United States Patent 7,482,117 (GENETIC POLYMORPHISMS ASSOCIATED WITH MYOCARDIAL INFARCTION, METHODS OF DETECTION AND USES THEREOF) - sequence listing, part 2

SEQ ID NO: 799 - DNA, 9104 bp, Homo sapiens
gcaagaccaggactcgggctggaggggcgctgggctcggacctgccaaggccacgggggwgcaagggacagaggcgggggtcctagctgacggcttttactgcctaggatgacgctgcggcttctggtggccgcgctctgcgccgggatcctggcagaggcsccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcayagcccaccagtgacttcttcttcttcgtcaatgacttcagcatcttgaggacactactgcccctcgtttcccggagagtgtgcacgactgctggtggcgtgcctgtgaccygacctccggatgactcgacctctgctccacgagacctggtgctgtctgagccaagcagccaatccttgagagtayagtggacagcggccagtggccctgtgactggctacaaggtccagtacactcctctgacggggctgggacagccactgccgagtgagcggyaggaggtgaacgtcccagctggtgagaccagtgtgcggctgcggggtctccggccactgaccgagtaccaagtgactgtgattgccctctamgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgygagtgtcctggagcccagtccctggtgccacccagtaccgcatcattgtgcgcagcacccagggggtkgagcggaccctggtgcttcctgggagtcagacagcattcgacttggatgacgttcaggctgggcttagctacactgtgcgggtgtctgctygagtgggtccccgtgagggcagtgccagtgtcctcactgtccgccgggagcyggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgygaggcagagaggagggccctgctgcagtcatcgtggctygaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctrrgtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagmgcagggcttccttctgcactggcaacctgagggtggccaggaacagtcccgggtcctggggcccgagctcagcagctatcacctggacgggctggagccagcgacacagtaccgcgtgaggctgagtgtcctarggccrgctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccytccccactgttcccactgaatggctcccatgaccttggcattatcttgcaaargatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtcyagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctccygggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctygaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggccccygaggaygagatggtgaagttggagagaaaggtgacgagggtcctccgggtgacccgggtttgcctggaaaagcaggcgagcgtggccttcggggggcacctgsagttcgggggcctgtgggtgaaaagggagaccagggagatcctggagaggatggacgaaatggcagccctggatcatctggacccaagggtgaccgtggggagccgggtcccccagracccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgacyggggtccccctrggctggatggccggagcggactggatgggaaaccaggagccgctgrgccctctgggccgaatggtgctgcaggcaaagctggggacccagggagagacgggcttccasgcctccgtrgagaacarggcctccctggcccctctggtccccctggattaccgggaaagccaggcgaggatggsaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtygaggccccaagggggactcaggcgaacagggccccccaggcaaggagggccccatcggctttcctggagaacgcgggctgaagggcgacbgtrgagaccctrrccctcaggrgccacctggtctggcccttggggagagggscccccccrsgccttccrgccttgccdgggagcctgraaagcctrdtattcccdggctcccagkcagggctgggggtgtgggagaggcagraaggccaggagagaggggagaacggggagagaaaggagaacgtggagaacagggcagagatgrccctcctrractccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacagggrtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggacccccmkgcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccrgagaccctggggaagatggtcagaaaggggctccaggacccaaaggtttcaagggtgacccaggagtcggggtcccgggctcccctgggcctcctggccctccaggtgtgaagggagatctgggcctccctgrcctgccmggtgctcctggtgttgttgggttcccgggtcagacaggccctcgaggagagatgggtcagccaggccctagtggagagcggggtctggcaggccycccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccgggtacgtatgtcwtactccacagccgaactcccttcatcccagctcttgcctctgatttccaacctctgagtcaatgaacctaatgtcaccatccagggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccagggtcaacctggtgcagcagggatccctggtgacccgggcgattctctttggtccctcactgacctcctctgacctcacatggaccctctccctgctagggatccccaggaaaggatggagtgcctggtatccgaggagaaaaaggagatgttggcttcatgggtcccyggkgcctcaagggtgaacggggagtgaagggagcctgtggccttgatggagagaagggagacaaggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactcckagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaagctgctgttttaaaaggct

SEQ ID NO: 800 - DNA, 2260 bp, Homo sapiens
tttcagcccgtgtctgaactctgtgctcatgttcctaccctctcaaatgctgtttgctgggttttcttagggtcagaaaggggctccaggacccaaaggtttcaaggtatgtgtacccagaagggtccctgctggggtcctggtygtgagactccctgagcttgatccgatgcctcttttcctcaaagggtgacccaggagtcggggtcccgggctcccctgggcctcctggccctccaggtgtgaagggagatctgggcctccctgrcctgccmggtgctcctggtgttgttgggttcccgggtcagacaggccctcgaggagagatgggtcagccaggccctagtggagagcggggtctggcaggccycccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccaggcaaggtcaacctggtgcagcagggatccctggtgacccgggatccccaggaaaggatggagtgcctggtatccgaggagaaaaaggagatgttggcttcatgggtcccyggkgcctcaagggtgaacggggagtgaagggagcctgtggccttgatggagagaagggagacaagggagaagctggtcccccaggccgccccgggctggcaggacacaaaggagagatggtgaggggagcctggtgtgccgggccagtcggggrcccctggcaaggagggcctgatcggtcccaagggtgacygaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcaggsccagaagggtgagcgaggtccccccrgagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactcckagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaagctgctgttttaaaaggc

SEQ ID NO: 801 - DNA, 9277 bp, Homo sapiens
gcaagaccaggactcgggctggaggggcgctgggctcggacctgccaaggccacgggggwgcaagggacagaggcgggggtcctagctgacggcttttactgcctaggatgacgctgcggcttctggtggccgcgctctgcgccgggatcctggcagaggcsccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcayagcccaccagtgacttcttcttcttcgtcaatgacttcagcatcttgaggacactactgcccctcgtttcccggagagtgtgcacgactgctggtggcgtgcctgtgaccygacctccggatgactcgacctctgctccacgagacctggtgctgtctgagccaagcagccaatccttgagagtayagtggacagcggccagtggccctgtgactggctacaaggtccagtacactcctctgacggggctgggacagccactgccgagtgagcggyaggaggtgaacgtcccagctggtgagaccagtgtgcggctgcggggtctccggccactgaccgagtaccaagtgactgtgattgccctctamgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgygagtgtcctggagcccagtccctggtgccacccagtaccgcatcattgtgcgcagcacccagggggtkgagcggaccctggtgcttcctgggagtcagacagcattcgacttggatgacgttcaggctgggcttagctacactgtgcgggtgtctgctygagtgggtccccgtgagggcagtgccagtgtcctcactgtccgccgggagcyggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgygaggcagagaggagggccctgctgcagtcatcgtggctygaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctrrgtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagmgcagggcttccttctgcactggcaacctgagggtggccaggaacagtcccgggtcctggggcccgagctcagcagctatcacctggacgggctggagccagcgacacagtaccgcgtgaggctgagtgtcctarggccrgctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccytccccactgttcccactgaatggctcccatgaccttggcattatcttgcaaargatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtcyagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctccygggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctygaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggccccygaggaygagatggtgaagttggagagaaaggtgacgagggtcctccgggtgacccgggtttgcctggaaaagcaggcgagcgtggccttcggggggcacctgsagttcgggggcctgtgggtgaaaagggagaccagggagatcctggagaggatggacgaaatggcagccctggatcatctggacccaagggtgaccgtggggagccgggtcccccagracccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgacyggggtccccctrggctggatggccggagcggactggatgggaaaccaggagccgctgrgccctctgggccgaatggtgctgcaggcaaagctggggacccagggagagacgggcttccasgcctccgtrgagaacarggcctccctggcccctctggtccccctggattaccgggaaagccaggcgaggatggsaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtygaggccccaagggggactcaggcgaacagggccccccaggcaaggagggccccatcggctttcctggagaacgcgggctgaagggcgacbgtrgagaccctrrccctcaggrgccacctggtctggcccttggggagagggscccccccrsgccttccrgccttgccdgggagcctgraaagcctrdtattcccdggctcccagkcagggctgggggtgtgggagaggcagraaggccaggagagaggggagaacggggagagaaaggagaacgtggagaacagggcagagatgrccctcctrractccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacagggrtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggacccccmkgcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccrgagaccctggggaagatggtcagaaaggggctccaggacccaaaggtttcaagggtgacccaggagtcggggtcccgggctcccctgggcctcctggccctccaggtgtgaagggagatctgggcctccctgrcctgccmggtgctcctggtgttgttgggttcccgggtcagacaggccctcgaggagagatgggtcagccaggccctagtggagagcggggtctggcaggccycccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtcccyggkgcctcaagggtgaacggggagtgaagggagcctgtggccttgatggagagaagggagacaagggagaagctggtcccccaggccgccccgggctggcaggacacaaaggagagatgggggagcctggtgtgccgggccagtcggggrcccctggcaaggagggcctgatcggtcccaagggtgacygaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcaggsccagaagggtgagcgaggtccccccrgagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactcckagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaagctgctgttttaaaaggct

SEQ ID NO: 802 - DNA, 1992 bp, Homo sapiens
ctctctcttgtgccctggtcacccccttcagcctccactgacctcccatgaccctgcgtcccccactgattcccctcactgatccccggtgtcctgttggtctccagggagaccctggagtagggctgcctgggccccgaggcgagcgtggggagccaggcatccgggtacgtatgtcwtactccacagccgaactcccttcatcccagctcttgcctctgatttccaacctctgagtcaatgaacctaatgtcaccatccagggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtcccyggkgcctcaagggtgaacggggagtgaagggagcctgtggccttgatggagagaagggagacaagggagaagctggtcccccaggccgccccgggctggcaggacacaaaggagagatgggggagcctggtgtgccgggccagtcggggrcccctggcaaggagggcctgatcggtcccaagggtgacygaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcaggsccagaagggtgagcgaggtccccccrgagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactcckagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaagctgctgttttaaaaggct

SEQ ID NO: 803 - DNA, 1469 bp, Homo sapiens
agttcccactgcagcrcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggagccagggctgaggtcagtgctgaccaggtggccacrgtgatgtgggactacttcagccagctgagcaacaatgccaaggaggccgtggaacatctccagaaatctgaactcacccagcaactcaatgccctcttccaggacaaacttggagaagtgaacacttaygcargygacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcarcacgcaggcygagcagctgcggcgccagctgaccccctackcacagcgcatggagagagtgctgcgggagaacgccgacagcctgcaggcctygctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccraggagctcaaggccaggatctcggccagtgcygaggagctgcrgcagaggctggcgcccttggccgaggacgtgcgtggcaacctgargggcaacacygaggggctgcagaagtcactggcagagctgggtgggcacctrgaccagcaggtggaggagttccgacgccggstggagccctacggggaaaacttcaacaaagccctggtgcagcagatggaacagctcaggcagaaactgggcccccatgcgggggacgtkgaaggccacttgagcttcctggagaaggacctgagggacaaggtcaactccttcttcagcaccttcaaggagaaagagagccaggacaagwctctctccctccctgagctggagcaacagcaggaacagcakcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctc

SEQ ID NO: 804 - DNA, 1466 bp, Homo sapiens
agttcccactgcagcgcaggtgagctctcctgaggacctctctgtcagctcccctgattgtagggaggcatccagtgtggcaagaaactcctccagcccagcaagcagctcaggatgttcctgaaggccgtggtcctgaccctggccctggtggctgtcgccggagccagggctgaggtcagtgctgaccaggtggccacrgtgatgtgggactacttcagccagctgagcaacaatgccaaggaggccgtggaacatctccagaaatctgaactcacccagcaactcaatgccctcttccaggacaaacttggagaagtgaacacttaygcargygacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcarcacgcaggcygagcagctgcggcgccagctgaccccctackcacagcgcatggagagagtgctgcgggagaacgccgacagcctgcaggcctygctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccraggagctcaaggccaggatctcggccagtgcygaggagctgcrgcagaggctggcgcccttggccgaggacgtgcgtggcaacctgargggcaacacygaggggctgcagaagtcactggcagagctgggtgggcacctrgaccagcaggtggaggagttccgacgccggstggagccctacggggaaaacttcaacaaagccctggtgcagcagatggaacagctcaggacgaaactgggcccccatgcgggggacgtkgaaggccacttgagcttcctggagaaggacctgagggacaaggtcaactccttcttcagcaccttcaaggagaaagagagccaggacaagwctctctccctccctgagctggagcaacagcaggaacagcakcaggagcagcagcaggagcaggtgcagatgctggcccctttggagagctgagctgcccctggtgcactggccccaccctcgtggacacctgccctgccctgccacctgtctgtctgtcccaaagaagttctggtatgaacttgaggacacatgtccagtgggaggtgagaccacctctcaatattcaataaagctgctgagaatctagcctc

SEQ ID NO: 805 - DNA, 4820 bp, Homo sapiens
gcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacrcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgytgggactcccagccaggggatgaggcccagccccagaacctgsagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagygagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctamctgacatcctgggccagccggagcccccacaggagggtgggagccagaagtccccacctccagggtccctggagtacctgtgtctgcctgctggggggcaggtgcaactggtccctctggcccaggcgatggkaccrggacaggccrtggaagtggagagaaggccgagccagggggctgcagggagtccctccctggagtccgggggaggccctgcccctcctgctcttgggccaagggtgggaggacaggaccaaaaggacagccctgtggctatayccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccrgcagatgtgtccccaacatccccacagccmgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagargcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccawctccccctcatttttttaatcaggtttccttgcttttgccatttttcttccttcttttttcactgatttattatgagagtggggctgaggtctgagctgagccttatcagactgagatkcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggygggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacrgatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaa

SEQ ID NO: 806 - DNA, 4871 bp, Homo sapiens
cactctgcctagaggctccagaagaagactggtctctcccaccacacagaggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacrcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgytgggactcccagccaggggatgaggcccagccccagaacctgsagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagygagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctamctgacatcctgggccagccggagcccccacaggagggtgggagccagaagtccccacctccagggtccctggagtacctgtgtctgcctgctggggggcaggtgcaactggtccctctggcccaggcgatggkaccrggacaggccrtggaagtggagagaaggccgagccagggggctgcagggagtccctccctggagtccgggggaggccctgcccctcctgctcttgggccaagggtgggaggacaggaccaaaaggacagccctgtggctatayccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccrgcagatgtgtccccaacatccccacagccmgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagargcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccawctccccctcatttttttaatcaggtttccttgcttttgccatttttcttccttcttttttcactgatttattatgagagtggggctgaggtctgagctgagccttatcagactgagatkcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggygggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacrgatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaa

SEQ ID NO: 807 - DNA, 4889 bp, Homo sapiens
cactctgcctagaggctccagaagaagactggtctctcccaccacacagaggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacrcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgytgggactcccagccaggggatgaggcccagccccagaacctgsagtgcttctttgacggggccgccgtgctcagctgctcctgggaggtgaggaaggaggtggccagctcggtctcctttggcctattctacaagcccagcccagatgcaggctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagygagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctamctgacatcctgggccagccggagcccccacaggagggtgggagccagaagtccccacctccagggtccctggagtacctgtgtctgcctgctggggggcaggtgcaactggtccctctggcccaggcgatggkaccrggacaggccrtggaagtggagagaaggccgagccagggggctgcagggagtccctccctggagtccgggggaggccctgcccctcctgctcttgggccaagggtgggaggacaggaccaaaaggacagccctgtggctatayccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccrgcagatgtgtccccaacatccccacagccmgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagargcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccawctccccctcatttttttaatcaggtttccttgcttttgccatttttcttccttcttttttcactgatttattatgagagtggggctgaggtctgagctgagccttatcagactgagatkcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggygggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacrgatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaa

SEQ ID NO: 808 - DNA, 2106 bp, Homo sapiens
atgtgaaggcacaagctgctgttayatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaagsagtgactacagtgaaaccaggtgacaaagtcatccctctctttctgccacaatgtagagaatgcaatgcttgtcgcaacccagatggcaacctttgcattaggagcgatattactggtcrtggagtactggctgatggcaccaccagatttacatgcaagggcaaaccagtmcaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctagratcattgggattgacctcaacraagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatrttttaccatttaaaaaaatcagtgaaggatttgagctgctcaattcaggacaaagcattcgaacggtcctgacgttttgagatccaaagtggcargaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctayaattgtatcttttaagaaaacatacacttggatttctatgttgaaatggagatttttaagagttttaaccagctgctgcagatatatawctcaaaacagatatagcgtataaagatatagtaaatgcatctccyagagtaatattcacttaacacattgaaactattattttttagatttgaatataaatgtattttttaaacacttgttatgagttaasttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagartcatattatcatacttatcataatgttcaatttgatacagtagaattgcaagtccytaagtccctattcactgtgcttagtagtgactccatttaataaaaagtgtttttagtttttaacaactacactgatgtatctatatatatctataacatgttaaaaattcttaagaaaattaaaaattatat

SEQ ID NO: 809 - DNA, 2048 bp, Homo sapiens
atgtgaaggcacaagctgctgttatatacaacagagtgaactgagcatcagtcagaaaaagtctatgtttgcagaaatacagatccaagacaaagacaggatgggcactgctggaaaagttattaaatgcaaagcagctgtgctttgggagcagaagcaacccttctccattgaggaaatagaagttgccccaccaaagactaaagaagttcgcattaagattttggccacaggaatctgtcgcacagatgaccatgtgataaaaggaacaatggtgtccaagtttccagtgattgtgggacatgaggcaactgggattgtagagagcattggagaagsagtgactacagtgaaaccaggtgacaaagtcatccctctctttctgccacaatgtagagaatgcaatgcttgtcgcaacccagatggcaacctttgcattaggagcgatattactggtcrtggagtactggctgatggcaccaccagatttacatgcaagggcaaaccagtmcaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtcaaacctggttccacttgcgtcgtctttggcctgggaggagttggcctgtcagtcatcatgggctgtaagtcagctggtgcatctagratcattgggattgacctcaacraagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatgattgatgccctggcatcctgccacatgaactatgggaccagcgtggttgtaggagttcctccatcagccaagatgctcacctatgacccgatgttgctcttcactggacgcacatggaagggatgtgtctttggaggtttgaaaagcagagatgatgtcccaaaactagtgactgagttcctggcaaagaaatttgacctggaccagttgataactcatrttttaccatttaaaaaaatcagtgaaggatttgagctgctcaattcaggacaaagcattcgaacggtcctgacgttttgagatccaaagtggcargaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctayaattgtatcttttaagaaaacatacacttggatttctatgttgaaatggagatttttaagagttttaaccagctgctgcagatatatawctcaaaacagatatagcgtataaagatatagtaaatgcatctccyagagtaatattcacttaacacattgaaactattattttttagatttgaatataaatgtattttttaaacacttgttatgagttaasttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagartcatattatcatacttatcataatgttcaatttgatacagtagaattgcaagtccytaagtccctattcactgtgcttagtagtgactccatttaataaaaagtgtttttagtttttaacaactaaaccg

SEQ ID NO: 810 - DNA, 2296 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 811 - DNA, 2183 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttgggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 812 - DNA, 2086 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 813 - DNA, 2412 bp, Homo sapiens
atgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctgga

SEQ ID NO: 814 - DNA, 5051 bp, Homo sapiens
cggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcmgcagcagcggagctgtggacccttcagtgcaacggtcattcacccaggtcacattaccttccttctctccctcggcggcctccccacaggctccaactctgcaagtcaaggtttctcccacctcagttccmaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcrccacaggtgcagcaggtcccggtcctggtccagcctcagatcatcaagacagattcccttgttttgaccacactgaagacagatggcagccctgttatggctgcggtccagaacccggccctcacygccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagaggagattttgcagctgctgccgscaacctacaaacctgcctggcagttttgggccgggcactgcccacctcccgcctggacctggcctgcagcctctcctggaacrtgatccgctacagcctgcagaagctacgcctggtgcgctggctgctcaagaaagtcttccagtgccrgcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccagsagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgmggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctcyccccctcagcatcttcccgctgagagtggtggggargagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgcyaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaagatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcargaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 815 - DNA, 5232 bp, Homo sapiens
cggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcmgcagcagcggagctgtggacccttcagtgcaacggtcattcacccaggtcacattaccttccttctctccctcggcggcctccccacaggctccaactctgcaagtcaaggtttctcccacctcagttccmaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcrccacaggtgcagcaggtcccggtcctggtccagcctcagatcatcaagacagattcccttgttttgaccacactgaagacagatggcagccctgttatggctgcggtccagaacccggccctcacygccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagaggagattttgcagctgctgccgscaacctacaaacctgcctggcagttttgggccgggcactgcccacctcccgcctggacctggcctgcagcctctcctggaacrtgatccgctacagcctgcagaagctacgcctggtgcgctggctgctcaagaaagtcttccagtgccrgcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccagsagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgmggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctcyccccctcagcatcttcccgctgagagtggtggggargagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgcyaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcargaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccrgagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagcac

SEQ ID NO: 816 - DNA, 787 bp, Homo sapiens
ctttcccctgctaccagacacgcggtcacgtggggccatcgcgggctgccggcgcgggaagccgcgcgagaggcggccgaggggtgcgtgagccggcgccactgcttgcagtgcgcggcttgggagcccgcccctcctgcacggaggagtcggcctgccgccgcggcggcatctggaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaaggaaaagaaaaatgagctgtaccatctgtggtcataaattccctcgaaagagccaattgttggaacacatgtatacacacaaagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccgtcctataaaggaagcatttcatatcaaagcatggaaaatggctggagagacagaattgtcttctttttgccattaaacctcatgtgaattacccactgataaacgaacactaaccaagaaatttggcctgggtttgaatctcagctccgaaactta

SEQ ID NO: 817 - DNA, 3344 bp, Homo sapiens
agtgtgatccccyggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaracttgctagaggtgacctcaatgactgtttcattccttgtacgcctaagggatgcttggaactcatcaaagagacaggggtgcygattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcrtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccrgatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccytgaaacagaacaggtgaatggattattctaaacagacttccctgaggggagaggggatagtaatgagagttggcaataaccaatgaattgaaatatttatatttcaacacatttttggaagaagcgcagcatggcttgtcacaggttgacagtgtaggggagaaaactgctgtccaataaactacagaggaaactacaggagagatcaccatccatcttcaagaagctactttraaagtctggccagtgtctattcaggcccactgggagttaggaagtataagtaagccaagagaagtcagcccctgyccagaagatctgaaactaatagtaggagtttccccagamgtcattttcagccttaattctcatcatgtataaattaacataaatcatgcatgtctgtttactttagtgacgttccacagaataaaaggaaacaagtttgcc

SEQ ID NO: 818 - DNA, 3217 bp, Homo sapiens
agtgtgatccccyggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaracttgctagaggtgacctcaatgactgtttcattccttgtacgcctaagggatgcttggaactcatcaaagagacaggggtgcygattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcrtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccrgatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccytgaaacagaacaggtgaatggattattctaaacagatcaccatccatcttcaagaagctactttraaagtctggccagtgtctattcaggcccactgggagttaggaagtataagtaagccaagagaagtcagcccctgyccagaagatctgaaactaatagtaggagtttccccagamgtcattttcagccttaattctcatcatgtataaattaacataaatcatgcatgtctgtttactttagtgacgttccacagaataaaaggaaacaagtttgccatcttggtgttgcaatatgaattacagccttaacagactgtg

SEQ ID NO: 819 - DNA, 1502 bp, Homo sapiens
  misc_feature (1)...(1502): n = A,T,C or G, or insertion/deletion polymorphism (see Tables 1-2)
gctccrcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcmcccyaagatgcatcttgcccacagcamcctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 820 - DNA, 1416 bp, Homo sapiens
  misc_feature (1)...(1416): n = A,T,C or G, or insertion/deletion polymorphism (see Tables 1-2)
gctccrcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggttctccccatgacaccacctgaacgtctcttcctcccaagggtgngtggcaccaccctacacctcctccttctggggctgctgctggttctgctgcctggggcccaggggctccctggtgttggcctcacaccttcagctgcccagactgcccgtcagcmcccyaagatgcatcttgcccacagcamcctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 821 - DNA, 1878 bp, Homo sapiens
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcstatggttttgagaagcccyctgccatccagcagcgagccattctaccttgtatcaagggttatgatgtgattgctcaagcccaatctgggactgggaaaacggccacatttgccatatcrattctgcagcagattgaattagatctaaaagccacccaggccttggtcctagcacccactcgagaattggctcagcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgcttaaccgsagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttastcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactrtgtcactcagcctcatttgctggaccaaatctggagggagaacccctaaaacycctaagtgaggttgcccagggggttgtccccaggtggggggaagcaggggagagaaaatggtagccatttttacattgttttgtatagtatttattgattcaggaaacaaacacaaaattctgaataaaatgacttggaaactgcct

SEQ ID NO: 822 - DNA, 1699 bp, Homo sapiens
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcstatggttttgagaagcccyctgccatccagcagcgagccattctaccttgtatcaagggttatgatgtgattgctcaagcccaatctgggactgggaaaacggccacatttgccatatcrattctgcagcagattgaattagatctaaaagccacccaggccttggtcctagcacccactcgagaattggctcagcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgcttaaccgsagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttastcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaactggggggaagcaggggagagaaaatggtagccatttttacattgttttgtatagtatttattgattcaggaaacaaacacaaaattctgaataaaatgacttggaaactgc

SEQ ID NO: 823 - DNA, 1637 bp, Homo sapiens
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcstatggttttgagaagcccyctgccatccagcagcgagccattctaccttgtatcaagggttatgatgtgattgctcaagcccaatctgggactgggaaaacggccacatttgccatatcrattctgcagcagattgaattagatctaaaagccacccaggccttggtcctagcacccactcgagaattggctcagcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgcttaaccgsagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctgggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaactggggggaagcaggggagagaaaatggtagccatttttacattgttttgtatagtatttattgattcaggaaacaaacacaaaattctgaataaaatgacttggaaactgc

SEQ ID NO: 824 - DNA, 1880 bp, Homo sapiens
ggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcstatggttttgagaagcccyctgccatccagcagcgagccattctaccttgtatcaagggttatgatgtgattgctcaagcccaatctgggactgggaaaacggccacatttgccatatcrattctgcagcagattgaattagatctaaaagccacccaggccttggtcctagcacccactcgagaattggctcagcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgcttaaccgsagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtcatggagatatggaccaaaaggaacgagacgtgattatgagggagtttcgttctggctctagcagagttttgattaccactgacctgctggccagaggcattgatgtgcagcaggtttctttastcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactrtgtcactcagcctcatttgctggaccaaatctggagggagaacccctaaaacycctaagtgaggttgcccagggggttgtccccaggtggggggaagcaggggagagaaaatggtagccatttttacattgttttgtatagtatttattgattcaggaaacaaacacaaaattctgaataaaatgacttggaaactgcct

SEQ ID NO: 825 - DNA, 720 bp, Homo sapiens
tacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcrgagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgattatgctttaatgctgttatctatyttattgttcttgaaaatacctgcattttttggtatcatgttcaaccaaca

SEQ ID NO: 826 - DNA, 1224 bp, Homo sapiens
tacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcrgagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatyttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactytgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtgkatgtgtttgtctacaagtawgattgctgttamataacaccccaaattaactcccaaattaaaacacagttgtgctgtcaatacctcatactgctttacctttttttcctggatatctgtgtattttcaaatgttactatatattaaagcagaaatataaccaaaggttaa

SEQ ID NO: 827 - DNA, 4225 bp, Homo sapiens
ggcctcaaagatcccagcgcactaggagggtggtttgtggctccctgcagtccccacgccccggatccaaacgacagagttcggggactcacaggggcagcaaggcggcagagccgcggagccagtgcaacttctccggcgggaccgcgcccaatcttccccgccgcagtcggggagccccgggggccgccgagcacaggctgcggaccgcggcgggcacgtgggctcggctgcagcgctgcgccaggcaccggctgctcggctctgcccaacctctccgctcccgcctcggtccctgcctctggggagagggttcctccccccttccactttgcaccagtccgagggaatttgcggtcggtgacgcgcatccttaagagagccacctgcagcgcgaggcgcgccgctccaggcggcatcgcagggctgggccggcgcggcctggggaccccgggctccggaggccatgccggcgttggcgcgcgrcggcggccagctgccgctgctcgttsttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgaygccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggayggacataaggtgctgtgccagaaatgaactgggcagggaatgcaccargctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacracaccggatactacacttgttcctcttcaaagcatcccagtcaatcagctttggttaccatcgtagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcrttttaaccctgctratttgtcacaagtacaaaaagcaatttaggtatgaaagccagctacagatggtacaggtgaccggctcctcagataatgagtacttctacgttgatttcagagaatatgaatatgatctcaaatgggagttyccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcracctttcagcagagagatggatttggggctactctctccrcagsctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaamcccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccac

SEQ ID NO: 828 - DNA, 3475 bp, Homo sapiens
cgaggcggcatccgagggctgggccggcgccctgggggaccccgggctccggaggccatgccggcgttggcgcgcgacgcgggcaccgtgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgaygccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggayggacataaggtgctgtgccagaaatgaactgggcagggaatgcaccargctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacracaccggatactacacttgttcctcttcaaagcatcccagtcaatcagctttggttaccatcgtaggaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcrttttaaccctgctratttgtcacaagtacaaaaagcaatttaggtatgaaagccagctacagatggtacaggtgaccggctcctcagataatgagtacttctacgttgatttcagagaatatgaatatgatctcaaatgggagttyccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcracctttcagcagagagatggatttggggctactctctccrcagsctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagccgtctgcgtttactcttgttttcaaagggacttttgtaaaatcaaatcatcctgtcacaaggcaggaggagctgataatgaactttattggagcattgatctgcatccaaggccttctcaggccggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacag

SEQ ID NO: 829 - protein, 441 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 830 - protein, 443 aa, Homo sapiens
MQRVNMIMAESPGLITICLLGYLLSAECTVFLDHENANKILNRPKRYNSGKLEEFVQGNLERECMEEKCSFEEAREVFCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 831 - protein, 226 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQILLKLKPFWITSLKAPNHLMTSLGLLVEKMPNQVNSLGRLF

SEQ ID NO: 832 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 833 - protein, 485 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 834 - protein, 485 aa, Homo sapiens; identical to SEQ ID NO: 833

SEQ ID NO: 835 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 836 - protein, 384 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHEFDSFHQQEEPFPEVLS

SEQ ID NO: 837 - protein, 541 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 838 - protein, 541 aa, Homo sapiens; identical to SEQ ID NO: 837

SEQ ID NO: 839 - protein, 134 aa, Homo sapiens
MKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPGKQTFRGRER

SEQ ID NO: 840 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 841 - protein, 344 aa, Homo sapiens; identical to SEQ ID NO: 840

SEQ ID NO: 842 - protein, 430 aa, Homo sapiens [sequence omitted]

SEQ ID NO: 843 - protein, 168 aa, Homo sapiens [sequence omitted]

SEQ ID NO: 844 - protein, 237 aa, Homo sapiens
MSKRKWRGFRGAQQERAQPPAASPQPCPAPHAGLPGGSRRRAPAPAGQQQMRAESRSGAQRRRGSARRGAHREAGGCVRGRTRSSGSERSNALWQAVDAAEALALSSPLRRPWDQAQHFTNPAPVSKGPQSAPPSPPAGRRRRGADLALAPLAGEGHTRWRHRPAWEVGLRTRTATLHTRQHRPPQGCSICPKPKELPCQDLGAVETAGNLLCPHLLWPLDGSTWSQPRNSRSQLCD

SEQ ID NO: 845 - protein, 670 aa, Homo sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 846 - protein, 670 aa, Homo sapiens
MGEPAGVAGTMESPFSPGLFHRLDEDWDSALFAELGYFTDTDELQLEAANETYENNFDNLDFDLDLLPWESDIWDINNQICTVKDIKAEPQPLSPASSSYSVSSPRSVDSYSSTQHVPEELDLSSSSQMSPLSLYGENSNSLSSPEPLKEDKPVTGSRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVGPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGVVEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 847 - protein, 1405 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 848 - protein, 1406 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 849 - protein, 1436 aa, Homo sapiens [sequence omitted]

SEQ ID NO: 850 - protein, 1432 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKFLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 851 - protein, 699 aa, Homo sapiens [sequence omitted]

SEQ ID NO: 852 - protein, 699 aa, Homo sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 853 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 854 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 855 - protein, 635 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIENVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 856 - protein, 324 aa, Homo sapiens
MLARRKPMLPALTINPTIAEGPSPTSEGASEANLVDLQKKLEELELDEQQKRLEAFLTQKAKVGELKDDDFERTSELDAGNGGVVTKVQHRPSGLIMARKLIHLEIKPAIRNQIIREHQVLHECNSPYIVGFYGAFYCDREISICMEHMDGGSLDQGLKEAKRIPEDILGKVSIAVLRGLAYLREKHQIMHRNVKPSNILVNSRGEIKLCDFGVSGQLIDSMANSFVGTRSYMAPERLQGTHYSVQSVIWSMDLSLVELAIERYPIPPPDAKELEAIFGQPVVDREEGEPHSISSWPGSPGAPTAVTGWTACPPWPSSNCWTIL

SEQ ID NO: 857 - protein, 324 aa, Homo sapiens; identical to SEQ ID NO: 856

SEQ ID NO: 858 - protein, 400 aa, Homo sapiens [sequence omitted]

SEQ ID NO: 859 - protein, 36 aa, Homo sapiens
MTAVGLECSPPCEIIVRATLICLRMLYSTTHNCSIF

SEQ ID NO: 860 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 861 - protein, 1368 aa, Homo sapiens [sequence omitted]

SEQ ID NO: 862 - protein, 375 aa, Homo sapiens
MAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 863 - protein, 363 aa, Homo sapiens
MAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 864 - protein, 354 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVVCHPNGQKLFVYDPNNPPSSEVLRIQNILSEKPTVTTVYANNGSVLQGSSVASVYDGKLLIGTLYHRALYCEL

SEQ ID NO: 865 - protein, 267 aa, Homo sapiens
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 866 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 867 - protein, 392 aa, Homo sapiens
MMWRIYVSLESVVGLDLYGQCVCASCVSCYWPGLGQEPSTLGPTPCVLGSPRGSVRDDLGTKEMMGASSLTAWISVPFSRTLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 868 - protein, 366 aa, Homo sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 869 - protein, 363 aa, Homo sapiens
MAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 870 - protein, 360 aa, Homo sapiens
MSIQKTYLEGDFVFPVSSSSFLRTLLEPQLGSALLTAMNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 871 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 872 - protein, 260 aa, Homo sapiens; identical to SEQ ID NO: 871

SEQ ID NO: 873 - protein, 260 aa, Homo sapiens; identical to SEQ ID NO: 871

SEQ ID NO: 874 - protein, 62 aa, Homo sapiens
MNLCNKHLSQNMCHQTPASSERWHQSCFHCQRKEGERNLAEQSWQTFILENLEMSGAREHQW

SEQ ID NO: 875 - protein, 53 aa, Homo sapiens
  VARIANT (1)...(53): Xaa = Any Amino Acid
MPDVRSKGAPVVEEPASPGSIKGHRPMRITRPALSSTLGGHSRAQESERKWKX

SEQ ID NO: 876 - protein, 794 aa, Homo sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 877 - protein, 400 aa, Homo sapiens
MRVVIRVCFGGPEKMQVQLPGTDQLPAAGFLPLVSDQGRPCAIQGAEQESSSFSHHPASGNTLQLASHLTEAFSCSGSHGPLQLGMLILASSHPRTKGTEGNGVMKQDWGEKGEGLLSSREKRRPSETLLAPTESSAPANEQQQRSPETVSPSFLEERNTIGGRITPRVLTLALDATRCAHLPHVTSQPPHYSKECECFKTTNHQTTAERTPSLIGLSSLFLSELSGLAPSRLKTERPFTGIAFNSPHFRDGGRGRRIKPPPPPAVDTGGSSRSPHPRASLLTPTRHHQNKSYQIAKDSECGATLLINYVQRKCGAAEERATRRRPQQNQGQGSALAKHNTLPAPPQTLALKPQRTTPLARDGRLGVPVRRRLHPALRARVSECTSAPTTHPPTHTRMRP

SEQ ID NO: 878 - protein, 164 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITVSQKMKSFSLYDEFISLMSDYFFL

SEQ ID NO: 879 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 880 - protein, 772 aa, Homo sapiens
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 881 - protein, 772 aa, Homo sapiens; identical to SEQ ID NO: 880

SEQ ID NO: 882 - protein, 772 aa, Homo sapiens; identical to SEQ ID NO: 880

SEQ ID NO: 883 - protein, 772 aa, Homo sapiens; identical to SEQ ID NO: 880

SEQ ID NO: 884 - protein, 395 aa, Homo sapiens
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGNILLLSEPENADSLMLVDFEYSSYNYRGFDIGNHFCEWVYDYTHEEWPFYKARPTDYPTQEQQLHFIRHYLAEAKKGETLSQEEQRKLEEDLLVEVSRYALASHFFWGLWSILQASMSTIEFGYLDYAQSRFQFYFQQKGQLTSVHSSS

SEQ ID NO: 885 - protein, 772 aa, Homo sapiens; identical to SEQ ID NO: 880

SEQ ID NO: 886 - protein, 772 aa, Homo sapiens; identical to SEQ ID NO: 880

SEQ ID NO: 887 - protein, 772 aa, Homo sapiens; identical to SEQ ID NO: 880

SEQ ID NO: 888 - protein, 540 aa, Homo sapiens [sequence omitted]

SEQ ID NO: 889 - protein, 414 aa, Homo sapiens [sequence omitted]

SEQ ID NO: 890 - protein, 605 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 891 - protein, 562 aa, Homo sapiens [sequence omitted]

SEQ ID NO: 892 - protein, 546 aa, Homo sapiens [sequence omitted]

SEQ ID NO: 893 - protein, 249 aa, Homo sapiens
MNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQVGPTWRPAEPEL

SEQ ID NO: 894 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 895 - protein, 1102 aa, Homo sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 896 - protein, 1102 aa, Homo sapiens; identical to SEQ ID NO: 895

SEQ ID NO: 897 - protein, 4655 aa, Homo sapiens [sequence omitted]

SEQ ID NO: 898 - protein, 205 aa, Homo sapiens [sequence omitted]

SEQ ID NO: 899 - protein, 215 aa, Homo sapiens
MEWLLVTRTVLIMDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEVCDQLPGHFVK

SEQ ID NO: 900 - protein, 77 aa, Homo sapiens
LLRRLRSSCARQSRGAEEEAIAWPRLSGPCLARERKQRQPENCFNHGQTKLTDECFSPGNKLASWVSSSVSTDSIPR

SEQ ID NO: 901 - protein, 119 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLED

SEQ ID NO: 902 - protein, 128 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQVISKTQNTHKKQNCASSLLNQISK

SEQ ID NO: 903 - protein, 318 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 904 - protein, 186 aa, Homo sapiens [sequence omitted]

SEQ ID NO: 905 - protein, 311 aa, Homo sapiens
MNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 906 - protein, 1122 aa, Homo sapiens
MEPSEVPSQISKDNFLEVPNLSDSLCEDEEVTFQPGFSPQPSRRGSDSSEDIYLDTPSSGTRRVSFADSFGFNLVSVKEFDCWELPSASTTFDLGTDIFHTEEYVLAPLFDLPSSKEDLMQQLQIQKAILESTESLLGSTSIKGIIRVLNVSFEKLVYVRMSLDDWQTHYDILAEYVPNSCDGETDQFSFKIVLVPPYQKDGSKVEFCIRYETSVGTFWSNNNGTNYTFICQKKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTMQIPCPSSDQLMAGNLNKKHEGGAKKIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDHRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 907 - protein, 921 aa, Homo sapiens
MKKLLSNLVSPLNQVDEVLILLKTYTWIPHLQKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTMQIPCPSSDQLMAGNLNKKHEGGAKKIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDHRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 908 - protein, 291 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRTGRSVSSPATASMRPCLLSIRSG

SEQ ID NO: 909 - protein, 516 aa, Homo sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 910 - protein, 482 aa, Homo sapiens [sequence omitted]

SEQ ID NO: 911 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 912 - protein, 293 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRCRTGRSVSSPATASMRPCLLSIRSG

SEQ ID NO: 913 - protein, 195 aa, Homo sapiens
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 914 - protein, 201 aa, Homo sapiens
APYRCGSPPSRGHLGGWGRGLGGAGFGRERRGGSARLAVSQPGSCRHGADRVGHVGQRTGAGVRPDPHHRGHRGHSWALHPVVLWCLLHCGGRVCVPAGVPPGEEEEGLHHGALGTEVHDRRGEAVRALYQELLCSGRPASPALGARRLPAGHHPWDRLPGHCERHLPTGEWRPLRSAPATPIPSPCPDTLGHAWPLKPAL

SEQ ID NO: 915 - protein, 170 aa, Homo sapiens [sequence omitted]

SEQ ID NO: 916 - protein, 195 aa, Homo sapiens
MGQIEWAMWANEQALASGLILITGGIVATAGRFTQWYFGAYSIVAGVFVCLLEYPRGKRKKGSTMERWGQKHMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAAAAGGPPGGPQVNPIPVTDEVV

SEQ ID NO: 917 - protein, 467 aa, Homo sapiens [sequence omitted]

SEQ ID NO: 918 - protein, 179 aa, Homo sapiens
MQMSPALTCLVLGLALVFGEGSAVHHPPSYVAHLASDFGVRVFQQVAQASKDRNVVFSPYGVASVLAMLQLTTGGETQQQIQAAMGFKIDGEPRDTRGGGWHAEQTYQKPRKGWLWLSRAKPHTAVLQGPPHLLPTTLQVTGPLNLQGCLTSRFTAYSPPCDLNLVKFAHLQNEDYLLS

SEQ ID NO: 919 - protein, 402 aa, Homo sapiens [sequence omitted]

SEQ ID NO: 920 - protein, 402 aa, Homo sapiens [sequence omitted]

SEQ ID NO: 921 - protein, 285 aa, Homo sapiens
MLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 922 - protein, 215 aa, Homo sapiens
LQLCLYGCCAPGGHPPHTRHQIVGSSWPSPAALQPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALFTVPQPGVPAGRRVVRLSAKHLPRLPDHSV

SEQ ID NO: 923 - protein, 323 aa, Homo sapiens
ELTRPREDTQGAVVHLRVGGGHALFSLSQGRRPSRSPGSLCWTIRARIGRTRWASGCAPGGHPPHTRHQIVGSSWPSPAALQPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 924 - protein, 328 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 925 - protein, 315 aa, Homo sapiens
MGGCAGSRRRFSDSEGEETVPEPRLPLLDHQGAHWKNAVGFWLLGLCNNFSYVVMLSAAHDILSHKRTSGNQSHPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 926 - protein, 223 aa, Homo sapiens
MLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 927 - protein, 390 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPSYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 928 - protein, 338 aa, Homo sapiens
MWTQAQRRSPTTAHHDLTATLSLRLPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 929 - protein, 421 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKVRMMAGFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 930 - protein, 339 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 931 - protein, 438 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 932 - protein, 384 aa, Homo sapiens
MLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 933 - protein, 1088 aa, Homo sapiens [sequence omitted]

SEQ ID NO: 934 - protein, 1097 aa, Homo sapiens [sequence omitted]

SEQ ID NO: 935 - protein, 1079 aa, Homo sapiens [sequence omitted]

SEQ ID NO: 936 - protein, 1088 aa, Homo sapiens
MDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGISSGGEAGTASGGEEAGTASGGDEAWTTSGKEEADLLGVRQTQYGAVPGERLLEATGKVWVLEEEGDEEREAEVSPFPKQAQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGALGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPSPLRHDGTPVPARRRPLGHGFGLAHPGMMQELQARLGRPKPQ

SEQ ID NO: 937 - protein, 130 aa, Homo sapiens
MGNPQRWASPIHTPPLGPEILRAMPEALGLRPDPATSVPSALSQRFRVLAQELSEKPGRNPRNGPRSSLFTLHHGIPVPELDSLPPTPYLSPWTLLEEKSLQGACCQRVSLPWEWRCRDRVFCCYCLFVF

SEQ ID NO: 938 - protein, 130 aa, Homo sapiens; identical to SEQ ID NO: 937

SEQ ID NO: 939 - protein, 365 aa, Homo sapiens [sequence omitted]

SEQ ID NO: 940 - protein, 365 aa, Homo sapiens [sequence omitted]

SEQ ID NO: 941 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 942 - protein, 49 aa, Homo sapiens
MQVSTAALAVLLCTMALCNQFSASRESEFRCGYHHSLAMVRPHQSFLVA

SEQ ID NO: 943 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 944 - protein, 178 aa, Homo sapiens
MLRAHRLHQLAFDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 945 - protein, 222 aa, Homo sapiens
MAAGSRTSLLLAFALLCLPWLQEAGAVQTVPLSRLFKEAMLQAHRAHQLAIDTYQEFISSWGMEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 946 - protein, 178 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGAGRWQPPDWADLQADLQQVRHKLTQR

SEQ ID NO: 947 - protein, 202 aa, Homo sapiens
MATGSRTSLLLAFGLLCLPWLQEGSAFPTIPLSRLFDNAMLRAHRLHQLAFDTYQEFNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 948 - protein, 217 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 949 - protein, 167 aa, Homo sapiens [sequence omitted]

SEQ ID NO: 950 - protein, 122 aa, Homo sapiens
MAPGSRTSLLLAFALLCLPWLQEAGAVQTVPLSRLFDHAMLQAHRAHQLAIDTYQEFRLEDGSRRTGQILKQTYSKFDTNSHNHDALLKNYGLLYCFRKDMDKVETFLRMVQCRSVEGSCGF

SEQ ID NO: 951 - protein, 256 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGVRVAPGVTNPGTPLASRAGGEKYCCPLFSSKALTQENSPYSSFRLVNPPGLSLHPEGEGGKWINERGREQCPSAWPLLLFLHFAEAGRRQPPDWADPQADLQQV

SEQ ID NO: 952 - protein, 199 aa, Homo sapiens
MAAGSRTSLLLAFALLCLPWLQEAGAVQTVPLSRLFKEAMLQAHRAHQLAIDTYQEFISSWGMDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 953 - protein, 217 aa, Homo sapiens
MAPGSRTSLLLAFALLCLPWLQEAGAVQTVPLSRLFDHAMLQAHRAHQLAIDTYQEFEETYIPKDQKYSFLHDSQTSFCFSDSIPTPSNMEETQQKSNLELLRISLLLIESWLEPVRFLRSMFANNLVYDTSDSDDYHLLKDLEEGIQTLMGRLEDGSRRTGQILKQTYSKFDTNSHNHDALLKNYGLLYCFRKDMDKVETFLRMVQCRSVEGSCGF

SEQ ID NO: 954 - protein, 213 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGVRVAPGVPNPGAPLTLRAVLEKHCCPLFSSQALTQENSPYSSFPLVNPPGLSLHPEGEGGK

SEQ ID NO: 955 - protein, 217 aa, Homo sapiens; identical to SEQ ID NO: 953

SEQ ID NO: 956 - protein, 128 aa, Homo sapiens
MEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 957 - protein, 122 aa, Homo sapiens
MATGSRTSLLLAFGLLCLPWLQEGSAFPTIPLSRLFDNAMLRAHRLHQLAFDTYQEFRLEDGSPRTGQIFKQTYSKFDTNSHNDDALLKNYGLLYCFRKDMDKVETFLRIVQCRSVEGSCGF

SEQ ID NO: 958 - protein, 202 aa, Homo sapiens; identical to SEQ ID NO: 947

SEQ ID NO: 959 - protein, 222 aa, Homo sapiens; identical to SEQ ID NO: 945

SEQ ID NO: 960 - protein, 122 aa, Homo sapiens; identical to SEQ ID NO: 957

SEQ ID NO: 961 - protein, 217 aa, Homo sapiens; identical to SEQ ID NO: 953

SEQ ID NO: 962 - protein, 177 aa, Homo sapiens
MATGSRTSLLLAFGLLCLPWLQEGSAFPTIPLSRLFDNAMLRAHRLHQLAFDTYQEFNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 963 - protein, 256 aa, Homo sapiens; identical to SEQ ID NO: 951

SEQ ID NO: 964 - protein, 256 aa, Homo sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWVRVAPGIPNPGAPLASRDWGEKHCCPLFSSQALTQENSPYSSFPLVNPPGLSLQPGGEGGKWMNERGREQCPSAWPLLLFLHFAEAGRWQPPDWADLQSVLQQV

SEQ ID NO: 965 - protein, 46 aa, Homo sapiens
MTHCSRTTGCSTASGRTWTRSRHSCAWCSAALWRAAVASRGPRGIL

SEQ ID NO: 966 - protein, 239 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGLEVATPVPTSLVLIKLSCIILSD

SEQ ID NO: 967 - protein, 199 aa, Homo sapiens; identical to SEQ ID NO: 952

SEQ ID NO: 968 - protein, 122 aa, Homo sapiens; identical to SEQ ID NO: 950

SEQ ID NO: 969 - protein, 139 aa, Homo sapiens
MAADSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 970 - protein, 178 aa, Homo sapiens
MLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 971 - protein, 137 aa, Homo sapiens [sequence omitted]

SEQ ID NO: 972 - protein, 245 aa, Homo sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLIGWKMAAPGLGRSSISPTASLTQNRTTMTHCSRTTGCSTASGRTWTRSRHSCASCSAALWRAAVASSCPGGIPVTPPQCLSWSWKVLLQCPPALS

SEQ ID NO: 973 - protein, 32 aa, Homo sapiens
MTHCSRTTGCSTASGRTWTRSRHSCAWCSAAL

SEQ ID NO: 974 - protein, 177 aa, Homo sapiens; identical to SEQ ID NO: 962

SEQ ID NO: 975 - protein, 217 aa, Homo sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 976 - protein, 91 aa, Homo sapiens
MAAPGLGRSSSRPTASSTQTHTTMTHYSRTTGCSTASGRTWTRSRHSCASCSAALWRAAVASSCPGGIPVTPPQCLSWPWKLPLQCPPALS

SEQ ID NO: 977 - protein, 122 aa, Homo sapiens; identical to SEQ ID NO: 950

SEQ ID NO: 978 - protein, 46 aa, Homo sapiens
MTHCSRTTGCSTASGRTWTRSRHSCAWCSAALWRAAVASRCPSSIL

SEQ ID NO: 979 - protein, 202 aa, Homo sapiens
MAAGSRTSLLLAFGLLCLSWLQEGSAFPTIPLSRLFDNAMLRARRLYQLAYDTYQEFNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 980 - protein, 603 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVKNMHFPLAVIRVIFYRTTELNFYVVTLKEELGNWAQWVVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 981 - protein, 564 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 982 - protein, 515 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 983 - protein, 329 aa, Homo sapiens
MLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 984 - protein, 659 aa, Homo sapiens [sequence omitted]

SEQ ID NO: 985 - protein, 359 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTVAGSAGAGISGKVQPGGH

SEQ ID NO: 986 - protein, 701 aa, Homo sapiens
MAGDSTATSRRLGAAPDRAAPHILPAGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 987 - protein, 808 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 988 - protein, 751 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 989 - protein, 276 aa, Homo sapiens
MALLDVCGAPRGQRPESALPVAGSGRRSDPGHYSFSMRSPELALPRGMQPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 990 - protein, 272 aa, Homo sapiens
MLIGTPTPRDTTPSSWLTSSLLVEAAPLDDTTLPTPVSSGCPGLEPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 991 - protein, 258 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 992 - protein, 258 aa, Homo sapiens; identical to SEQ ID NO: 991

SEQ ID NO: 993 - protein, 149 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRGWSAVAPSWLTAASTSWAQVILLPQPPM

SEQ ID NO: 994 - protein, 185 aa, Homo sapiens
MCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRVSGTYLPLAYSHLFHDEGFDRKEMSESSRGH

SEQ ID NO: 995 - protein, 164 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRREAQSDSARSKTLTGAGGFVLGLIICGVGIFMHRRSKKVQRGSA

SEQ ID NO: 996 - protein, 256 aa, Homo sapiens
MVPLSPALPHLHYPLPPAVQLLLGVRLINWRKNYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 997 - protein, 212 aa, Homo sapiens
MQNNEITTIEWDDMTLYQAFNGLKNKNSQLKTLLAIGGWNFGTAPFTAMVSTPENHQTFINSVIKFLRQYEFDGLDFDWEYPGSRVSPPQDKHLFTVLVQEMREAFEQEAKHINKPRLMVTAAVAAGISNIQSGYEIPQLSQYPDYIHVMTYDLHGSWEGYTGENSPLYKYPTDTGSNAYLNVDYVMNYWKDNRAPAEKLMLDSQPMDTPSF

SEQ ID NO: 998 - protein, 97 aa, Homo sapiens
MADKVLKEKRKLFIHSMGEGTINGLLDELLQTRVLNQEEMEKVKRENATVMDKTRALIDSVIPKGAQACQICITYICEEDSYLAETLGLSAGPIPGN

SEQ ID NO: 999 - protein, 96 aa, Homo sapiens
MPTCSSPEGRIKLCFLEDAQRIWKQKLQRCHVQNTIIKWSERYTSGSFEMQWLFLRTNFIERFWRNILLLPLHKGSLYPRIPGLGKELQTGTHKLS

SEQ ID NO: 1000 - protein, 306 aa, Homo sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 1001 - protein, 306 aa, Homo sapiens; identical to SEQ ID NO: 1000

SEQ ID NO: 1002 - protein, 356 aa, Homo sapiens
MTKSYSESGLMGEPQPQGPPSWTDECLSSQDEEHEADKKEDDLEAMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 1003 - protein, 210 aa, Homo sapiens
MFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 1004 - protein, 76 aa, Homo sapiens
MDGRESAFPKLKYLGQDNSLAAQSPPWRTQIRMLRPENQRLGPRPQPSQHDTDASLGEQGLSASSGVVCILLYLML

SEQ ID NO: 1005 - protein, 76 aa, Homo sapiens; identical to SEQ ID NO: 1004

SEQ ID NO: 1006 - protein, 423 aa, Homo sapiens [sequence omitted]

SEQ ID NO: 1007 - protein, 423 aa, Homo sapiens
MAQLQTRFYTDNKKYAVDDVPFSIPAASEIADLSNIINKLLKDKNEFHKHVEFDFLIKGQFLRMPLDKHMEVENISSEEVVEIEYVEKCTAPQPEQCMFHDDWISSIKGAEEWILTGSYDKTSRIWSLEGKSIMTIVGHTDVVKDVAWVKKDSLSCLLLSASMDQTILLWEWNVERNKVKALHCCRGHAGSVDSIAVDGSGTKFCSGSWDKMLKIWSTVPTDEEDEMEESTNRPRKKQKTEQLGLTRTPIVTLSGHMEAVSSVLWSDAEEICSASWDHTIRVWDVGSGSLKSTLTGNKVFNCISYSPLCKRLASGSTDRHIRLWDPRTKDGSLVSLSLTSHTGWVTSVKWSPTHEQQLISGSLDNIVKLWDTRSCKAPLYDLAAHEDKVLSVDWTDTGLLLSGGADNKLYSYRYSPTTSHVGA

SEQ ID NO: 1008 - protein, 73 aa, Homo sapiens
MQLRFAPFSEQATTLTQGSTQATGYDLNGAYDDTIPPMEKALGKMDIQIALPSGCYRRVAPWFGLAAKHFIDR

SEQ ID NO: 1009 - protein, 232 aa, Homo sapiens [sequence omitted]

SEQ ID NO: 1010 - protein, 472 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 1011 - protein, 472 aa, Homo sapiens; identical to SEQ ID NO: 1010

SEQ ID NO: 1012 - protein, 3623 aa, Homo sapiens [sequence omitted]

SEQ ID NO: 1013 - protein, 152 aa, Homo sapiens
MDSLRQAMREIKDFTITCGKTDVEDPQEHIHIQWVDDDKNFSKCVISPINEKSMETITNVKLFHGSECKANGKVIRWTELLKEDGMTKLGLSMTLDSDQVCYQAGSNGQPLPSQYMNDLDSALVPVIPGGACQLSEGPVVMELIFYILENIA

SEQ ID NO: 1014 - protein, 391 aa, Homo sapiens
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 1015 - protein, 391 aa, Homo sapiens; identical to SEQ ID NO: 1014

SEQ ID NO: 1016 - protein, 317 aa, Homo sapiens [sequence omitted]

SEQ ID NO: 1017 - protein, 833 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 1018 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPAPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 1019 - protein, 1170 aa, Homo sapiens; identical to SEQ ID NO: 1018

SEQ ID NO: 1020 - protein, 432 aa, Homo sapiens
  VARIANT (1)...(432): Xaa = Any Amino Acid
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRX

SEQ ID NO: 1021 - protein, 1170 aa, Homo sapiens; identical to SEQ ID NO: 1018

SEQ ID NO: 1022 - protein, 432 aa, Homo sapiens; identical to SEQ ID NO: 1020
  VARIANT (1)...(432): Xaa = Any Amino Acid

SEQ ID NO: 1023 - protein, 252 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILVSRLAHWRNFKH

SEQ ID NO: 1024 - protein, 2201 aa, Homo sapiens [sequence omitted]

SEQ ID NO: 1025 - protein, 363 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILMDVTCDDIAHGQLTVPRSAAVAATGDAKPNMMGRETLLSICASVPKVEFHERHILKHFSFCVCVSVSLFPAKGIVSFSWASFRIWVLWKAVFWQHGESMAVWEGQLGLGLNIAFEYFTSIDVG

SEQ ID NO: 1026 - protein, 2261 aa, Homo sapiens [sequence omitted]

SEQ ID NO: 1027 - protein, 2201 aa, Homo sapiens [sequence omitted]

SEQ ID NO: 1028 - protein, 415 aa, Homo sapiens [sequence omitted]

SEQ ID NO: 1029 - protein, 94 aa, Homo sapiens
MSPVDRPAPLAGWVHPPSTWLTCHGRLCPASTPILHSPRACGAVQTGVPGISSPPGVSPHAVLYTPHPSLGPLNFRAVPIPAPPIFLCLAVIDQ

SEQ ID NO: 1030 - protein, 94 aa, Homo sapiens; identical to SEQ ID NO: 1029

SEQ ID NO: 1031 - protein, 127 aa, Homo sapiens [sequence omitted]

SEQ ID NO: 1032 - protein, 2096 aa, Homo sapiens [sequence omitted]

SEQ ID NO: 1033 - protein, 216 aa, Homo sapiens
MRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 1034 - protein, 2351 aa, Homo sapiens [sequence omitted]

SEQ ID NO: 1035 - protein, 1169 aa, Homo sapiens
MNYCRNPDAVAAPYCYTRDPGVRWEYCNLTQCSDAEGTAVAPPTVTPVPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 1036 - protein, 4548 aa, Homo sapiens
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 1037 - protein, 39 aa, Homo sapiens
MLLFSMVCKTFETIEIFLNNNFQILLNTSIVLINVLIMR

SEQ ID NO: 1038 - protein, 1306 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1039 - protein, 1258 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1040 - protein, 960 aa, Homo sapiens
MIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1041 - protein, 1219 aa, Homo sapiens [sequence omitted]

SEQ ID NO: 1042 - protein, 1267 aa, Homo sapiens
MPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1043 - protein, 1304 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 1044 - protein, 535 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1045 - protein, 425 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1046 - protein, 742 aa, Homo sapiens [sequence omitted]

SEQ ID NO: 1047 - protein, 668 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGALMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1048 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1049 - protein, 742 aa, Homo sapiens [sequence omitted]

SEQ ID NO: 1050 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 1051 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1052 - protein, 395 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1053 - protein, 691 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1054 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTYNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQEAWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVENLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1055 - protein, 95 aa, Homo sapiens [sequence omitted]

SEQ ID NO: 1056 - protein, 994 aa, Homo sapiens [sequence omitted]

SEQ ID NO: 1057 - protein, 1027 aa, Homo sapiens [sequence omitted]

SEQ ID NO: 1058 - protein, 994 aa, Homo sapiens [sequence omitted]

SEQ ID NO: 1059 - protein, 994 aa, Homo sapiens [sequence omitted]

SEQ ID NO: 1060 - protein, 1156 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGLWVLGGSIAQGFRSVAAVEAQTFYFDKQLKKSKNVIGSLDAYNGQE

SEQ ID NO: 1061 - protein, 820 aa, Homo sapiens [sequence omitted]

SEQ ID NO: 1062 - protein, 1032 aa, Homo sapiens [sequence omitted]

SEQ ID NO: 1063 - protein, 1032 aa, Homo sapiens [sequence omitted]

SEQ ID NO: 1064 - protein, 1038 aa, Homo sapiens
MFPTESAWLGKRGANPGPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 1065 - protein, 1348 aa, Homo sapiens [sequence omitted]

SEQ ID NO: 1066 - protein, 642 aa, Homo sapiens [sequence omitted]

SEQ ID NO: 1067 - protein, 2355 aa, Homo sapiens [sequence omitted]

SEQ ID NO: 1068 - protein, 1315 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1069 - protein, 984 aa, Homo sapiens [sequence omitted]

SEQ ID NO: 1070 - protein, 1341 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1071 - protein, 2386 aa, Homo sapiens [sequence omitted]

SEQ ID NO: 1072 - protein, 657 aa, Homo sapiens [sequence omitted]

SEQ ID NO: 1073 - protein, 847 aa, Homo sapiens
MRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1074 - protein, 1286 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSGWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1075 - protein, 2296 aa, Homo sapiens [sequence omitted]

SEQ ID NO: 1076 - protein, 693 aa, Homo sapiens [sequence omitted]

SEQ ID NO: 1077 - protein, 1259 aa, Homo sapiens
MWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 1078 - protein, 2355 aa, Homo sapiens [sequence omitted]

SEQ ID NO: 1079 - protein, 824 aa, Homo sapiens [sequence omitted]

SEQ ID NO: 1080 - protein, 152 aa, Homo sapiens
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 1081 - protein, 144 aa, Homo sapiens
MSSSFLPEPLPAKSLQHGVPLSLDSSLSSLLEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 1082 - protein, 110 aa, Homo sapiens
MTEWPSPGKTSVVTGIKLWNIRVKARVCCELELRECLGIPPGISKGTMATASLAHVRHLLCQAFSVVEKGGRRMQLFQCCLAVPKSRDWAPHLTSNFRFTLGHSCLPLQS

SEQ ID NO: 1083 - protein, 50 aa, Homo sapiens
MFFIRASTPCIGPLFSRRLSCPSDQVWIPTWPLRQSSAPKRVSDHHVLWC

SEQ ID NO: 1084 - protein, 355 aa, Homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 1085 - protein, 362 aa, Homo sapiens
MASGAFTMDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 1086 - protein, 1223 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQGVHGLVEMQTSKQILCRPAGDAEHTVGAQEGELPCPWGVSEAFRDNIRAGPCRVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 1087 - protein, 1086 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 1088 - protein, 1170 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 1089 - protein, 256 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1090 - protein, 147 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGRQKSLNIYIQMACVYFMLLHALGCINVVQAFCLEGQVLQDTIYSSEVSSLGIKF

SEQ ID NO: 1091 - protein, 168 aa, Homo sapiens
MGPRARPALLLLMLLQTAVLQGRLLLPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1092 - protein, 260 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1093 - protein, 348 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1094 - protein, 256 aa, Homo sapiens; identical to SEQ ID NO: 1089

SEQ ID NO: 1095 - protein, 334 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1096 - protein, 246 aa, Homo sapiens
MGPRARPALLLLMLLQTAVLQGRLLQSHTLQVILGCEMQEDNSTEGYWKYGYDGQDHLEFCPDTLDWRAAEPRAWPTKLEWERHKIRARQNRAYLERDCPAQLQQLLELGRGVLDQQVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1097 - protein, 325 aa, Homo sapiens
MGPRARPALLLLMLLQTAVLQGRLLPLGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1098 - protein, 242 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1099 - protein, 348 aa, Homo sapiens; identical to SEQ ID NO: 1093

SEQ ID NO: 1100 - protein, 175 aa, Homo sapiens
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKEGSESSSLPGKGKQIPSPHPSSFLSSASFGEGDTSCDLFSDHSTVSGLELLPPEHHHEVAEG

SEQ ID NO: 1101 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLVVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 1102 - protein, 4347 aa, Homo sapiens [sequence omitted]

SEQ ID NO: 1103 - protein, 4346 aa, Homo sapiens [sequence omitted]

SEQ ID NO: 1104 - protein, 3588 aa, Homo sapiens
MKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 1105 - protein, 4393 aa, Homo sapiens
MGWRAPGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPAPFLINWRLNWGHIPSQPRVTVTSEGGRGTLIIRDVKESDQGAYTCEAMNARGMVFGIPDGVLELVPQRAGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLVGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCSCNGHASSCDPVYGHCLNCQHNTEGPQCKKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADRSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLVASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGRGPHYFYWSREDGRPVPSGTQQRHQGSELHFPSVQPSDAGVYICTCRNLHRSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASQPPVKIESSSPSVTEGQTLDLNCVVAGSAHAQVTWYRRGGSLPHHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPRVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSYHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHHVSPADSGEYVCRAAGGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHTVLQISSAKPSDAGTYVCLAQNALGTAQKQVEVIVDTGAMAPGAPQVQAEEAELTVEAGHTATLRCSATGSPARTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVQPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRTAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGIKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSIYIGGAPDVATLTGGRFSSGITGCVKNLVLHSARPGAPPPQPLDLQHRAQAGANTRPCPS

SEQ ID NO: 1106 - protein, 154 aa, Homo sapiens
MPGVGPEPLGFWKIPWWTLPDANSSTQILLSRCQGQGRQGGRPEVQQEGWPRRVAGPAPSGGRHSPTLAGSPPRVPRHFCTWGWWGESLKTTGFHWLLLKIQTPGPMPGGSTATGQVDLGVCAFHLLSHNIWWKNMSHHIRHEQKEKLDMCDPT

SEQ ID NO: 1107 - protein, 55 aa, Homo sapiens
MREIVHIQAGQCGNQIGAKFWEVISDEHGIDPSGNYVGDSDLQLERISVYYNEAS

SEQ ID NO: 1108 - protein, 450 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 1109 - protein, 797 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSCSQDRALVSWDVKSLGGSVCQELLPQQPQEKGLCDQKASSTALQRLLQKEFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 1110 - protein, 118 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAGHWRPRERVLWGEQKPLMHFKWNEV

SEQ ID NO: 1111 - protein, 148 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFAHPAGRCQLASSPQLPGILGWLFGLLALPVGRKVCWSRRADPFTQDPLRRQSLALL

SEQ ID NO: 1112 - protein, 825 aa, Homo sapiens [sequence omitted]

SEQ ID NO: 1113 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 1114 - protein, 171 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCARKSVGKVISWFAQNLSGFSTQSLTSGISSVTAQ

SEQ ID NO: 1115 - protein, 345 aa, Homo sapiens; identical to SEQ ID NO: 1113

SEQ ID NO: 1116 - protein, 482 aa, Homo sapiens
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 1117 - protein, 482 aa, Homo sapiens; identical to SEQ ID NO: 1116

SEQ ID NO: 1118 - protein, 482 aa, Homo sapiens; identical to SEQ ID NO: 1116

SEQ ID NO: 1119 - protein, 482 aa, Homo sapiens; identical to SEQ ID NO: 1116

SEQ ID NO: 1120 - protein, 482 aa, Homo sapiens; identical to SEQ ID NO: 1116

SEQ ID NO: 1121 - protein, 390 aa, Homo sapiens [sequence omitted]

SEQ ID NO: 1122 - protein, 373 aa, Homo sapiens
MGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 1123 - protein, 68 aa, Homo sapiens
MKLVEVIKTPMTSQKTFESLVDFSKALGKHPVSCKDTPGFIVNRLLVPYLMEAIRLYERGPPGFPVGL

SEQ ID NO: 1124 - protein, 314 aa, Homo sapiens
MAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLHITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 1125 - protein, 261 aa, Homo sapiens [sequence omitted]

SEQ ID NO: 1126 - protein, 224 aa, Homo sapiens [sequence omitted]

SEQ ID NO: 1127 - protein, 261 aa, Homo sapiens [sequence omitted]

SEQ ID NO: 1128 - protein, 271 aa, Homo sapiens [sequence omitted]

SEQ ID NO: 1129 - protein, 271 aa, Homo sapiens [sequence omitted]

SEQ ID NO: 1130 - protein, 261 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 1131 - protein, 211 aa, Homo sapiens [sequence omitted]

SEQ ID NO: 1132 - protein, 211 aa, Homo sapiens [sequence omitted]

SEQ ID NO: 1133 - protein, 180 aa, Homo sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 1134 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1135 - protein, 169 aa, Homo sapiens
MGYVDDTQFVRFDSDSACPRMEPRAPWVEQEGPEYWEEETRNTKAHAQTDRMNLQTLRGYYNQSEAKIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1136 - protein, 206 aa, Homo sapiens
MSWTHTETQGYGMKGKLTLWQQAPWSDFSSRRVHGDRVSLLPLPTCVGSFFLDTHQAAPVLTPIECRVPREANQCSRGPGSKVPTHPPGLRFSPVAEDGVMAPRTLLLLLSGALVLTQTWAGFHSLRYFHTTMSRPGRADPRFLSVGDVDDTQCVRLDSDATSPRMEPEGPEYWEEETGTAKAKAQFYRVNLRTLSGYYNQSEACE

SEQ ID NO: 1137 - protein, 243 aa, Homo sapiens
MAPRTLLLLLSGALVLTQTWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRAGPSSQPTFLIMGIVTVLVVLGAVVTAVMWKNKTPGRKGVS

SEQ ID NO: 1138 - protein, 338 aa, Homo sapiens; identical to SEQ ID NO: 1134

SEQ ID NO: 1139 - protein, 343 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1140 - protein, 158 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSS

SEQ ID NO: 1141 - protein, 105 aa, Homo sapiens
MGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSS

SEQ ID NO: 1142 - protein, 251 aa, Homo sapiens
MKTPRMVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1143 - protein, 198 aa, Homo sapiens
MGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1144 - protein, 383 aa, Homo sapiens
MGLGPVFLLLAGIFPFAPPGAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 1145 - protein, 332 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 1146 - protein, 351 aa, Homo sapiens
MVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 1147 - protein, 332 aa, Homo sapiens; identical to SEQ ID NO: 1145

SEQ ID NO: 1148 - protein, 314 aa, Homo sapiens [sequence omitted]

SEQ ID NO: 1149 - protein, 332 aa, Homo sapiens; identical to SEQ ID NO: 1145

SEQ ID NO: 1150 - protein, 170 aa, Homo sapiens
MNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 1151 - protein, 344 aa, Homo sapiens
MFVFLFLAYFTYNIFEVRWAQWLTPGFPALWEAEAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 1152 - protein, 383 aa, Homo sapiens; identical to SEQ ID NO: 1144

SEQ ID NO: 1153 - protein, 383 aa, Homo sapiens
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 1154 - protein, 273 aa, Homo sapiens
MGAQDEEEGIQDLDGLLVFDKIVEVTLLNLPWYNEETEGQRGEMTAPKSPRAKIRGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKVGVDWPGCTWMVCDFWI

SEQ ID NO: 1155 - protein, 2813 aa, Homo sapiens [sequence omitted]

SEQ ID NO: 1156 - protein, 2764 aa, Homo sapiens [sequence omitted]

SEQ ID NO: 1157 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKANKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGT

SEQ ID NO: 1158 - protein, 738 aa, Homo sapiens; identical to SEQ ID NO: 1157

SEQ ID NO: 1159 - protein, 385 aa, Homo sapiens
MKLVRKNIEKDNAGQVTLVPEEPEDMWHTYNLVQVGDSLRASTIRKVQTESSTGSVGSNRVRTTLTLCVEAIDFDSQACQLRVKGTNIQENEYVKMGAYHTIELEPNRQFTLAKKQWDSVVLERIEQACDPAWSADVAAVVMQEGLAHICLVTPSMTLTRAKVEVNIPRKRKGNCSQHDRALERFYEQVVQAIQRHIHFDVVKCILVASPGFVREQFCDYMFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 1160 - protein, 385 aa, Homo sapiens; identical to SEQ ID NO: 1159

SEQ ID NO: 1161 - protein, 1177 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 1162 - protein, 126 aa, Homo sapiens
MNLAPLECQATAGSRCSWPSGGSTCSAGASRHCFTGCGVPSRPGAWQWHGSTGWMPKGQSSWCGPCQPSRSLCHSRAPWSFPCLPAPGPLRFQGRGERGSIRPPQPGKRGRPRAPPSTRVQTAFNP

SEQ ID NO: 1163 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1164 - protein, 515 aa, Homo sapiens [sequence omitted]

SEQ ID NO: 1165 - protein, 331 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 1166 - protein, 1251 aa, Homo sapiens
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 1167 - protein, 1096 aa, Homo sapiens [sequence omitted]

SEQ ID NO: 1168 - protein, 1307 aa, Homo sapiens [sequence omitted]

SEQ ID NO: 1169 - protein, 1206 aa, Homo sapiens
MYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 1170 - protein, 2483 aa, Homo sapiens
MVLLLCLSCLIFSCLTFSWLKIWEKMTDSKPITKSKSEANLIPSQEPFPASDNSGETPQRNGEGHTLHKDTQPGRAQPPTKAQRSGRRRNSLPPSRQKPPRNPLSSSDAAPSPELQANGTGTQGLEATDTNGLSSSARPQGSKLVPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVRMVTPEDLKANAEYIKMADHYGPAPGGPNNNNYANVELIVDIAKRIPLQAVWAGWGHALENPKLPELLCKNGVAFLGPPRLRPMVGLGDKIASTVVAQTLQVPTLPRSGSALTVEWTEDDLQQGKRISVPEDVYDKGCVKDVDEGLEAAERIGFPLMIKASEGGGGKGIRETESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGAPLHRLKDIRLLYGESPWGDSPISFENSAHLPCPRGHVIATRITSENPDEGFKPSSGTVQELNFRSSKNVWGYFTVAATGGLHEFAISQFGHCFSWGENRKEAISNMVVALKELSLRGDFRTTVEYLINLLETESFQNNYIDTGWLDYLIAEKVQKKPNIMLGVVCGALERGDAMFRTCMTDFLHSLERGQVLPADSLLNLVDVELIYEGVKYILKVTRQSLTMFVLIMNGCHIEIDAHRLNDGGLLLSYNGNSYTTYMKEEVDSYRTIGNKTCVFEKENDPTVLRSPSAGKLTQITVEDGGHVEAGRRYAEMEVMKMIMTLNVQERGRVKYIKRPGAVLEAGCVVARLELDDPSKVHPAEPFTGELPAQQNTADLGKKLHRVFHSVLGSLTNVMSGFCLPEPFFSIKLKEWVQKLMMTLRHPSLLLDVQEIMTSRAGRIPPPVEKSVRKVMAQYASNITSVLCQFPSQQIATILDCHAATLQRKADREVFFINTQSMVQLVQRYRSGIRGHMKTVVIDLLRRYLRVETIFGKARDADANSSGMVGGVRSLSFTSVWVVLSPPAHYDKCVINLREQFKPDMSQVLDCIFSHAQVTKKNQLVIMLIDELCGPDPSLSDELISILNELTQLSKSEHCKVALRARQILIASPSYELRHNQVESIFLSAIDMYGHQFCPENLQKLILSETTIFDVLNTFFYHANKVVCMASLEVYVGGAYIAYVLNSLQHRQLPDGTCVVEFQFMLPSSHPNRMTVPISITNPDLLRHTTELFMDSGFSPLCQRMGAMVAFRRFEDFTRNFDEVISCFANVPKDPPLFSEARTSLYSEDDCKSLREEPIHILNVSIQCADHLEDEALVPILRTFVQSKKNILVDYGLRRIPFLIAQEKEFPKFFTFRARDEFAEDRIYRHLEPALAFQLELNRMRNFDLTAVPCANHKMHLYLGAAKVEGRYEVTDHRFFIRAIIRHSDLITKEASFEYLQNEGERLLLEAMDELEVAFNNTNVRTDCNHIFLNFVPTVIMDPNKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEAIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAIKDFNREKLPLMIFANWRGFSGGMKDMYDQVLKFGAYIVDGLRQYKQPILIYIRPMRELRGGSWVVIDATINPLCIEMYADKESRGGVLEPEGTVEIKFRKEDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 1171 - protein, 159 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGKAFIICKKVV

SEQ ID NO: 1172 - protein, 3396 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 1173 - protein, 3396 aa, Homo sapiens; identical to SEQ ID NO: 1172

SEQ ID NO: 1174 - protein, 655 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 1175 - protein, 2409 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 1176 - protein, 1642 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 1177 - protein, 2409 aa, Homo sapiens; identical to SEQ ID NO: 1175

SEQ ID NO: 1178 - protein, 1642 aa, Homo sapiens; identical to SEQ ID NO: 1176

SEQ ID NO: 1179 - protein, 427 aa, Homo sapiens [sequence omitted]

SEQ ID NO: 1180 - protein, 644 aa, Homo sapiens [sequence omitted]

SEQ ID NO: 1181 - protein, 427 aa, Homo sapiens [sequence omitted]

SEQ ID NO: 1182 - protein, 253 aa, Homo sapiens
MGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1183 - protein, 1104 aa, Homo sapiens
MLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1184 - protein, 1166 aa, Homo sapiens [sequence omitted]

SEQ ID NO: 1185 - protein, 1914 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1186 - protein, 154 aa, Homo sapiens
MAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1187 - protein, 1483 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSCLSASLTRTLS

SEQ ID NO: 1188 - protein, 123 aa, Homo sapiens
MGDVKLVASSHISKTSLSVDPSRVDSMPLTEAPAFILPPRNLCIKEGATAKFEGRNNALAAHWCIQKKDYSRETSKASSCLAETNAEGETVEENALEASMLQVCIVSVGNNTETFASGKGHIT

SEQ ID NO: 1189 - protein, 784 aa, Homo sapiens [sequence omitted]

SEQ ID NO: 1190 - protein, 1079 aa, Homo sapiens
MEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSCLSASLTRTLS

SEQ ID NO: 1191 - protein, 1279 aa, Homo sapiens
MDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1192 - protein, 1654 aa, Homo sapiens
  VARIANT (1)...(1654): Xaa = Any Amino Acid
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYIX

SEQ ID NO: 1193 - protein, 1845 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEGLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1194 - protein, 1846 aa, Homo sapiens [sequence omitted]

SEQ ID NO: 1195 - protein, 153 aa, Homo sapiens
MAMISGLSGRKSSTGSPTSPLNAEKLESEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 1196 - protein, 1845 aa, Homo sapiens; identical to SEQ ID NO: 1193

SEQ ID NO: 1197 - protein, 50 aa, Homo sapiens
  VARIANT (1)...(50): Xaa = Any Amino Acid
MIIIMAVAMCMKRQVLRRTRRRRRRGGGGSPQVAAVVAAAAAAAVSGLLX

SEQ ID NO: 1198 - protein, 402 aa, Homo sapiens
MGKLVALVLLGVGLSLVGEMFLAFRERVNASREVEPVEPENCHLIEELESGSEDIDILPSGLAFISSLQVCWSLLEVHSRPCLPGYHQWRLQNGKYCCLIFLLEASSQRGIRLYEGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 1199 - protein, 355 aa, Homo sapiens [sequence omitted]

SEQ ID NO: 1200 - protein, 268 aa, Homo sapiens
MDLNEEDPTVLELGITGSKFDVSSFNPHGISTFTDEDNAMYLLVVNHPDAKSTVELFKFQEEEKSLLHLKTIRHKLLPNLNDIVAVGPEHFYGTNDHYFLDPYLQSWEMYLGLAWSYVVYYSPSEVRVVAEGFDFANGINISPDGKYVYIAELLAHKIHVYEKHANWTLTPLKSLDFNTLVDNISVDPETGDLWVGCHPNGMKIFFYDSENPPASEVLRIQNILTEEPKVTQVYAENGTVLQGSTVASVYKGKLLIGTVFHKALYCEL

SEQ ID NO: 1201 - protein, 354 aa, Homo sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 1202 - protein, 355 aa, Homo sapiens [sequence omitted]

SEQ ID NO: 1203 - protein, 346 aa, Homo sapiens
MPRGCDPNNPGGVSGRGLAQPEEAPAAQGQGCAEAASAPPAPPADPEITRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLGGLRWENGLSLGGRGCSELRSHHCTLARVTKPDLVSKNTGMNMSITLI

SEQ ID NO: 1204 - protein, 321 aa, Homo sapiens [sequence omitted]

SEQ ID NO: 1205 - protein, 620 aa, Homo sapiens [sequence omitted]

SEQ ID NO: 1206 - protein, 260 aa, Homo sapiens
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 1207 - protein, 331 aa, Homo sapiens
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 1208 - protein, 331 aa, Homo sapiens; identical to SEQ ID NO: 1207

SEQ ID NO: 1209 - protein, 260 aa, Homo sapiens; identical to SEQ ID NO: 1206

SEQ ID NO: 1210 - protein, 331 aa, Homo sapiens; identical to SEQ ID NO: 1207

SEQ ID NO: 1211 - protein, 406 aa, Homo sapiens
MQLFLLLCLVLLSPQGASLHRHHPREMKKRVEDLHVGATVAPSSRRDFTFDLYRALASAAPSQSIFFSPVSISMSLAMLSLGAGSSTKMQILEGLGLNLQKSSEKELHRGFQQLLQELNQPRDGFQLSLGNALFTDLVVDLQDTFVSAMKTLYLADTFPTNFRDSAGAMKQINDYVAKQTKGKIVDLLKNLDSNAVVIMVNYIFFKAKWETSFNHKGTQEQDFYVTSETVVRVPMMSREDQYHYLLDRNLSCRVVGVPYQGNATALFILPSEGKMQQVENGLSEKTLRKWLKMFKKRQLELYLPKFSIEGSYQLEKVLPSLGISNVFTSHADLSGISNHSNIQVSEMVHKAVVEVDESGTRAAAATGTIFTFRSARLNSQRLVFNRPFLMFIVDNNILFLGKVNRP

SEQ ID NO: 1212 - protein, 406 aa, Homo sapiens; identical to SEQ ID NO: 1211

SEQ ID NO: 1213 - protein, 406 aa, Homo sapiens; identical to SEQ ID NO: 1211

SEQ ID NO: 1214 - protein, 406 aa, Homo sapiens; identical to SEQ ID NO: 1211

SEQ ID NO: 1215 - protein, 406 aa, Homo sapiens; identical to SEQ ID NO: 1211

SEQ ID NO: 1216 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQATTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 1217 - protein, 418 aa, Homo sapiens; identical to SEQ ID NO: 1216

SEQ ID NO: 1218 - protein, 418 aa, Homo sapiens; identical to SEQ ID NO: 1216

SEQ ID NO: 1219 - protein, 418 aa, Homo sapiens; identical to SEQ ID NO: 1216

SEQ ID NO: 1220 - protein, 418 aa, Homo sapiens; identical to SEQ ID NO: 1216

SEQ ID NO: 1221 - protein, 418 aa, Homo sapiens; identical to SEQ ID NO: 1216

SEQ ID NO: 1222 - protein, 418 aa, Homo sapiens; identical to SEQ ID NO: 1216

SEQ ID NO: 1223 - protein, 2491 aa, Homo sapiens
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 1224 - protein, 734 aa, Homo sapiens [sequence omitted]

SEQ ID NO: 1225 - protein, 873 aa, Homo sapiens
MDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 1226 - protein, 184 aa, Homo sapiens [sequence omitted]

SEQ ID NO: 1227 - protein, 184 aa, Homo sapiens [sequence omitted]

SEQ ID NO: 1228 - protein, 184 aa, Homo sapiens [sequence omitted]

SEQ ID NO: 1229 - protein, 745 aa, Homo sapiens
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 1230 - protein, 884 aa, Homo sapiens
MLGRRAPICPSRLCSRQKQWGKNRPELSDAGIRDQSWRGLGCALRFRTNKAFKLPNLWFDSTRAASLSHPGAHPLSSVAATEGGGACGAQTQLELLRGGLGLSQRGKGGGKEVGFLPANRRARPRCRSMPLRPGSLVPEGAGFPKMAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRRPAEGPPTNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 1231 - protein, 194 aa, Homo sapiens
MEAEPIPDSSMPAKLLAPPCLNLERLGGSPSQEKPRTPGCCRISERCRRPRKQLNPCRGTERVDPGFEGVTLKFQIKPDSSLQIIPTYSLPCSSRSQESPADAVGGPAAHPGGTEAHSAGSEALEPRRCASCRTQRTPLWRDAEDGTPLCNACGIRYKKYGTRCSSCWLVPRKNVQPKRLCGRCGVSLDPIQEG

SEQ ID NO: 1232 - protein, 524 aa, Homo sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNAGSSHFVPVFVAVLLTLGVVTIVLALMYVFREHQRSGSYHVREESTYLPLTSMQPTEAMGEEPSRAE

SEQ ID NO: 1233 - protein, 547 aa, Homo sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 1234 - protein, 186 aa, Homo sapiens
MHVMAASMARGGVSARVLLQAARGTWWNRPGGTSGSGEGVALGTTRKFQATGSRPAGEEDAGGPERPGDVVNVVFVDRSGQRIPVSGRVGDNVLHLAQRHGVDLEGACEASLACSTCHVYVSEDHLDLLPPPEEREDDMLDMAPLLQENSRLGCQIVLTPELEGAEFTLPKITRNFYVDGHVPKPH

SEQ ID NO: 1235 - protein, 547 aa, Homo sapiens; identical to SEQ ID NO: 1233

SEQ ID NO: 1236 - protein, 547 aa, Homo sapiens; identical to SEQ ID NO: 1233

SEQ ID NO: 1237 - protein, 92 aa, Homo sapiens
QGGGRIKSIILRQTSALRELLPPKKAGTWADCVSPPCGERDRCEGWADRHTACSSPASPPQHRAKSFKKDLGHCLFLREERPACAPRLTGPV

SEQ ID NO: 1238 - protein, 84 aa, Homo sapiens
AECVAAAIRHFSFLPLYEEGCVCFPLCHDCKFPEASSALQNWLEQCILGSLKEAVEMSPRRETRRAPQAHQLFVGSLQTCHSSG

SEQ ID NO: 1239 - protein, 114 aa, Homo sapiens [sequence omitted]

SEQ ID NO: 1240 - protein, 868 aa, Homo sapiens [sequence omitted]

SEQ ID NO: 1241 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYTCDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 1242 - protein, 2489 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIVRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDRQGNGVWSSPAPRCELSVPAACPDPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRAHDALIVGTLSGTIFFILLIIFLSWIILKHRKGNNAHENPKEVAIHLHSQGGSSVHPRTLQTNEENSRVLP

SEQ ID NO: 1243 - protein, 455 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 1244 - protein, 455 aa, Homo sapiens; identical to SEQ ID NO: 1243

SEQ ID NO: 1245 - protein, 455 aa, Homo sapiens; identical to SEQ ID NO: 1243

SEQ ID NO: 1246 - protein, 455 aa, Homo sapiens; identical to SEQ ID NO: 1243

SEQ ID NO: 1247 - protein, 448 aa, Homo sapiens
MKIHYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 1248 - protein, 423 aa, Homo sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 1249 - protein, 205 aa, Homo sapiens
MPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 1250 - protein, 423 aa, Homo sapiens; identical to SEQ ID NO: 1248

SEQ ID NO: 1251 - protein, 423 aa, Homo sapiens; identical to SEQ ID NO: 1248

SEQ ID NO: 1252 - protein, 433 aa, Homo sapiens
MERMLPLLALGLLAAGFCPAVLCHPNSPLDEENLTQENQDRGTHVDLGLASANVDFAFSLYKQLVLKALDKNVIFSPLSISTALAFLSLGAHNTTLTEILKASSSPHGDLLRQKFTQSFQHLRAPSISSSDELQLSMGNAMFVKEQLSLLDRFTEDAKRLYGSEAFATDFQDSAAAKKLINDYVKNGTRGKITDLIKDPDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKVVSDVFEEGTEASAATAVKITLLSALVETRTIVRFNRPFLMIIVPTDTQNIFFMSKVTNPSKPRACIKQWGSQ

SEQ ID NO: 1253 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 1254 - protein, 317 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 1255 - protein, 106 aa, Homo sapiens
MRLVQGEAVCCVPGPATSWRACAGTWSCPTWAAACVCDCTVATLAHTPLAHPSAPPVSISLGSGIQVGSKCEWAEAAQWAQSKTQAKVPLDWPGKRHPKDPIMLIC

SEQ ID NO: 1256 - protein, 425 aa, Homo sapiens
MAQADIVLIGLAVMGQNLILTMKDHGFVVCAFNRTVSEVDDFLANEAKGTKVVGAQSLKEMVSKLKKPQRIILLVKAGQAVDYFIKKLIPLLDIGDIIIDGGNSEYRDTTRRCQDLKAKGILFVGSGVSGGEEGAWIEYGDMQLICEAYHLMKDVLGMAQDKMAQAFEDWNKTELDSFLIEITANILKFQGADGKHLLPKIRDSAGQKGMGKWTTISALEYGIPVTLIGEAVFAWCLSSLKDGRIQASKKLKGPQKFQFDGFMLLRQGATEFGWTLNYGDIALMWRGGCIIRSVFLGKIKDAFDRNPEPQNLLLDDFLSQLLKTARTLGGGQSALGSRLAFPCPVLSLPSPSMTSTDTRCFQPTSSRLSGIPLGLTPMNSWPNQGSLSTPTGQATVAVYHPRHTMPDDDDAAPVTLHDSTDQDIP

SEQ ID NO: 1257 - protein, 135 aa, Homo sapiens
ATMPGLLLAGRWEVQKSSVPCYIKAHPPGTVICSSVGRRGLATWPEAVTKAQAICGALGFVISAANKGGKFLLPELRLRILTCMSLPTFLGISFLEPETKSSQMLCLAPVSLTCRPVSGRGHATVAHLPLALRRG

SEQ ID NO: 1258 - protein, 84 aa, Homo sapiens
LLFIPIARNIIAAFDKAIIIFLSYLPNMHFFNQSSCLQSCLLQSILDAAKVVFVKCSLACCFSFVIVSPNGQTQTPSCSTEVLR

SEQ ID NO: 1259 - protein, 57 aa, Homo sapiens
MHFFNQSSCLQSCLLQSILDAAKVVFVKCSLACCFSFVIVSPNGQTQTPSCSTEVLR

SEQ ID NO: 1260 - protein, 117 aa, Homo sapiens [sequence omitted]

SEQ ID NO: 1261 - protein, 531 aa, Homo sapiens
MYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVVSGPLLGPWLLPRPLPRPYTWPLYCAHPDLRGEAAGLLFLGHACLRGSVNLRRDQWLPVHLLQVTALGRRGHGEGRLGCRCAPVMPWARGRDTCRGRGLPEAGMMIPHGNKCLITTGRQRKQEAGRLDEGENCPVGLLGPEQEVRGDSLRGTSGPKLRPRMWPVPISVPNARLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 1262 - protein, 370 aa, Homo sapiens
MSPQELLSSNAVAVVSGPLLGPWLLPRPLPRPYTWPLYCAHPDLRGEAAGLLFLGHACLRGSVNLRRDQWLPVHLLQVTALGRRGHGEGRLGCRCAPVMPWARGRDTCRGRGLPEAGMMIPHGNKCLITTGRQRKQEAGRLDEGENCPVGLLGPEQEVRGDSLRGTSGPKLRPRMWPVPISVPNARLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 1263 - protein, 523 aa, Homo sapiens
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 1264 - protein, 770 aa, Homo sapiens
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 1265 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 1266 - protein, 431 aa, Homo sapiens; identical to SEQ ID NO: 1265

SEQ ID NO: 1267 - protein, 682 aa, Homo sapiens
  VARIANT (1)...(682): Xaa = Any Amino Acid
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNELCNTEXTSEQIDNGCTGATCTGAAGATACAGGAGAGGGACGAACTCGCCTGGAAGAAACTAAAGCTTGACGGCTTGGACGAAGATGGGGAGAAGGAAGCGAGACTCATACGCARCCTCARTGTCATCTTGGCCAAGTATGGTCTGGACGGAAAGAAGGACGCTCGGCAGGTGACCAGCAACTCCCTCAGTGGCACCCAGGAAGACGGGCTGGATCELERASNPIDHCVSNPPSITINTRANSCRIPTSNPSRCEDBSNPPPLATINALLELECNTNPPGASNPTYPEMISSENSEMTATINPRTEINCDINGSEQIDNNAACSAGC

SEQ ID NO: 1268 - protein, 682 aa, Homo sapiens; identical to SEQ ID NO: 1267
  VARIANT (1)...(682): Xaa = Any Amino Acid

SEQ ID NO: 1269 - protein, 631 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 1270 - protein, 313 aa, Homo sapiens
MKCGLLPISPEALSLGEVAYHDYHGILVDEEEKVLIQKNLGPKSKVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQVRAQSVSDFSGWWLCDRLLQSYSEIERVTL

SEQ ID NO: 1271 - protein, 768 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 1272 - protein, 631 aa, Homo sapiens; identical to SEQ ID NO: 1269

SEQ ID NO: 1273 - protein, 768 aa, Homo sapiens; identical to SEQ ID NO: 1271

SEQ ID NO: 1274 - protein, 737 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 1275 - protein, 737 aa, Homo sapiens; identical to SEQ ID NO: 1274

SEQ ID NO: 1276 - protein, 662 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 1277 - protein, 737 aa, Homo sapiens; identical to SEQ ID NO: 1274

SEQ ID NO: 1278 - protein, 631 aa, Homo sapiens; identical to SEQ ID NO: 1269

SEQ ID NO: 1279 - protein, 768 aa, Homo sapiens; identical to SEQ ID NO: 1271

SEQ ID NO: 1280 - protein, 1257 aa, Homo sapiens
MASCSFTRDQATRRLRGAAAAAAAALAAVVTTPLLSSGTPTALIGTGSSCPGAMWLSTATGSRSDSESEEEDLPVGEEVCKRGYLRKQKHGHRRYFVLKLETADAPARLEYYENARKFRHSVRAAAAAAAAAASGAAIPPLIPPRRVITLYQCFSVSQRADARYRHLIALFTQDEYFAMVAENESEQESWYLLLSRLILESKRRRCGTLGAQPDGEPAALAAAAAAEPPFYKDVWQVIVKPRGLGHRKELSGVFRLCLTDEEVVFVRLNTEVASVVVQLLSIRRCGHSEQYFFLEVGRSTVIGPGELWMQVDDCVVAQNMHELFLEKMRALCADEYRARCRSYSISIGAHLLTLLSARRHLGLVPLEPGGWLRRSRFEQFCHLRAIGDGEDEMLFTRRFVTPSEPVAHSRRGRLHLPRGRRSRRAVSVPASFFRRLAPSPARPRHPAEAPNNGARLSSEVSGSGSGNFGEEGNPQGKEDQEGSGGDYMPMNNWGSGNGRGSGGGQGSNGQGSSSHSSGGNQCSGEGQGSRGGQGSNGQGSGGNQCSRDGQGTAGGHGSGGGQRPGGGHGSGGGQGPGDGHGSGGGKNSGGGKGSGSGKGSDGDGERGKSLKKRSYFGKLTQSKQQQMPPPPPPPPPPPPAGGTGGKGKSGGRFRLYFCVDRGATKECKEAKEVKDAEIPEGAARGPHRARAFDEDEDDPYVPMRPGVATPLVSSSDYMPMAPQNVSASKKRHSRSPFEDSRGYMMMFPRVSPPPAPSPPKAPDTNKEDDSKDNDSESDYMFMAPGAGAIPKNPRNPQGGSSSKSWSSYFSLPNPFRSSPLGQNDNSEYVPMLPGKFLGRGLDKEVSYNWDPKDAASKPSGEGSFSKPGDGGSPSKPSDHEPPKNKAKRPNRLSFITKGYKIKPKPQKPTHEQREADSSSDYVNMDFTKRESNTPAPSTQGLPDSWGIIAEPRQSAFSNYVNVEFGVPFPNPANDLSDLLRAIPRANPLSLDSARWPLPPLPLSATGSNAIEEEGDYIEVIFNSAMTPAMALADSAIRYDAETGRIYVVDPFSECCMDISLSPSRCSEPPPVARLLQEEEQERRRPQSRSQSFFAAARAAVSAFPTDSLERDLSPSSAPAVASAAEPTLALSQVVAAASALAAAPGIGAAAAAAGFDSASARWFQPVANAADAEAVRGAQDVAGGSNPGAHNPSANLARGDNQAGGAAAAAAAPEPPPRSRRVPRPPEREDSDNDDDTHVRMDFARRDNQFDSPKRGR

SEQ ID NO: 1281 - protein, 407 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHGDGRCITCIYYLNQNWDVKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 1282 - protein, 407 aa, Homo sapiens; identical to SEQ ID NO: 1281

SEQ ID NO: 1283 - protein, 407 aa, Homo sapiens; identical to SEQ ID NO: 1281

SEQ ID NO: 1284 - protein, 158 aa, Homo sapiens
MCLPSPSKPTSLHPCQAMVACYPGNGLGYVRHVDNPHGDGRCITCIYYLNQNWDVKVGVRVRVRVALGLGLGRGWRASTPFSTLSPDSGILLFLFSTHSGQCDLPALPGKWHLLLSSGLCGGNSPLSGNGAVCPAPPGLVMNTFPLFLSLVASCPSPW

SEQ ID NO: 1285 - protein, 407 aa, Homo sapiens; identical to SEQ ID NO: 1281

SEQ ID NO: 1286 - protein, 3000 aa, Homo sapiens
MTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTLIGKKRQLLAC

SEQ ID NO: 1287 - protein, 4563 aa, Homo sapiens [sequence omitted]

SEQ ID NO: 1288 - protein, 4563 aa, Homo sapiens [sequence omitted]

SEQ ID NO: 1289 - protein, 732 aa, Homo sapiens [sequence omitted]

SEQ ID NO: 1290 - protein, 619 aa, Homo sapiens [sequence omitted]

SEQ ID NO: 1291 - protein, 427 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGET

SEQ ID NO: 1292 - protein, 452 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVGSWAPRSDYLHGRKRTLTTLCPLVLCGGVMAPGPAVDQEARDGQGCAHVPQGLGRNGPGRGCLLPGEYCGPAHFQQPPTLPHLRPVQGLPAGLGGGHGFPGPWGDLSPRSSWCASNPPVPHHLNQ

SEQ ID NO: 1293 - protein, 427 aa, Homo sapiens; identical to SEQ ID NO: 1291

SEQ ID NO: 1294 - protein, 160 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSSAWSTCTASRPGSRPTGAG

SEQ ID NO: 1295 - protein, 176 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGVEHVHSFTPWIQAHGGWEGILAVSPVDLNLPLD

SEQ ID NO: 1296 - protein, 176 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRPSYSRLLCFGGPAAGTAGPRAAEISAQPRITGSPIDREGSHTAEAGGPAGGGGRSH

SEQ ID NO: 1297 - protein, 334 aa, Homo sapiens
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 1298 - protein, 447 aa, Homo sapiens [sequence omitted]

SEQ ID NO: 1299 - protein, 516 aa, Homo sapiens [sequence omitted]

SEQ ID NO: 1300 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 1301 - protein, 804 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNMESSSVFLQHSGWSAMVRSWLTAASTSWVQAILLPQPPEELGLQVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 1302 - protein, 760 aa, Homo sapiens; identical to SEQ ID NO: 1300

SEQ ID NO: 1303 - protein, 317 aa, Homo sapiens [sequence omitted]

SEQ ID NO: 1304 - protein, 1089 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 1305 - protein, 218 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKGTCIISFLL

SEQ ID NO: 1306 - protein, 475 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 1307 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 1308 - protein, 390 aa, Homo sapiens; identical to SEQ ID NO: 1307

SEQ ID NO: 1309 - protein, 391 aa, Homo sapiens
MPPSGLRLLPLLLPLLWLLVLTPGPPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 1310 - protein, 652 aa, Homo sapiens [sequence omitted]

SEQ ID NO: 1311 - protein, 652 aa, Homo sapiens [sequence omitted]

SEQ ID NO: 1312 - protein, 389 aa, Homo sapiens [sequence omitted]

SEQ ID NO: 1313 - protein, 114 aa, Homo sapiens [sequence omitted]

SEQ ID NO: 1314 - protein, 388 aa, Homo sapiens
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLFVTSLDATVNHVSLILSYANSCANPILYGFLSDNFRRFFQRVLCLRCCLLEGAGGAEEEPLDYYATALKSKGGAGCMCPPLPCQQEALQPEPGRKRIPLTRTTTF

SEQ ID NO: 1315 - protein, 388 aa, Homo sapiens
MSAPSTLPPGGEEGLGTAWPSAANASSAPAEAEEAVAGPGDARAAGMVAIQCIYALVCLVGLVGNALVIFVILRYAKMKTATTIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLVVTSLDATVNHVSLILSYANSCANPILYGFLSDNFRRSFQRVLCLRCCLLEGAGGAEEEPLDYYATALKSKGGAGCMCPPLKCQQEALQPEPGRKRIPLTRTTTF

SEQ ID NO: 1316 - protein, 216 aa, Homo sapiens
MLPCPIPFSPSRLLIPPFPSFPSNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 1317 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 1318 - protein, 2210 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1319 - protein, 3177 aa, Homo sapiens [sequence omitted]

SEQ ID NO: 1320 - protein, 2977 aa, Homo sapiens [sequence omitted]

SEQ ID NO: 1321 - protein, 2244 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1322 - protein, 2205 aa, Homo sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1323 - protein, 2411 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1324 - protein, 2211 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPSTFHRAPGVPRLPNRTSLCFRHL

SEQ ID NO: 1325 - protein, 2971 aa, Homo sapiens [sequence omitted]

SEQ ID NO: 1326 - protein, 1288 aa, Homo sapiens [sequence omitted]

SEQ ID NO: 1327 - protein, 1663 aa, Homo sapiens
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 1328 - protein, 493 aa, Homo sapiens [sequence omitted]

SEQ ID NO: 1329 - protein, 525 aa, Homo sapiens [sequence omitted]

SEQ ID NO: 1330 - protein, 727 aa, Homo sapiens
MESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEDPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 1331 - protein, 114 aa, Homo sapiens [sequence omitted]

SEQ ID NO: 1332 - protein, 782 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRDAESSEMQRPPPDCDDTVTYSALHKRQVGDYENVIPDFPEDEGIHYSELIQFGVGERPQAQENVDYVILKH

SEQ ID NO: 1333 - protein, 488 aa, Homo sapiens
MRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEDPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 1334 - protein, 847 aa, Homo sapiens [sequence omitted]

SEQ ID NO: 1335 - protein, 847 aa, Homo sapiens [sequence omitted]

SEQ ID NO: 1336 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACARCNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPHHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPRTCDDTVTYSALHKRQVGDYENVIPDFPEDEGIHYSELIQFGVGERPQAQENVDYVILKH

SEQ ID NO: 1337 - protein, 493 aa, Homo sapiens [sequence omitted]

SEQ ID NO: 1338 - protein, 433 aa, Homo sapiens
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 1339 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 1340 - protein, 387 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIR

SEQ ID NO: 1341 - protein, 488 aa, Homo sapiens; identical to SEQ ID NO: 1339

SEQ ID NO: 1342 - protein, 421 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLATLLQAHASTGQQQVDGQDRGVPGLGLLPRVPGERPSANVPPLGVHGHDGSDPTGLVRGPLFPGQLWQRSCVAVAHHRTANSRPHVRPRLLRAQL

SEQ ID NO: 1343 - protein, 464 aa, Homo sapiens
MASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 1344 - protein, 631 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1345 - protein, 587 aa, Homo sapiens
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1346 - protein, 324 aa, Homo sapiens
MKAHLSIASLPPSLRATTPPAGSMKRWPRLGSPGCLPKPCAPSGTYRPWKPRKGKERIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 1347 - protein, 116 aa, Homo sapiens
MEHQPDSWHVLCSPGIPDQRVRLQCHREDPEDAERILPAQGLSWAVFQLACPRHQNRGGPVCKGPALTFKETFSRGTVQLKLRKHHYLQRQDLTIEVADSFFFLMSKMSWVGGKEG

SEQ ID NO: 1348 - protein, 146 aa, Homo sapiens [sequence omitted]

SEQ ID NO: 1349 - protein, 146 aa, Homo sapiens
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 1350 - protein, 669 aa, Homo sapiens
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 1351 - protein, 148 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 1352 - protein, 148 aa, Homo sapiens; identical to SEQ ID NO: 1351

SEQ ID NO: 1353 - protein, 148 aa, Homo sapiens; identical to SEQ ID NO: 1351

SEQ ID NO: 1354 - protein, 1365 aa, Homo sapiens [sequence omitted]

SEQ ID NO: 1355 - protein, 1366 aa, Homo sapiens [sequence omitted]

SEQ ID NO: 1356 - protein, 1411 aa, Homo sapiens
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATIAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLGAVKLTSLACGNQHIWACDSRGGVYFRVGTQPLNPSLMLPAWIMIEPPVQPAGVSLVSVHSSPNDQMLWVLDSRWNVHVRTGITEEMPVGTAWEHVPGLQACQLALSTRTVWARCPNGDLARRYGVTDKNPAGDYWKKIPGSVSCFTVTASDELWAVGPPGYLLQRLTKTFSHSHGTQKSSQAAMPHPEDLEDEWEVI

SEQ ID NO: 1357 - protein, 1234 aa, Homo sapiens
MASISEPVTFREFCPLYYLLNAIPTKIQKGFRSIVVYLTALDTNGDYIAVGSSIGMLYLYCRHLNQMRKYNFEGKTESITVVKLLSCFDDLVAAGTASGRVAVFQLVSSLPGRNKQLRRFDVTGIHKNSITALAWSPNGMKLFSGDDKGKIVYSSLDLDQGLCNSQLVLEEPSSIVQLDYSQKVLLVSTLQRSLLFYTEEKSVRQIGTQPRKSTGKFGACFIPGLCKQSDLTLYASRPGLRLWKADVHGTVQATFILKDAFAGGVKPFELHPRLESPNSGSCSLPERHLGLVSCFFQEGWVLSWNEYSIYLLDTVNQATIAGLEGSGDIVSVSCTENEIFFLKGDRNIIRISSRPEGLTSTVRDGLEMSGCSERVHVQQAEKLPGATVSETRLRGSSMASSVASEPRSRSSSLNSTDSGSGLLPPGLQATPELGKGSQPLSQRFNAISSEDFDQELVVKPIKVKRKKKKKKTEGGSRSTCHSSLESTPCSEFPGDSPQSLNTDLLSMTSSVLGSSVDQLSAESPDQESSFNGEVNGVPQENTDPETFNVLEVSGSMPDSLAEEDDIRTEMPHCHHAHGRELLNGAREDVGGSDVTGLGDEPCPADDGPNSTQLPFQEQDSSPGAHDGEDIQPIGPQSTFCEVPLLNSLTVPSSLSWAPSAEQWLPGTRADEGSPVEPSQEQDILTSMEASGHLSTNLWHAVTDDDTGQKEIPISERVLGSVGGQLTPVSALAASTHKPWLEQPPRDQTLTSSDEEDIYAHGLPSSSSETSVTELGPSCSQQDLSRLGAEDAGLLKPDQFAESWMGYSGPGYGILSLVVSEKYIWCLDYKGGLFCSALPGAGLRWQKFEDAVQQVAVSPSGALLWKIEQKSNRAFACGKVTIKGKRHWYEALPQAVFVALSDDTAWIIRTSGDLYLQTGLSVDRPCARAVKVDCPYPLSQITARNNVVWALTEQRALLYREGVSSFCPEGEQWKCDIVSERQALEPVCITLGDQQTLWALDIHGNLWFRTGIISKKPQGDDDHWWQVSITDYVVFDQCSLFQTIIHATHSVATAAQAPVEKVADKLRMAFWSQQLQCQPSLLGVNNSGVWISSGKNEFHVAKGSLIGTYWNHVVPRGTASATKWAFVLASAAPTKEGSFLWLCQSSKDLCSVSAQSAQSRPSTVQLPPEAEMRAYAACQDALWALDSLGQVFIRTLSKSCPTGMHWTRLDLSQLARRGQLGQRPFQPQRPDAVGA

SEQ ID NO: 1358 - protein, 568 aa, Homo sapiens [sequence omitted]

SEQ ID NO: 1359 - protein, 568 aa, Homo sapiens [sequence omitted]

SEQ ID NO: 1360 - protein, 543 aa, Homo sapiens [sequence omitted]

SEQ ID NO: 1361 - protein, 670 aa, Homo sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 1362 - protein, 670 aa, Homo sapiens; identical to SEQ ID NO: 1361

SEQ ID NO: 1363 - protein, 579 aa, Homo sapiens
MFLTKNCKQEQERVESAKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFGKNSYFFPHPIRTILLLLFFITL

SEQ ID NO: 1364 - protein, 670 aa, Homo sapiens; identical to SEQ ID NO: 1361

SEQ ID NO: 1365 - protein, 679 aa, Homo sapiens
MCRGCGCLPPDAPCPTLCSRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGDPIGDQWEEEEGGFNYAVDLVKHIRSEFGDYFDICVAGYPKGHPEAGSFEADLKHLKEKVSAGADFIITQLFFEADTFFRFVKACTDMGITCPIVPGIFPIQGYHSLRQLVKLSKLEVPQEIKDVIEPIKDNDAAIRNYGIELAVSLCQELLASGLVPGLHFYTLNREMATTEVLKRLGMWTEDPRRPLPWALSAHPKRREEDVRPIFWASRPKSYIYRTQEWDEFPNGRWGNSSSPAFGELKDYYLFYLKSKSPKEELLKMWGEELTSEESVFEVFVLYLSGEPNRNGHKVTCLPWNDEPLAAETSLLKEELLRVNRQGILTINSQPNINGKPSSDPIVGWGPSGGYVFQKAYLEFFTSRETAEALLQVLKKYELRVNYHLVNVKGENITNAPELQPNAVTWGIFPGREIIQPTVVDPVSFMFWKDEAFALWIERWGKLYEEESPSRTIIQYIHDNYFLVNLVDNDFPLDNCLWQVVEDTLELLNRPTQNARETEAP

SEQ ID NO: 1366 - protein, 656 aa, Homo sapiens [sequence omitted]

SEQ ID NO: 1367 - protein, 679 aa, Homo sapiens; identical to SEQ ID NO: 1365

SEQ ID NO: 1368 - protein, 656 aa, Homo sapiens [sequence omitted]

SEQ ID NO: 1369 - protein, 656 aa, Homo sapiens [sequence omitted]

SEQ ID NO: 1370 - protein, 656 aa, Homo sapiens [sequence omitted]

SEQ ID NO: 1371 - protein, 1608 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 1372 - protein, 1479 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 1373 - protein, 1647 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 1374 - protein, 1565 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 1375 - protein, 1542 aa, Homo sapiens [sequence omitted]

SEQ ID NO: 1376 - protein, 1588 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 1377 - protein, 1545 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 1378 - protein, 1588 aa, Homo sapiens; identical to SEQ ID NO: 1376

SEQ ID NO: 1379 - protein, 1581 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 1380 - protein, 1474 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 1381 - protein, 858 aa, Homo sapiens
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELEPLQGKTLSFFSLAANSLYSRVSVDWGKCMNPFRNMVLEILDVSGNGWTVDITGNFSNAISKSQAFSLILAHHIMGAGFGFHNIKDPDQNTFAGLARSSVRHLDLSHGFVFSLNSRVFETLKDLKVLNLAYNKINKIADEAFYGLDNLQVLNLSYNLLGELYSSNFYGLPKVAYIDLQKNHIAIIQDQTFKFLEKLQTLDLRDNALTTIHFIPSIPDIFLSGNKLVTLPKINLTANLIHLSENRLENLDILYFLLRVPHLQILILNQNRFSSCSGDQTPSENPSLEQLFLGENMLQLAWETELCWDVFEGLSHLQVLYLNHNYLNSLPPGVFSHLTALRGLSLNSNRLTVLSHNDLPANLEILDISRNQLLAPNPDVFVSLSVLDITHNKFICECELSTFINWLNHTNVTIAGPPADIYCVYPDSFSGVSLFSLSTEGCDEEEVLKSLKFSLFIVCTVTLTLFLMTILTVTKFRGFCFICYKTAQRLVFKDHPQGTEPDMYKYDAYLCFSSKDFTWVQNALLKHLDTQYSDQNRFNLCFEERDFVPGENRIANIQDAIWNSRKIVCLVSRHFLRDGWCLEAFSYAQGRCLSDLNSALIMVVVGSLSQYQLMKHQSIRGFVQKQQYLRWPEDLQDVGWFLHKLSQQILKKEKEKKKDNNIPLQTVATIS

SEQ ID NO: 1382 - protein, 858 aa, Homo sapiens; identical to SEQ ID NO: 1381

SEQ ID NO: 1383 - protein, 340 aa, Homo sapiens [sequence omitted]

SEQ ID NO: 1384 - protein, 247 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1385 - protein, 247 aa, Homo sapiens; identical to SEQ ID NO: 1384

SEQ ID NO: 1386 - protein, 247 aa, Homo sapiens; identical to SEQ ID NO: 1384

SEQ ID NO: 1387 - protein, 405 aa, Homo sapiens [sequence omitted]

SEQ ID NO: 1388 - protein, 405 aa, Homo sapiens [sequence omitted]

SEQ ID NO: 1389 - protein, 381 aa, Homo sapiens
MHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 1390 - protein, 784 aa, Homo sapiens
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 1391 - protein, 784 aa, Homo sapiens; identical to SEQ ID NO: 1390

SEQ ID NO: 1392 - protein, 160 aa, Homo sapiens
MVKPFTPSAGLLPEQAQRHMRRGGSCLETLSPPGPPVCNPAEAMPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 1393 - protein, 117 aa, Homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 1394 - protein, 358 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLRPVQLTDHIRAGPS

SEQ ID NO: 1395 - protein, 451 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 1396 - protein, 388 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLSTGPIWLNEVFCFGRESSIEECKIRQWGTRACSHSEDAGVTCTL

SEQ ID NO: 1397 - protein, 358 aa, Homo sapiens; identical to SEQ ID NO: 1394

SEQ ID NO: 1398 - protein, 358 aa, Homo sapiens; identical to SEQ ID NO: 1394

SEQ ID NO: 1399 - protein, 400 aa, Homo sapiens
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 1400 - protein, 201 aa, Homo sapiens [sequence omitted]

SEQ ID NO: 1401 - protein, 422 aa, Homo sapiens
MAGCVPLLQGLVLVLALHRVEPSATSLKERHGLHSDSACTGVQESLFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 1402 - protein, 704 aa, Homo sapiens
MKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDM

SEQ ID NO: 1403 - protein, 1420 aa, Homo sapiens [sequence omitted]

SEQ ID NO: 1404 - protein, 1232 aa, Homo sapiens [sequence omitted]

SEQ ID NO: 1405 - protein, 1420 aa, Homo sapiens [sequence omitted]

SEQ ID NO: 1406 - protein, 1627 aa, Homo sapiens
MRLWSWVLHLGLLSAALGCGLAERPRRARRDPRAGRPPRPAAGPATCATRGPRPPRLAAAAAAAGRAWEAVRVPRRRQQREARGATEEPSPPSRALYFSGRGEQLRVLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGRGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 1407 - protein, 617 aa, Homo sapiens [sequence omitted]

SEQ ID NO: 1408 - protein, 617 aa, Homo sapiens [sequence omitted]

SEQ ID NO: 1409 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 1410 - protein, 364 aa, Homo sapiens; identical to SEQ ID NO: 1409

SEQ ID NO: 1411 - protein, 364 aa, Homo sapiens; identical to SEQ ID NO: 1409

SEQ ID NO: 1412 - protein, 364 aa, Homo sapiens; identical to SEQ ID NO: 1409

SEQ ID NO: 1413 - protein, 364 aa, Homo sapiens; identical to SEQ ID NO: 1409

SEQ ID NO: 1414 - protein, 2468 aa, Homo sapiens [sequence omitted]

SEQ ID NO: 1415 - protein, 2622 aa, Homo sapiens [sequence omitted]

SEQ ID NO: 1416 - protein, 2147 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRADDTDSQSWRSPLKALSEFFKGDPKGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPGVRVMNCSAQILWGWRVQFHTGSR

SEQ ID NO: 1417 - protein, 2534 aa, Homo sapiens [sequence omitted]

SEQ ID NO: 1418 - protein, 2622 aa, Homo sapiens [sequence omitted]

SEQ ID NO: 1419 - protein, 2598 aa, Homo sapiens [sequence omitted]

SEQ ID NO: 1420 - protein, 2602 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVNCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNMVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 1421 - protein, 619 aa, Homo sapiens [sequence omitted]

SEQ ID NO: 1422 - protein, 619 aa, Homo sapiens [sequence omitted]

SEQ ID NO: 1423 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 1424 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 1425 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAKKVRRAIEQLAAMD

SEQ ID NO: 1426 - protein, 120 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIERALLAE

SEQ ID NO: 1427 - protein, 137 aa, Homo sapiens; identical to SEQ ID NO: 1424

SEQ ID NO: 1428 - protein, 165 aa, Homo sapiens; identical to SEQ ID NO: 1425

SEQ ID NO: 1429 - protein, 142 aa, Homo sapiens; identical to SEQ ID NO: 1423

SEQ ID NO: 1430 - protein, 583 aa, Homo sapiens [sequence omitted]

SEQ ID NO: 1431 - protein, 570 aa, Homo sapiens [sequence omitted]

SEQ ID NO: 1432 - protein, 532 aa, Homo sapiens [sequence omitted]

SEQ ID NO: 1433 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLMDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 1434 - protein, 405 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGFLLRLNQST

SEQ ID NO: 1435 - protein, 376 aa, Homo sapiens
MLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 1436 - protein, 529 aa, Homo sapiens
MLKWPIPGQVALFQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 1437 - protein, 1009 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 1438 - protein, 559 aa, Homo sapiens
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAGNGCAPTPEEQLPKTAPSPLVEAKDPKLREDRRPITVHFGQVRPPRPHVVKRPKSNIAVEGRRTSVPSPEQNTIATPATLHILQKSITHFAAKFPTRGWTSSSH

SEQ ID NO: 1439 - protein, 378 aa, Homo sapiens
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 1440 - protein, 378 aa, Homo sapiens; identical to SEQ ID NO: 1439

SEQ ID NO: 1441 - protein, 391 aa, Homo sapiens
MAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVPEPVSGCQGLWEGCRQPRPPPALGFSRTGKLCFLCPSCCE

SEQ ID NO: 1442 - protein, 391 aa, Homo sapiens; identical to SEQ ID NO: 1441

SEQ ID NO: 1443 - protein, 354 aa, Homo sapiens
MAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQLAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 1444 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 1445 - protein, 569 aa, Homo sapiens; identical to SEQ ID NO: 1444

SEQ ID NO: 1446 - protein, 569 aa, Homo sapiens; identical to SEQ ID NO: 1444

SEQ ID NO: 1447 - protein, 306 aa, Homo sapiens
MREGLGAACEAAGPRLCRLLCRILRPKPDCCPRRASPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAHRHHSISNALENDYMKMAITSKTLKELDVNVKNNPFLHMHVLTTMCVGGVGVMVIITVVMLRAKIEEHLARVEAVTKEIETTGTYQLTGDELIFATKQAWRNAPRCIGRIQWSNLQVNFLRLERERAGGGQALSRWLGTATQSCAQASWD

SEQ ID NO: 1448 - protein, 974 aa, Homo sapiens [sequence omitted]

SEQ ID NO: 1449 - protein, 997 aa, Homo sapiens [sequence omitted]

SEQ ID NO: 1450 - protein, 1153 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 1451 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 1452 - protein, 63 aa, Homo sapiens
MCQAWGNPLPELKCLKDGTFPLPIGESVTVTRDLEGTYLCRARSTQGEVTRKPPGMRLSSSLW

SEQ ID NO: 1453 - protein, 830 aa, Homo sapiens
MGLGLLLPLLLLWTRGTQGSELDPKGQHVCVASSPSAELQCCAGWRQKDQECTIPICEGPDACQKDEVCVKPGLCRCKPGFFGAHCSSRCPGQYWGPDCRESCPCHPHGQCEPATGACQCQADRWGARCEFPCACGPHGRCDPATGVCHCEPGWWSSTCRRPCQCNTAAARCEQATGACVCKPGWWGRRCSFRCNCHGSPCEQDSGRCACRPGWWGPECQQQCECVRGRCSAASGECTCPPGFRGARCELPCPAGSHGVQCAHSCGRCKHNEPCSPDTGSCESCEPGWNGTQCQQPCLPGTFGESCEQQCPHCRHGEACEPDTGHCQRCDPGWLGPRCEDPCPTGTFGEDCGSTCPTCVQGSCDTVTGDCVCSAGYWGPSCNASCPAGFHGNNCSVPCECPEGLCHPVSGSCQPGSGSRDTALIVGSLVPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPDEAEAPESFPAAASPGDSATGHRRPPLGSRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 1454 - protein, 491 aa, Homo sapiens
MALLWGLLVLSWSCLQGPCSVFSPVSAMEPLGWQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 1455 - protein, 495 aa, Homo sapiens [sequence omitted]

SEQ ID NO: 1456 - protein, 513 aa, Homo sapiens
MHVRRVRDLCHRFTSFLSLPQEHGAALGAPGAQLVLPARPLLRVLPCERHGALGLQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 1457 - protein, 491 aa, Homo sapiens; identical to SEQ ID NO: 1454

SEQ ID NO: 1458 - protein, 279 aa, Homo sapiens
MHVRRVRDLCHRFTRHRGCDKAFNTEPGADPLTSLTPDLSLQEPGGQTALKSPPGVCSRDPTPEQTHRLARAMMAFTADLFSLVAQTSTCPNLILSPLSVALALSHLALGFWRNKFDPSLTQRDSFHLDEQFTVPVEMMQARTYPLRWFLLEQPEIQNNMSFVVLVPTHFEWNVSQVLANLSWDTLHPPLVWERPTKVRLPKLYLKHQMDLVATLSQLGLQELFQAPDLRGISEQSLVVSGVQHQSTLELSAAGNRAAQNSASLLVWEKNWQLGSLWSF

SEQ ID NO: 1459 - protein, 1104 aa, Homo sapiens [sequence omitted]

SEQ ID NO: 1460 - protein, 1077 aa, Homo sapiens [sequence omitted]

SEQ ID NO: 1461 - protein, 471 aa, Homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 1462 - protein, 471 aa, Homo sapiens; identical to SEQ ID NO: 1461

SEQ ID NO: 1463 - protein, 471 aa, Homo sapiens; identical to SEQ ID NO: 1461

SEQ ID NO: 1464 - protein, 445 aa, Homo sapiens [sequence omitted]

SEQ ID NO: 1465 - protein, 792 aa, Homo sapiens
MGVPFFSSLRCMVDLGPCWAGGLTAEMKLLLALAGLLAILATPQPSEGAAPAVLGEVDTSLVLSSMEEAKQLVDKAYKERRERWGTRHCPALGKDVPGLSEKQQAAGSLKVGEGDYGDPCGLPFCLSVPVIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 1466 - protein, 777 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRCGWLGVAAGTGLREASRTPQASRCQRPVLPCRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 1467 - protein, 677 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDR

SEQ ID NO: 1468 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 1469 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 1470 - protein, 1306 aa, Homo sapiens [sequence omitted]

SEQ ID NO: 1471 - protein, 1356 aa, Homo sapiens; identical to SEQ ID NO: 1469

SEQ ID NO: 1472 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 1473 - protein, 549 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 1474 - protein, 807 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 1475 - protein, 1818 aa, Homo sapiens [sequence omitted]

SEQ ID NO: 1476 - protein, 1767 aa, Homo sapiens [sequence omitted]

SEQ ID NO: 1477 - protein, 1818 aa, Homo sapiens [sequence omitted]

SEQ ID NO: 1478 - protein, 1806 aa, Homo sapiens [sequence omitted]

SEQ ID NO: 1479 - protein, 1806 aa, Homo sapiens [sequence omitted]

SEQ ID NO: 1480 - protein, 1767 aa, Homo sapiens [sequence omitted]

SEQ ID NO: 1481 - protein, 113 aa, Homo sapiens
MKVSVAALSCLMLVAVLGSQAQFTNDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 1482 - protein, 113 aa, Homo sapiens; identical to SEQ ID NO: 1481

SEQ ID NO: 1483 - protein, 113 aa, Homo sapiens; identical to SEQ ID NO: 1481

SEQ ID NO: 1484 - protein, 113 aa, Homo sapiens
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 1485 - protein, 544 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRALAPAASASLCISTAGPVTPSSTPSASISSRSQRVEGARTHPHCCCRSRC

SEQ ID NO: 1486 - protein, 513 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRSQRVEGARTHPHCCCRSRC

SEQ ID NO: 1487 - protein, 672 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 1488 - protein, 444 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKGVTLGTTLFPVPSWMWPT

SEQ ID NO: 1489 - protein, 139 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVSCPVQLPADWTCKVQPVWLEFPCLPISCRLRVSSDTSPDSATWGSWK

SEQ ID NO: 1490 - protein, 544 aa, Homo sapiens [sequence omitted]

SEQ ID NO: 1491 - protein, 517 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 1492 - protein, 138 aa, Homo sapiens
MRAGRGATPARELFRDAAFPAADSSLFCDLSTPLAQFREDITWRRPQVPEGGRSQDAPPLLLQEPLLSCVPHRYAQEVSRLCLLPAGTYKVVPSTYLPDTEGAFTVTIATRIDRPSIHSQEMLGQFLQEVSVMAVMKT

SEQ ID NO: 1493 - protein, 139 aa, Homo sapiens; identical to SEQ ID NO: 1489

SEQ ID NO: 1494 - protein, 545 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRALAPAASASLCISTAGPVTPSSTPSASISSRQSQRVEGARTHPHCCCRSRC

SEQ ID NO: 1495 - protein, 444 aa, Homo sapiens; identical to SEQ ID NO: 1488

SEQ ID NO: 1496 - protein, 626 aa, Homo sapiens
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 1497 - protein, 117 aa, Homo sapiens
MATYSLANERLRALEDIEREIGAILQNAGTVILELSKEKTNERLLDRQAAAFTASVQHVEAELSAQIRYLTQVATGQPHEGSSYSSRKDCQMALKRVDYARLKLSDVARTCEQMLEN

SEQ ID NO: 1498 - protein, 273 aa, Homo sapiens [sequence omitted]

SEQ ID NO: 1499 - protein, 663 aa, Homo sapiens
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELQAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 1500 - protein, 663 aa, Homo sapiens; identical to SEQ ID NO: 1499

SEQ ID NO: 1501 - protein, 375 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 1502 - protein, 265 aa, Homo sapiens
MQRNWKLLTSKINWKKRKVRSTTQLRISQMASHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 1503 - protein, 375 aa, Homo sapiens; identical to SEQ ID NO: 1501

SEQ ID NO: 1504 - protein, 145 aa, Homo sapiens [sequence omitted]

SEQ ID NO: 1505 - protein, 375 aa, Homo sapiens
MDALQLANSAFAVDLFKQLCEKEPLGNVLFSPICLSTSLSLAQVGAKGDTANEIGQVLHFENVKDIPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFPESETKECPFRLNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 1506 - protein, 1268 aa, Homo sapiens
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKKKKTTTIAVEVKKSQHKYVIGPKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 1507 - protein, 1268 aa, Homo sapiens; identical to SEQ ID NO: 1506

SEQ ID NO: 1508 - protein, 1268 aa, Homo sapiens; identical to SEQ ID NO: 1506

SEQ ID NO: 1509 - protein, 1196 aa, Homo sapiens [sequence omitted]

SEQ ID NO: 1510 - protein, 1179 aa, Homo sapiens
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPQYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 1511 - protein, 140 aa, Homo sapiens
MLSRAVCGTSRQLAPVLGYLGSRQKHSLPDLPYDYGALEPHINAQIMQLHHSKHHAAYVNNLNVTEEKYQEALAKGRFQAERREAVPGRGDPREPGPIRTGLSVEENSLRICTGSEFSRHDSLSFKHMVYLIVEGVPRWV

SEQ ID NO: 1512 - protein, 222 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 1513 - protein, 222 aa, Homo sapiens; identical to SEQ ID NO: 1512

SEQ ID NO: 1514 - protein, 222 aa, Homo sapiens; identical to SEQ ID NO: 1512

SEQ ID NO: 1515 - protein, 222 aa, Homo sapiens
MLSRAVCGTSRQLPPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKLDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 1516 - protein, 348 aa, Homo sapiens
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGRESPIFKQFFKDWK

SEQ ID NO: 1517 - protein, 348 aa, Homo sapiens; identical to SEQ ID NO: 1516

SEQ ID NO: 1518 - protein, 348 aa, Homo sapiens; identical to SEQ ID NO: 1516

SEQ ID NO: 1519 - protein, 348 aa, Homo sapiens; identical to SEQ ID NO: 1516

SEQ ID NO: 1520 - protein, 698 aa, Homo sapiens [sequence omitted]

SEQ ID NO: 1521 - protein, 725 aa, Homo sapiens [sequence omitted]

SEQ ID NO: 1522 - protein, 615 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCDR

SEQ ID NO: 1523 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 1524 - protein, 662 aa, Homo sapiens; identical to SEQ ID NO: 1523

SEQ ID NO: 1525 - protein, 754 aa, Homo sapiens
  VARIANT (1)...(754): Xaa = Any Amino Acid
MFVGLFSLLSFNVFRSGDGVAEPRRWQRGSPGAVGLYVDPMEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKVLGPSGPDGQGCNPARGVGGLDIHRSWDIRAWRPEGETKTSTLSYRHEERLSX

SEQ ID NO: 1526 - protein, 702 aa, Homo sapiens
MFVGLFSLLSFNVFRSGDGVAEPRRWQRGSPGAVGLYVDPMEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 1527 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 1528 - protein, 55 aa, Homo sapiens
MAPFCPSCALQILAKKLHARLGRQHSMTRNRDKEIPPSEQRHLKWKREIGFWWVT

SEQ ID NO: 1529 - protein, 45 aa, Homo sapiens
MSLPEHSGSTDNSYACTKEHDFKRLWPNAYKMPISKIYKNILQKC

SEQ ID NO: 1530 - protein, 155 aa, Homo sapiens; identical to SEQ ID NO: 1527

SEQ ID NO: 1531 - protein, 155 aa, Homo sapiens; identical to SEQ ID NO: 1527

SEQ ID NO: 1532 - protein, 55 aa, Homo sapiens; identical to SEQ ID NO: 1528

SEQ ID NO: 1533 - protein, 385 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGKKSKRSMNDPY

SEQ ID NO: 1534 - protein, 375 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGLAFIIWLARRLKKGM

SEQ ID NO: 1535 - protein, 320 aa, Homo sapiens [sequence omitted]

SEQ ID NO: 1536 - protein, 373 aa, Homo sapiens
MGCRRTREGPSKAMIFPWKCQSTQRDLWNIFKLWGWTMLCCDFLAHHGTDCWTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYNPLFIPVAVMVTAFSGFNSVLYLMTDTSK

SEQ ID NO: 1537 - protein, 385 aa, Homo sapiens; identical to SEQ ID NO: 1533

SEQ ID NO: 1538 - protein, 372 aa, Homo sapiens [sequence omitted]

SEQ ID NO: 1539 - protein, 275 aa, Homo sapiens
MLGGVTLKLFYLLPRTAASGARSRPEPGTQVRSLNFRMLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 1540 - protein, 238 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 1541 - protein, 238 aa, Homo sapiens; identical to SEQ ID NO: 1540

SEQ ID NO: 1542 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 1543 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 1544 - protein, 160 aa, Homo sapiens
MDYLLMIFSLLFVACQGAPETAVLGAELSAVGENGGEKPTPSPPWRLRRSKRCSCSSLMDKECVYFCHLDIIWVNTPEAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 1545 - protein, 212 aa, Homo sapiens
MDYLLMIFSLLFVACQGAPETAVLGAELSAVGENGGEKPTPSPPWRLRRSKRCSCSSLMDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 1546 - protein, 212 aa, Homo sapiens; identical to SEQ ID NO: 1545

SEQ ID NO: 1547 - protein, 78 aa, Homo sapiens
MEKDWNNHKKGKDCSKLGKKCIYQQLVRGRKIRRSSEEHLRQTRSETMRNSVKSSFHDPKLKGKPSRERYVTHNRAHW

SEQ ID NO: 1548 - protein, 1575 aa, Homo sapiens [sequence omitted]

SEQ ID NO: 1549 - protein, 1575 aa, Homo sapiens [sequence omitted]

SEQ ID NO: 1550 - protein, 1640 aa, Homo sapiens [sequence omitted]

SEQ ID NO: 1551 - protein, 127 aa, Homo sapiens
MPHEELPSLQRPRYGSIVDDERLSAEEMDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPK

SEQ ID NO: 1552 - protein, 374 aa, Homo sapiens
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 1553 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 1554 - protein, 777 aa, Homo sapiens; identical to SEQ ID NO: 1553

SEQ ID NO: 1555 - protein, 894 aa, Homo sapiens [sequence omitted]

SEQ ID NO: 1556 - protein, 768 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 1557 - protein, 790 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQDDGKCPLNPHSHLGTYGVFTNAAFDPSP

SEQ ID NO: 1558 - protein, 830 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 1559 - protein, 830 aa, Homo sapiens; identical to SEQ ID NO: 1558

SEQ ID NO: 1560 - protein, 610 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 1561 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 1562 - protein, 481 aa, Homo sapiens
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 1563 - protein, 467 aa, Homo sapiens
MILLPLRLARLRHPLRHHWSISGGVDSSPQGDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 1564 - protein, 452 aa, Homo sapiens
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 1565 - protein, 132 aa, Homo sapiens
MVSVNAPLGAPVESSYGKWGWGKTGQGGTAVSFGRPWDTSPCVSYGPKAPPGAPLEGQEAPRRQCDRFPKLSSRGMACLVREVLGGAEKPWGRGLAHFVCPEAFLGMHLRGLSKTPQRVGLGSTVLFRCGAN

SEQ ID NO: 1566 - protein, 417 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGPCQAQEGRGWSGDSPGDRPHTVSSPLSSLASPLCRFGQVA

SEQ ID NO: 1567 - protein, 474 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 1568 - protein, 664 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 1569 - protein, 664 aa, Homo sapiens; identical to SEQ ID NO: 1568

SEQ ID NO: 1570 - protein, 972 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 1571 - protein, 972 aa, Homo sapiens; identical to SEQ ID NO: 1570

SEQ ID NO: 1572 - protein, 1292 aa, Homo sapiens
MDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGADLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 1573 - protein, 132 aa, Homo sapiens
MAFDSTWKVDRSENYDKFMEKMGVNIVKRKLAAHDNLKLTITQEGNKFTVKESSAFRNIEVVFELGVTFNYNLADGTELRGTWSLEGNKLIGKFKRTDNGNELNTVREIIGDELVQTYVYEGVEAKRIFKKD

SEQ ID NO: 1574 - protein, 261 aa, Homo sapiens [sequence omitted]

SEQ ID NO: 1575 - protein, 375 aa, Homo sapiens [sequence omitted]

SEQ ID NO: 1576 - protein, 373 aa, Homo sapiens
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKETLKSKTQ

SEQ ID NO: 1577 - protein, 1228 aa, Homo sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 1578 - protein, 452 aa, Homo sapiens [sequence omitted]

SEQ ID NO: 1579 - protein, 499 aa, Homo sapiens [sequence omitted]

SEQ ID NO: 1580 - protein, 268 aa, Homo sapiens
MQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 1581 - protein, 1023 aa, Homo sapiens [sequence omitted]

SEQ ID NO: 1582 - protein, 410 aa, Homo sapiens [sequence omitted]

SEQ ID NO: 1583 - protein, 1503 aa, Homo sapiens
MAAPAEPCAGQGVWNQTEPEPAATSLLSLCFLRTAGVWVPPMYLWVLGPIYLLFIHHHGRGYLWMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALVCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 1584 - protein, 134 aa, Homo sapiens [sequence omitted]

SEQ ID NO: 1585 - protein, 105 aa, Homo sapiens
MSRSTQGKHSRSHHSGLEYADPEKFADSDQDRDPHRLNSHLKLGFEDVIAEPVTTHSFDKVWICSHALFEISKYVMYKFLTVFLAIPLAFIAGILFATLSCLHIW

SEQ ID NO: 1586 - protein, 162 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 1587 - protein, 162 aa, Homo sapiens; identical to SEQ ID NO: 1586

SEQ ID NO: 1588 - protein, 490 aa, Homo sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 1589 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 1590 - protein, 388 aa, Homo sapiens
MGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1591 - protein, 247 aa, Homo sapiens
MGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDNVSWRHPTMGSVFIGRLIEHMQEYACSCDVEEIFRKVRFSFEQPDGRAQMPTTERVTLTRCFYLFPGH

SEQ ID NO: 1592 - protein, 247 aa, Homo sapiens; identical to SEQ ID NO: 1591

SEQ ID NO: 1593 - protein, 367 aa, Homo sapiens
MGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1594 - protein, 404 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1595 - protein, 367 aa, Homo sapiens; identical to SEQ ID NO: 1593

SEQ ID NO: 1596 - protein, 295 aa, Homo sapiens
MGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1597 - protein, 379 aa, Homo sapiens
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 1598 - protein, 33 aa, Homo sapiens
  VARIANT (1)...(33): Xaa = Any Amino Acid
MLKYTLVYACLEETFQCSLSLLALVINFQIHLX

SEQ ID NO: 1599 - protein, 707 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 1600 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 1601 - protein, 748 aa, Homo sapiens; identical to SEQ ID NO: 1600

SEQ ID NO: 1602 - protein, 567 aa, Homo sapiens
MRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 1603 - protein, 967 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 1604 - protein, 967 aa, Homo sapiens; identical to SEQ ID NO: 1603

SEQ ID NO: 1605 - protein, 950 aa, Homo sapiens
MGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 1606 - protein, 403 aa, Homo sapiens
MCRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKVQWLTPVNLALWEAEAGGSLEGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 1607 - protein, 272 aa, Homo sapiens
MCRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGLPFQIGAVSELQLPESNFLQNTSS

SEQ ID NO: 1608 - protein, 382 aa, Homo sapiens
MCRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 1609 - protein, 255 aa, Homo sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 1610 - protein, 2671 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 1611 - protein, 580 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASASQSAGITGVSHCTWPCCNPVFFSRDRVSPCWPGWSRTPDLR

SEQ ID NO: 1612 - protein, 1823 aa, Homo sapiens
MMMVGQGPMKRLTTLKSSSSAMRKMGETLMRRELRATGIPNQLLVRNGPLKQMAKRATPPTANRPLLRRPGQKPLGLQRQSRDLLPQSLPYPHLTGDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1613 - protein, 2108 aa, Homo sapiens [sequence omitted]

SEQ ID NO: 1614 - protein, 2102 aa, Homo sapiens [sequence omitted]

SEQ ID NO: 1615 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1616 - protein, 668 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 1617 - protein, 601 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 1618 - protein, 635 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGPPADDSSSTSSGEWYQNFQPPPQPPSEEQFGCPGSPSPQPDSTDNDDYDDISAA

SEQ ID NO: 1619 - protein, 592 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEDSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 1620 - protein, 595 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYDSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 1621 - protein, 661 aa, Homo sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMHYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 1622 - protein, 738 aa, Homo sapiens [sequence omitted]

SEQ ID NO: 1623 - protein, 909 aa, Homo sapiens
MAARPLPVSPARALLLALAGALLAPCEARGVSLWNQGRADEVVSASVRSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 1624 - protein, 906 aa, Homo sapiens [sequence omitted]

SEQ ID NO: 1625 - protein, 467 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 1626 - protein, 467 aa, Homo sapiens; identical to SEQ ID NO: 1625

SEQ ID NO: 1627 - protein, 2502 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRRELETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRVRMSYSTAELPSSQLLPLISNL

SEQ ID NO: 1628 - protein, 183 aa, Homo sapiens
MGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQARSTWCSRDPW

SEQ ID NO: 1629 - protein, 2944 aa, Homo sapiens [sequence omitted]

SEQ ID NO: 1630 - protein, 407 aa, Homo sapiens
MGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 1631 - protein, 396 aa, Homo sapiens [sequence omitted]

SEQ ID NO: 1632 - protein, 396 aa, Homo sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVNTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRTKLGPHAGDVEGHLSFLEKDLRDKVNSFFSTFKEKESQDKTLSLPELEQQQEQHQEQQQEQVQMLAPLES

SEQ ID NO: 1633 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 1634 - protein, 897 aa, Homo sapiens; identical to SEQ ID NO: 1633

SEQ ID NO: 1635 - protein, 903 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGSAVLLREEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 1636 - protein, 386 aa, Homo sapiens
MFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 1637 - protein, 374 aa, Homo sapiens
MGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 1638 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 1639 - protein, 331 aa, Homo sapiens; identical to SEQ ID NO: 1638

SEQ ID NO: 1640 - protein, 402 aa, Homo sapiens [sequence omitted]

SEQ ID NO: 1641 - protein, 331 aa, Homo sapiens; identical to SEQ ID NO: 1638

SEQ ID NO: 1642 - protein, 1141 aa, Homo sapiens
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 1643 - protein, 1141 aa, Homo sapiens; identical to SEQ ID NO: 1642

SEQ ID NO: 1644 - protein, 94 aa, Homo sapiens
MDTASHSLVLLQQLNMQREFGFLCDCTVAIGDVYFKAHRAVLAAFSNYFKMIFIHQTRKRKMSCTICGHKFPRKSQLLEHMYTHKDSKSPTLRS

SEQ ID NO: 1645 - protein, 935 aa, Homo sapiens
MAPAEILNGKEISAQIRARLKNQVTQLKEQVPGFTPRLAILQVGNRDDSNLYINVKLKAAEEIGIKATHIKLPRTTTESEVMKYITSLNEDSTVHGFLVQLPLDSENSINTEEVINAIAPEKDVDGLTSINAGRLARGDLNDCFIPCTPKGCLELIKETGVPIAGRHAVVVGRSKIVGAPMHDLLLWNNATVTTCHSKTAHLDEEVNKGDILVVATGQPEMVKGEWIKPGAIVIDCGINYVPDDKKPNGRKVVGDVAYDEAKERASFITPVPGGVGPMTVAMLMQSTVESAKRFLEKFKPGKWMIQYNNLNLKTPVPSDIDISRSCKPKPIGKLAREIGLLSEEVELYGETKAKVLLSALERLKHRPDGKYVVVTGITPTPLGEGKSTTTIGLVQALGAHLYQNVFACVRQPSQGPTFGIKGGAAGGGYSQVIPMEEFNLHLTGDIHAITAANNLVAAAIDARIFHELTQTDKALFNRLVPSVNGVRRFSDIQIRRLKRLGIEKTDPTTLTDEEINRFARLDIDPETITWQRVLDTNDRFLRKITIGQAPTEKGHTRTAQFDISVASEIMAVLALTTSLEDMRERLGKMVVASSKKGEPVSAEDLGVSGALTVLMKDAIKPNLMQTLEGTPVFVHAGPFANIAHGNSSIIADQIALKLVGPEGFVVTEAGFGADIGMEKFFNIKCRYSGLCPHVVVLVATVRALKMHGGGPTVTAGLPLPKAYIQENLELVEKGFSNLKKQIENARMFGIPVVVAVNAFKTDTESELDLISRLSREHGAFDAVKCTHWAEGGKGALALAQAVQRAAQAPSSFQLLYDLKLPVEDKIRIIAQKIYGADDIELLPEAQHKAEVYTKQGFGNLPICMAKTHLSLSHNPEQKGVPTGFILPIRDIRASVGAGFLYPLVGTMSTMPGLPTRPCFYDIDLDPETEQVNGLF

SEQ ID NO: 1646 - protein, 935 aa, Homo sapiens; identical to SEQ ID NO: 1645

SEQ ID NO: 1647 - protein, 152 aa, Homo sapiens
MHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 1648 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 1649 - protein, 406 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 1650 - protein, 406 aa, Homo sapiens; identical to SEQ ID NO: 1649

SEQ ID NO: 1651 - protein, 347 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLGKLYPQNRSRWTVWP

SEQ ID NO: 1652 - protein, 313 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMVMEIWTKRNET

SEQ ID NO: 1653 - protein, 158 aa, Homo sapiens
MMQKLLKCSRLVLALALILVLESSVQGYPTQRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 1654 - protein, 158 aa, Homo sapiens; identical to SEQ ID NO: 1653

SEQ ID NO: 1655 - protein, 993 aa, Homo sapiens [sequence omitted]

SEQ ID NO: 1656 - protein, 993 aa, Homo sapiens
MPALARDAGTVPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVGKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 1657 - DNA, 201 bp, Homo sapiens
atcagctttagttcttcagtaccttagagttccacttgttgaccgagccacatgtcttcgatctacaaagttcaccatctataacaacatgttctgtgctrgcttccatgaaggaggtagagattcatgtcaaggagatagtgggggaccccatgttactgaagtggaagggaccagtttcttaactggaattattagctg

SEQ ID NO: 1658 - DNA, 201 bp, Homo sapiens
tataacaacatgttctgtgctggcttccatgaaggaggtagagattcatgtcaaggagatagtgggggaccccatgttactgaagtggaagggaccagttycttaactggaattattagctggggtgaagagtgtgcaatgaaaggcaaatatggaatatataccaaggtatcccggtatgtcaactggattaaggaaaaa

SEQ ID NO: 1659 - DNA, 201 bp, Homo sapiens
tcgggttgttggtggagaagatgccaaaccaggtcaattcccttggcaggttgttttgaatggtaaagttgatgcattctgtggaggctctatcgttaatkaaaaatggattgtaactgctgcccactgtgttgaaactggtgttaaaattacagttgtcgcaggtgaacataatattgaggagacagaacatacagagca

SEQ ID NO: 1660 - DNA, 201 bp, Homo sapiens
gagatcagctttagttcttcagtaccttagagttccacttgttgaccgagccacatgtcttcgatctacaaagttcaccatctataacaacatgttctgtsctggcttccatgaaggaggtagagattcatgtcaaggagatagtgggggaccccatgttactgaagtggaagggaccagtttcttaactggaattattag

SEQ ID NO: 1661 - DNA, 201 bp, Homo sapiens
gttggtggagaagatgccaaaccaggtcaattcccttggcaggttgttttgaatggtaaagttgatgcattctgtggaggctctatcgttaatgaaaaatrgattgtaactgctgcccactgtgttgaaactggtgttaaaattacagttgtcgcaggtgaacataatattgaggagacagaacatacagagcaaaagcga

SEQ ID NO: 1662 - DNA, 201 bp, Homo sapiens
ttggtggagaagatgccaaaccaggtcaattcccttggcaggttgttttgaatggtaaagttgatgcattctgtggaggctctatcgttaatgaaaaatgkattgtaactgctgcccactgtgttgaaactggtgttaaaattacagttgtcgcaggtgaacataatattgaggagacagaacatacagagcaaaagcgaa

SEQ ID NO: 1663 - DNA, 201 bp, Homo sapiens
ggtggagaagatgccaaaccaggtcaattcccttggcaggttgttttgaatggtaaagttgatgcattctgtggaggctctatcgttaatgaaaaatggaytgtaactgctgcccactgtgttgaaactggtgttaaaattacagttgtcgcaggtgaacataatattgaggagacagaacatacagagcaaaagcgaaat

SEQ ID NO: 1664 - DNA, 201 bp, Homo sapiens
gctgcccactgtgttgaaactggtgttaaaattacagttgtcgcaggtgaacataatattgaggagacagaacatacagagcaaaagcgaaatgtgattckaattattcctcaccacaactacaatgcagctattaataagtacaaccatgacattgcccttctggaactggacgaacccttagtgctaaacagctacgtt

SEQ ID NO: 1665 - DNA, 201 bp, Homo sapiens
gttgaaactggtgttaaaattacagttgtcgcaggtgaacataatattgaggagacagaacatacagagcaaaagcgaaatgtgattcgaattattcctcrccacaactacaatgcagctattaataagtacaaccatgacattgcccttctggaactggacgaacccttagtgctaaacagctacgttacacctatttgc

SEQ ID NO: 1666 - DNA, 201 bp, Homo sapiens
tgaaactggtgttaaaattacagttgtcgcaggtgaacataatattgaggagacagaacatacagagcaaaagcgaaatgtgattcgaattattcctcacyacaactacaatgcagctattaataagtacaaccatgacattgcccttctggaactggacgaacccttagtgctaaacagctacgttacacctatttgcat

SEQ ID NO: 1667 - DNA, 201 bp, Homo sapiens
ggtgttaaaattacagttgtcgcaggtgaacataatattgaggagacagaacatacagagcaaaagcgaaatgtgattcgaattattcctcaccacaactrcaatgcagctattaataagtacaaccatgacattgcccttctggaactggacgaacccttagtgctaaacagctacgttacacctatttgcattgctgac

SEQ ID NO: 1668 - DNA, 201 bp, Homo sapiens
gttaaaattacagttgtcgcaggtgaacataatattgaggagacagaacatacagagcaaaagcgaaatgtgattcgaattattcctcaccacaactacartgcagctattaataagtacaaccatgacattgcccttctggaactggacgaacccttagtgctaaacagctacgttacacctatttgcattgctgacaag

SEQ ID NO: 1669 - DNA, 201 bp, Homo sapiens
gaacataatattgaggagacagaacatacagagcaaaagcgaaatgtgattcgaattattcctcaccacaactacaatgcagctattaataagtacaaccrtgacattgcccttctggaactggacgaacccttagtgctaaacagctacgttacacctatttgcattgctgacaaggaatacacgaacatcttcctcaaa

SEQ ID NO: 1670 - DNA, 201 bp, Homo sapiens
aacataatattgaggagacagaacatacagagcaaaagcgaaatgtgattcgaattattcctcaccacaactacaatgcagctattaataagtacaaccakgacattgcccttctggaactggacgaacccttagtgctaaacagctacgttacacctatttgcattgctgacaaggaatacacgaacatcttcctcaaat

SEQ ID NO: 1671 - DNA, 201 bp, Homo sapiens
ccttagagttccacttgttgaccgagccacatgtcttcgatctacaaagttcaccatctataacaacatgttctgtgctggcttccatgaaggaggtagarattcatgtcaaggagatagtgggggaccccatgttactgaagtggaagggaccagtttcttaactggaattattagctggggtgaagagtgtgcaatgaa

SEQ ID NO: 1672 - DNA, 201 bp, Homo sapiens
gacagaacatacagagcaaaagcgaaatgtgattcgaattattcctcaccacaactacaatgcagctattaataagtacaaccatgacattgcccttctgkaactggacgaacccttagtgctaaacagctacgttacacctatttgcattgctgacaaggaatacacgaacatcttcctcaaatttggatctggctatgt

SEQ ID NO: 1673 - DNA, 201 bp, Homo sapiens
gtggagaagatgccaaaccaggtcaattcccttggcaggttgttttgaatggtaaagttgatgcattctgtggaggctctatcgttaatgaaaaatggatkgtaactgctgcccactgtgttgaaactggtgttaaaattacagttgtcgcaggtgaacataatattgaggagacagaacatacagagcaaaagcgaaatg

SEQ ID NO: 1674 - DNA, 201 bp, Homo sapiens
aaggagatagtgggggaccccatgttactgaagtggaagggaccagtttcttaactggaattattagctggggtgaagagtgtgcaatgaaaggcaaatakggaatatataccaaggtatcccggtatgtcaactggattaaggaaaaaacaaagctcacttaatgaaagatggatttccaaggttaattcattggaattg

SEQ ID NO: 1675 - DNA, 201 bp, Homo sapiens
gaagatgccaaaccaggtcaattcccttggcaggttgttttgaatggtaaagttgatgcattctgtggaggctctatcgttaatgaaaaatggattgtaaytgctgcccactgtgttgaaactggtgttaaaattacagttgtcgcaggtgaacataatattgaggagacagaacatacagagcaaaagcgaaatgtgatt

SEQ ID NO: 1676 - DNA, 201 bp, Homo sapiens
agggagatcagctttagttcttcagtaccttagagttccacttgttgaccgagccacatgtcttcgatctacaaagttcaccatctataacaacatgttchgtgctggcttccatgaaggaggtagagattcatgtcaaggagatagtgggggaccccatgttactgaagtggaagggaccagtttcttaactggaattat

SEQ ID NO: 1677 - DNA, 201 bp, Homo sapiens
  misc_feature (1)...(201): n = A,T,C or G, or insertion/deletion polymorphism (see Tables 1-2)
gggagatcagctttagttcttcagtaccttagagttccacttgttgaccgagccacatgtcttcgatctacaaagttcaccatctataacaacatgttctntgctggcttccatgaaggaggtagagattcatgtcaaggagatagtgggggaccccatgttactgaagtggaagggaccagtttcttaactggaattatt

SEQ ID NO: 1678 - DNA, 201 bp, Homo sapiens
tcagctttagttcttcagtaccttagagttccacttgttgaccgagccacatgtcttcgatctacaaagttcaccatctataacaacatgttctgtgctgvcttccatgaaggaggtagagattcatgtcaaggagatagtgggggaccccatgttactgaagtggaagggaccagtttcttaactggaattattagctgg

SEQ ID NO: 1679 - DNA, 201 bp, Homo sapiens
acataatattgaggagacagaacatacagagcaaaagcgaaatgtgattcgaattattcctcaccacaactacaatgcagctattaataagtacaaccatracattgcccttctggaactggacgaacccttagtgctaaacagctacgttacacctatttgcattgctgacaaggaatacacgaacatcttcctcaaatt

SEQ ID NO: 1680 - DNA, 201 bp, Homo sapiens
cataatattgaggagacagaacatacagagcaaaagcgaaatgtgattcgaattattcctcaccacaactacaatgcagctattaataagtacaaccatgdcattgcccttctggaactggacgaacccttagtgctaaacagctacgttacacctatttgcattgctgacaaggaatacacgaacatcttcctcaaattt

SEQ ID NO: 1681 - DNA, 201 bp, Homo sapiens
ataatattgaggagacagaacatacagagcaaaagcgaaatgtgattcgaattattcctcaccacaactacaatgcagctattaataagtacaaccatgamattgcccttctggaactggacgaacccttagtgctaaacagctacgttacacctatttgcattgctgacaaggaatacacgaacatcttcctcaaatttg

SEQ ID NO: 1682 - DNA, 201 bp, Homo sapiens
cttagagttccacttgttgaccgagccacatgtcttcgatctacaaagttcaccatctataacaacatgttctgtgctggcttccatgaaggaggtagagrttcatgtcaaggagatagtgggggaccccatgttactgaagtggaagggaccagtttcttaactggaattattagctggggtgaagagtgtgcaatgaaa

SEQ ID NO: 1683 - DNA, 201 bp, Homo sapiens
agagttccacttgttgaccgagccacatgtcttcgatctacaaagttcaccatctataacaacatgttctgtgctggcttccatgaaggaggtagagattbatgtcaaggagatagtgggggaccccatgttactgaagtggaagggaccagtttcttaactggaattattagctggggtgaagagtgtgcaatgaaaggc

SEQ ID NO: 1684 - DNA, 201 bp, Homo sapiens
taatattgaggagacagaacatacagagcaaaagcgaaatgtgattcgaattattcctcaccacaactacaatgcagctattaataagtacaaccatgacwttgcccttctggaactggacgaacccttagtgctaaacagctacgttacacctatttgcattgctgacaaggaatacacgaacatcttcctcaaatttgg

SEQ ID NO: 1685 - DNA, 201 bp, Homo sapiens
  misc_feature (1)...(201): n = A,T,C or G, or insertion/deletion polymorphism (see Tables 1-2)
agttccacttgttgaccgagccacatgtcttcgatctacaaagttcaccatctataacaacatgttctgtgctggcttccatgaaggaggtagagattcangtcaaggagatagtgggggaccccatgttactgaagtggaagggaccagtttcttaactggaattattagctggggtgaagagtgtgcaatgaaaggcaa

SEQ ID NO: 1686 - DNA, 201 bp, Homo sapiens
aatattgaggagacagaacatacagagcaaaagcgaaatgtgattcgaattattcctcaccacaactacaatgcagctattaataagtacaaccatgacaytgcccttctggaactggacgaacccttagtgctaaacagctacgttacacctatttgcattgctgacaaggaatacacgaacatcttcctcaaatttgga

SEQ ID NO: 1687 - DNA, 201 bp, Homo sapiens
  misc_feature (1)...(201): n = A,T,C or G, or insertion/deletion polymorphism (see Tables 1-2)
gttccacttgttgaccgagccacatgtcttcgatctacaaagttcaccatctataacaacatgttctgtgctggcttccatgaaggaggtagagattcatntcaaggagatagtgggggaccccatgttactgaagtggaagggaccagtttcttaactggaattattagctggggtgaagagtgtgcaatgaaaggcaaa

SEQ ID NO: 1688 - DNA, 201 bp, Homo sapiens
attgaggagacagaacatacagagcaaaagcgaaatgtgattcgaattattcctcaccacaactacaatgcagctattaataagtacaaccatgacattghccttctggaactggacgaacccttagtgctaaacagctacgttacacctatttgcattgctgacaaggaatacacgaacatcttcctcaaatttggatct

SEQ ID NO: 1689 - DNA, 201 bp, Homo sapiens
acttgttgaccgagccacatgtcttcgatctacaaagttcaccatctataacaacatgttctgtgctggcttccatgaaggaggtagagattcatgtcaadgagatagtgggggaccccatgttactgaagtggaagggaccagtttcttaactggaattattagctggggtgaagagtgtgcaatgaaaggcaaatatgg

SEQ ID NO: 1690 - DNA, 201 bp, Homo sapiens
tgaggagacagaacatacagagcaaaagcgaaatgtgattcgaattattcctcaccacaactacaatgcagctattaataagtacaaccatgacattgccyttctggaactggacgaacccttagtgctaaacagctacgttacacctatttgcattgctgacaaggaatacacgaacatcttcctcaaatttggatctgg

SEQ ID NO: 1691 - DNA, 201 bp, Homo sapiens
gaggagacagaacatacagagcaaaagcgaaatgtgattcgaattattcctcaccacaactacaatgcagctattaataagtacaaccatgacattgcccdtctggaactggacgaacccttagtgctaaacagctacgttacacctatttgcattgctgacaaggaatacacgaacatcttcctcaaatttggatctggc

SEQ ID NO: 1692 - DNA, 201 bp, Homo sapiens
gagacagaacatacagagcaaaagcgaaatgtgattcgaattattcctcaccacaactacaatgcagctattaataagtacaaccatgacattgcccttcyggaactggacgaacccttagtgctaaacagctacgttacacctatttgcattgctgacaaggaatacacgaacatcttcctcaaatttggatctggctat

SEQ ID NO: 1693 - DNA, 201 bp, Homo sapiens
gaatggcagatgcgagcagttttgtaaaaatagtgctgataacaaggtggtttgctcctgtactgagggatatcgactttcacaaacttctaagctcacchgtgctgagactgtttttcctgatgtggactatgtaaattctactgaagctgaaaccattttggataacatcactcaaagcacccaatcatttaatgactt

SEQ ID NO: 1694 - DNA, 201 bp, Homo sapiens
  misc_feature (1)...(201): n = A,T,C or G, or insertion/deletion polymorphism (see Tables 1-2)
gaacatacagagcaaaagcgaaatgtgattcgaattattcctcaccacaactacaatgcagctattaataagtacaaccatgacattgcccttctggaacnggacgaacccttagtgctaaacagctacgttacacctatttgcattgctgacaaggaatacacgaacatcttcctcaaatttggatctggctatgtaagt

SEQ ID NO: 1695 - DNA, 201 bp, Homo sapiens
  misc_feature (1)...(201): n = A,T,C or G, or insertion/deletion polymorphism (see Tables 1-2)
aatggcagatgcgagcagttttgtaaaaatagtgctgataacaaggtggtttgctcctgtactgagggatatcgactttcacaaacttctaagctcacccntgctgagactgtttttcctgatgtggactatgtaaattctactgaagctgaaaccattttggataacatcactcaaagcacccaatcatttaatgacttc

SEQ ID NO: 1696 - DNA, 201 bp, Homo sapiens
tggcagatgcgagcagttttgtaaaaatagtgctgataacaaggtggtttgctcctgtactgagggatatcgactttcacaaacttctaagctcacccgtsctgagactgtttttcctgatgtggactatgtaaattctactgaagctgaaaccattttggataacatcactcaaagcacccaatcatttaatgacttcac

SEQ ID NO: 1697 - DNA, 201 bp, Homo sapiens
gtgctgataacaaggtggtttgctcctgtactgagggatatcgactttcacaaacttctaagctcacccgtgctgagactgtttttcctgatgtggactakgtaaattctactgaagctgaaaccattttggataacatcactcaaagcacccaatcatttaatgacttcactcgggttgttggtggagaagatgccaaac

SEQ ID NO: 1698 - DNA, 201 bp, Homo sapiens
tcagtaccttagagttccacttgttgaccgagccacatgtcttcgatctacaaagttcaccatctataacaacatgttctgtgctggcttccatgaaggakgtagagattcatgtcaaggagatagtgggggaccccatgttactgaagtggaagggaccagtttcttaactggaattattagctggggtgaagagtgtgc

SEQ ID NO: 1699 - DNA, 201 bp, Homo sapiens
gagaagtttttgaaaacactgaaagaacaactgaattttggaagcagtatgttgatggagatcagtgtgagtccaatccatgtttaaatggcggcagttgmaaggatgacattaattcctatgaatgttggtgtccctttggatttgaaggaaagaactgtgaattagatgtaacatgtaacattaagaatggcagatgcg

SEQ ID NO: 1700 - DNA, 201 bp, Homo sapiens
agatgccaaaccaggtcaattcccttggcaggttgttttgaatggtaaagttgatgcattctgtggaggctctatcgttaatgaaaaatggattgtaactvctgcccactgtgttgaaactggtgttaaaattacagttgtcgcaggtgaacataatattgaggagacagaacatacagagcaaaagcgaaatgtgattcg

SEQ ID NO: 1701 - DNA, 201 bp, Homo sapiens
ccatgaaggaggtagagattcatgtcaaggagatagtgggggaccccatgttactgaagtggaagggaccagtttcttaactggaattattagctggggtraagagtgtgcaatgaaaggcaaatatggaatatataccaaggtatcccggtatgtcaactggattaaggaaaaaacaaagctcacttaatgaaagatgga

SEQ ID NO: 1702 - DNA, 201 bp, Homo sapiens
gccaaaccaggtcaattcccttggcaggttgttttgaatggtaaagttgatgcattctgtggaggctctatcgttaatgaaaaatggattgtaactgctgyccactgtgttgaaactggtgttaaaattacagttgtcgcaggtgaacataatattgaggagacagaacatacagagcaaaagcgaaatgtgattcgaatt

SEQ ID NO: 1703 - DNA, 201 bp, Homo sapiens
ccgtgctgagactgtttttcctgatgtggactatgtaaattctactgaagctgaaaccattttggataacatcactcaaagcacccaatcatttaatgacytcactcgggttgttggtggagaagatgccaaaccaggtcaattcccttggcaggttgttttgaatggtaaagttgatgcattctgtggaggctctatcgt

SEQ ID NO: 1704 - DNA, 201 bp, Homo sapiens
caaaccaggtcaattcccttggcaggttgttttgaatggtaaagttgatgcattctgtggaggctctatcgttaatgaaaaatggattgtaactgctgccyactgtgttgaaactggtgttaaaattacagttgtcgcaggtgaacataatattgaggagacagaacatacagagcaaaagcgaaatgtgattcgaattat

SEQ ID NO: 1705 - DNA, 201 bp, Homo sapiens
tgagactgtttttcctgatgtggactatgtaaattctactgaagctgaaaccattttggataacatcactcaaagcacccaatcatttaatgacttcactbgggttgttggtggagaagatgccaaaccaggtcaattcccttggcaggttgttttgaatggtaaagttgatgcattctgtggaggctctatcgttaatga

SEQ ID NO: 1706 - DNA, 201 bp, Homo sapiens
  misc_feature (1)...(201): n = A,T,C or G, or insertion/deletion polymorphism (see Tables 1-2)
cttgttgaccgagccacatgtcttcgatctacaaagttcaccatctataacaacatgttctgtgctggcttccatgaaggaggtagagattcatgtcaagnagatagtgggggaccccatgttactgaagtggaagggaccagtttcttaactggaattattagctggggtgaagagtgtgcaatgaaaggcaaatatgga

SEQ ID NO: 1707 - DNA, 201 bp, Homo sapiens
ggcaggttgttttgaatggtaaagttgatgcattctgtggaggctctatcgttaatgaaaaatggattgtaactgctgcccactgtgttgaaactggtgtyaaaattacagttgtcgcaggtgaacataatattgaggagacagaacatacagagcaaaagcgaaatgtgattcgaattattcctcaccacaactacaatg

SEQ ID NO: 1708 - DNA, 201 bp, Homo sapiens
tgttgaccgagccacatgtcttcgatctacaaagttcaccatctataacaacatgttctgtgctggcttccatgaaggaggtagagattcatgtcaaggavatagtgggggaccccatgttactgaagtggaagggaccagtttcttaactggaattattagctggggtgaagagtgtgcaatgaaaggcaaatatggaat

SEQ ID NO: 1709 - DNA, 201 bp, Homo sapiens
  misc_feature (1)...(201): n = A,T,C or G, or insertion/deletion polymorphism (see Tables 1-2)
gagactgtttttcctgatgtggactatgtaaattctactgaagctgaaaccattttggataacatcactcaaagcacccaatcatttaatgacttcactcnggttgttggtggagaagatgccaaaccaggtcaattcccttggcaggttgttttgaatggtaaagttgatgcattctgtggaggctctatcgttaatgaa

SEQ ID NO: 1710 - DNA, 201 bp, Homo sapiens
aacaaaattctgaatcggccaaagaggtataattcaggtaaattggaagagtttgttcaagggaaccttgagagagaatgtatggaagaaaagtgtagttytgaagaagcacgagaagtttttgaaaacactgaaagaacaactgaattttggaagcagtatgttgatggagatcagtgtgagtccaatccatgtttaaat

SEQ ID NO: 1711 - DNA, 201 bp, Homo sapiens
gttgaccgagccacatgtcttcgatctacaaagttcaccatctataacaacatgttctgtgctggcttccatgaaggaggtagagattcatgtcaaggagdtagtgggggaccccatgttactgaagtggaagggaccagtttcttaactggaattattagctggggtgaagagtgtgcaatgaaaggcaaatatggaata

SEQ ID NO: 1712 - DNA, 201 bp, Homo sapiens
gactgtttttcctgatgtggactatgtaaattctactgaagctgaaaccattttggataacatcactcaaagcacccaatcatttaatgacttcactcggkttgttggtggagaagatgccaaaccaggtcaattcccttggcaggttgttttgaatggtaaagttgatgcattctgtggaggctctatcgttaatgaaaa

SEQ ID NO: 1713 - DNA, 201 bp, Homo sapiens
agagtttgttcaagggaaccttgagagagaatgtatggaagaaaagtgtagttttgaagaagcacgagaagtttttgaaaacactgaaagaacaactgaaktttggaagcagtatgttgatggagatcagtgtgagtccaatccatgtttaaatggcggcagttgcaaggatgacattaattcctatgaatgttggtgtcc

SEQ ID NO: 1714 - DNA, 201 bp, Homo sapiens
tgaccgagccacatgtcttcgatctacaaagttcaccatctataacaacatgttctgtgctggcttccatgaaggaggtagagattcatgtcaaggagatrgtgggggaccccatgttactgaagtggaagggaccagtttcttaactggaattattagctggggtgaagagtgtgcaatgaaaggcaaatatggaatata

SEQ ID NO: 1715 - DNA, 201 bp, Homo sapiens
gcaaaagcgaaatgtgattcgaattattcctcaccacaactacaatgcagctattaataagtacaaccatgacattgcccttctggaactggacgaacccwtagtgctaaacagctacgttacacctatttgcattgctgacaaggaatacacgaacatcttcctcaaatttggatctggctatgtaagtggctggggaag

SEQ ID NO: 1716 - DNA, 201 bp, Homo sapiens
actgtttttcctgatgtggactatgtaaattctactgaagctgaaaccattttggataacatcactcaaagcacccaatcatttaatgacttcactcgggwtgttggtggagaagatgccaaaccaggtcaattcccttggcaggttgttttgaatggtaaagttgatgcattctgtggaggctctatcgttaatgaaaaa

SEQ ID NO: 1717 - DNA, 201 bp, Homo sapiens
tttgttcaagggaaccttgagagagaatgtatggaagaaaagtgtagttttgaagaagcacgagaagtttttgaaaacactgaaagaacaactgaattttrgaagcagtatgttgatggagatcagtgtgagtccaatccatgtttaaatggcggcagttgcaaggatgacattaattcctatgaatgttggtgtcccttt

SEQ ID NO: 1718 - DNA, 201 bp, Homo sapiens
caaaagcgaaatgtgattcgaattattcctcaccacaactacaatgcagctattaataagtacaaccatgacattgcccttctggaactggacgaaccctyagtgctaaacagctacgttacacctatttgcattgctgacaaggaatacacgaacatcttcctcaaatttggatctggctatgtaagtggctggggaaga

SEQ ID NO: 1719 - DNA, 201 bp, Homo sapiens
tgttcaagggaaccttgagagagaatgtatggaagaaaagtgtagttttgaagaagcacgagaagtttttgaaaacactgaaagaacaactgaattttggragcagtatgttgatggagatcagtgtgagtccaatccatgtttaaatggcggcagttgcaaggatgacattaattcctatgaatgttggtgtccctttgg

SEQ ID NO: 1720 - DNA, 201 bp, Homo sapiens
gaccgagccacatgtcttcgatctacaaagttcaccatctataacaacatgttctgtgctggcttccatgaaggaggtagagattcatgtcaaggagatadtgggggaccccatgttactgaagtggaagggaccagtttcttaactggaattattagctggggtgaagagtgtgcaatgaaaggcaaatatggaatatat

SEQ ID NO: 1721 - DNA, 201 bp, Homo sapiens
tcaagggaaccttgagagagaatgtatggaagaaaagtgtagttttgaagaagcacgagaagtttttgaaaacactgaaagaacaactgaattttggaagyagtatgttgatggagatcagtgtgagtccaatccatgtttaaatggcggcagttgcaaggatgacattaattcctatgaatgttggtgtccctttggatt

SEQ ID NO: 1722 - DNA, 201 bp, Homo sapiens
accgagccacatgtcttcgatctacaaagttcaccatctataacaacatgttctgtgctggcttccatgaaggaggtagagattcatgtcaaggagatagdgggggaccccatgttactgaagtggaagggaccagtttcttaactggaattattagctggggtgaagagtgtgcaatgaaaggcaaatatggaatatata

SEQ ID NO: 1723 - DNA, 201 bp, Homo sapiens
attcgaattattcctcaccacaactacaatgcagctattaataagtacaaccatgacattgcccttctggaactggacgaacccttagtgctaaacagctrcgttacacctatttgcattgctgacaaggaatacacgaacatcttcctcaaatttggatctggctatgtaagtggctggggaagagtcttccacaaaggg

SEQ ID NO: 1724 - DNA, 201 bp, Homo sapiens
ttcgaattattcctcaccacaactacaatgcagctattaataagtacaaccatgacattgcccttctggaactggacgaacccttagtgctaaacagctamgttacacctatttgcattgctgacaaggaatacacgaacatcttcctcaaatttggatctggctatgtaagtggctggggaagagtcttccacaaaggga

SEQ ID NO: 1725 - DNA, 201 bp, Homo sapiens
ttgctcctgtactgagggatatcgactttcacaaacttctaagctcacccgtgctgagactgtttttcctgatgtggactatgtaaattctactgaagctkaaaccattttggataacatcactcaaagcacccaatcatttaatgacttcactcgggttgttggtggagaagatgccaaaccaggtcaattcccttggca

SEQ ID NO: 1726 - DNA, 201 bp, Homo sapiens
agggaaccttgagagagaatgtatggaagaaaagtgtagttttgaagaagcacgagaagtttttgaaaacactgaaagaacaactgaattttggaagcagdatgttgatggagatcagtgtgagtccaatccatgtttaaatggcggcagttgcaaggatgacattaattcctatgaatgttggtgtccctttggatttga

SEQ ID NO: 1727 - DNA, 201 bp, Homo sapiens
cgagccacatgtcttcgatctacaaagttcaccatctataacaacatgttctgtgctggcttccatgaaggaggtagagattcatgtcaaggagatagtgrgggaccccatgttactgaagtggaagggaccagtttcttaactggaattattagctggggtgaagagtgtgcaatgaaaggcaaatatggaatatatacc

SEQ ID NO: 1728 - DNA, 201 bp, Homo sapiens
aacttctaagctcacccgtgctgagactgtttttcctgatgtggactatgtaaattctactgaagctgaaaccattttggataacatcactcaaagcaccyaatcatttaatgacttcactcgggttgttggtggagaagatgccaaaccaggtcaattcccttggcaggttgttttgaatggtaaagttgatgcattctg

SEQ ID NO: 1729 - DNA, 201 bp, Homo sapiens
agccacatgtcttcgatctacaaagttcaccatctataacaacatgttctgtgctggcttccatgaaggaggtagagattcatgtcaaggagatagtgggrgaccccatgttactgaagtggaagggaccagtttcttaactggaattattagctggggtgaagagtgtgcaatgaaaggcaaatatggaatatataccaa

SEQ ID NO: 1730 - DNA, 201 bp, Homo sapiens
attcctcaccacaactacaatgcagctattaataagtacaaccatgacattgcccttctggaactggacgaacccttagtgctaaacagctacgttacachtatttgcattgctgacaaggaatacacgaacatcttcctcaaatttggatctggctatgtaagtggctggggaagagtcttccacaaagggagatcagct

SEQ ID NO: 1731 - DNA, 201 bp, Homo sapiens
gccacatgtcttcgatctacaaagttcaccatctataacaacatgttctgtgctggcttccatgaaggaggtagagattcatgtcaaggagatagtggggvaccccatgttactgaagtggaagggaccagtttcttaactggaattattagctggggtgaagagtgtgcaatgaaaggcaaatatggaatatataccaag

SEQ ID NO: 1732 - DNA, 201 bp, Homo sapiens
ctcaccacaactacaatgcagctattaataagtacaaccatgacattgcccttctggaactggacgaacccttagtgctaaacagctacgttacacctatktgcattgctgacaaggaatacacgaacatcttcctcaaatttggatctggctatgtaagtggctggggaagagtcttccacaaagggagatcagctttag

SEQ ID NO: 1733 - DNA, 201 bp, Homo sapiens
caccacaactacaatgcagctattaataagtacaaccatgacattgcccttctggaactggacgaacccttagtgctaaacagctacgttacacctatttbcattgctgacaaggaatacacgaacatcttcctcaaatttggatctggctatgtaagtggctggggaagagtcttccacaaagggagatcagctttagtt

SEQ ID NO: 1734 - DNA, 201 bp, Homo sapiens
cacatgtcttcgatctacaaagttcaccatctataacaacatgttctgtgctggcttccatgaaggaggtagagattcatgtcaaggagatagtgggggamcccatgttactgaagtggaagggaccagtttcttaactggaattattagctggggtgaagagtgtgcaatgaaaggcaaatatggaatatataccaaggt

SEQ ID NO: 1735 - DNA, 201 bp, Homo sapiens
caactacaatgcagctattaataagtacaaccatgacattgcccttctggaactggacgaacccttagtgctaaacagctacgttacacctatttgcattvctgacaaggaatacacgaacatcttcctcaaatttggatctggctatgtaagtggctggggaagagtcttccacaaagggagatcagctttagttcttca

SEQ ID NO: 1736 - DNA, 201 bp, Homo sapiens
tgcagctattaataagtacaaccatgacattgcccttctggaactggacgaacccttagtgctaaacagctacgttacacctatttgcattgctgacaagkaatacacgaacatcttcctcaaatttggatctggctatgtaagtggctggggaagagtcttccacaaagggagatcagctttagttcttcagtaccttag

SEQ ID NO: 1737 - DNA, 201 bp, Homo sapiens
aagtggctggggaagagtcttccacaaagggagatcagctttagttcttcagtaccttagagttccacttgttgaccgagccacatgtcttcgatctacaragttcaccatctataacaacatgttctgtgctggcttccatgaaggaggtagagattcatgtcaaggagatagtgggggaccccatgttactgaagtgga

SEQ ID NO: 1738 - DNA, 201 bp, Homo sapiens
caaccatgacattgcccttctggaactggacgaacccttagtgctaaacagctacgttacacctatttgcattgctgacaaggaatacacgaacatcttcytcaaatttggatctggctatgtaagtggctggggaagagtcttccacaaagggagatcagctttagttcttcagtaccttagagttccacttgttgaccg

SEQ ID NO: 1739 - DNA, 201 bp, Homo sapiens
cttttaggatatctactcagtgctgaatgtacagtttttcttgatcatgaaaacgccaacaaaattctgaatcggccaaagaggtataattcaggtaaatyggaagagtttgttcaagggaaccttgagagagaatgtatggaagaaaagtgtagttttgaagaagcacgagaagtttttgaaaacactgaaagaacaact

SEQ ID NO: 1740 - DNA, 201 bp, Homo sapiens
gggaaccttgagagagaatgtatggaagaaaagtgtagttttgaagaagcacgagaagtttttgaaaacactgaaagaacaactgaattttggaagcagtrtgttgatggagatcagtgtgagtccaatccatgtttaaatggcggcagttgcaaggatgacattaattcctatgaatgttggtgtccctttggatttgaa

SEQ ID NO: 1741 - DNA, 201 bp, Homo sapiens
acatgtcttcgatctacaaagttcaccatctataacaacatgttctgtgctggcttccatgaaggaggtagagattcatgtcaaggagatagtgggggachccatgttactgaagtggaagggaccagtttcttaactggaattattagctggggtgaagagtgtgcaatgaaaggcaaatatggaatatataccaaggta

SEQ ID NO: 1742 - DNA, 201 bp, Homo sapiens
atgtcttcgatctacaaagttcaccatctataacaacatgttctgtgctggcttccatgaaggaggtagagattcatgtcaaggagatagtgggggacccmatgttactgaagtggaagggaccagtttcttaactggaattattagctggggtgaagagtgtgcaatgaaaggcaaatatggaatatataccaaggtatc

SEQ ID NO: 1743 - DNA, 201 bp, Homo sapiens
tgtcttcgatctacaaagttcaccatctataacaacatgttctgtgctggcttccatgaaggaggtagagattcatgtcaaggagatagtgggggaccccrtgttactgaagtggaagggaccagtttcttaactggaattattagctggggtgaagagtgtgcaatgaaaggcaaatatggaatatataccaaggtatcc

SEQ ID NO: 1744 - DNA, 201 bp, Homo sapiens
gctattaataagtacaaccatgacattgcccttctggaactggacgaacccttagtgctaaacagctacgttacacctatttgcattgctgacaaggaatrcacgaacatcttcctcaaatttggatctggctatgtaagtggctggggaagagtcttccacaaagggagatcagctttagttcttcagtaccttagagtt

SEQ ID NO: 1745 - DNA, 201 bp, Homo sapiens
gtcttcgatctacaaagttcaccatctataacaacatgttctgtgctggcttccatgaaggaggtagagattcatgtcaaggagatagtgggggaccccawgttactgaagtggaagggaccagtttcttaactggaattattagctggggtgaagagtgtgcaatgaaaggcaaatatggaatatataccaaggtatccc

SEQ ID NO: 1746 - DNA, 201 bp, Homo sapiens
acaaagttcaccatctataacaacatgttctgtgctggcttccatgaaggaggtagagattcatgtcaaggagatagtgggggaccccatgttactgaagwggaagggaccagtttcttaactggaattattagctggggtgaagagtgtgcaatgaaaggcaaatatggaatatataccaaggtatcccggtatgtcaac

SEQ ID NO: 1747 - DNA, 201 bp, Homo sapiens
ctattaataagtacaaccatgacattgcccttctggaactggacgaacccttagtgctaaacagctacgttacacctatttgcattgctgacaaggaatavacgaacatcttcctcaaatttggatctggctatgtaagtggctggggaagagtcttccacaaagggagatcagctttagttcttcagtaccttagagttc

SEQ ID NO: 1748 - DNA, 201 bp, Homo sapiens
tattaataagtacaaccatgacattgcccttctggaactggacgaacccttagtgctaaacagctacgttacacctatttgcattgctgacaaggaatacvcgaacatcttcctcaaatttggatctggctatgtaagtggctggggaagagtcttccacaaagggagatcagctttagttcttcagtaccttagagttcc

SEQ ID NO: 1749 - DNA, 201 bp, Homo sapiens
aaagttcaccatctataacaacatgttctgtgctggcttccatgaaggaggtagagattcatgtcaaggagatagtgggggaccccatgttactgaagtgkaagggaccagtttcttaactggaattattagctggggtgaagagtgtgcaatgaaaggcaaatatggaatatataccaaggtatcccggtatgtcaactg

SEQ ID NO: 1750 - DNA, 201 bp, Homo sapiens
attaataagtacaaccatgacattgcccttctggaactggacgaacccttagtgctaaacagctacgttacacctatttgcattgctgacaaggaatacahgaacatcttcctcaaatttggatctggctatgtaagtggctggggaagagtcttccacaaagggagatcagctttagttcttcagtaccttagagttcca

SEQ ID NO: 1751 - DNA, 201 bp, Homo sapiens
accatctataacaacatgttctgtgctggcttccatgaaggaggtagagattcatgtcaaggagatagtgggggaccccatgttactgaagtggaagggamcagtttcttaactggaattattagctggggtgaagagtgtgcaatgaaaggcaaatatggaatatataccaaggtatcccggtatgtcaactggattaag

SEQ ID NO: 1752 - DNA, 201 bp, Homo sapiens
attgcccttctggaactggacgaacccttagtgctaaacagctacgttacacctatttgcattgctgacaaggaatacacgaacatcttcctcaaatttgkatctggctatgtaagtggctggggaagagtcttccacaaagggagatcagctttagttcttcagtaccttagagttccacttgttgaccgagccacatgt

SEQ ID NO: 1753 - DNA, 201 bp, Homo sapiens
ctataacaacatgttctgtgctggcttccatgaaggaggtagagattcatgtcaaggagatagtgggggaccccatgttactgaagtggaagggaccagtbtcttaactggaattattagctggggtgaagagtgtgcaatgaaaggcaaatatggaatatataccaaggtatcccggtatgtcaactggattaaggaaaa

SEQ ID NO: 1754 - DNA, 201 bp, Homo sapiens
cttctggaactggacgaacccttagtgctaaacagctacgttacacctatttgcattgctgacaaggaatacacgaacatcttcctcaaatttggatctgrctatgtaagtggctggggaagagtcttccacaaagggagatcagctttagttcttcagtaccttagagttccacttgttgaccgagccacatgtcttcga

SEQ ID NO: 1755 - DNA, 201 bp, Homo sapiens
aacaacatgttctgtgctggcttccatgaaggaggtagagattcatgtcaaggagatagtgggggaccccatgttactgaagtggaagggaccagtttctkaactggaattattagctggggtgaagagtgtgcaatgaaaggcaaatatggaatatataccaaggtatcccggtatgtcaactggattaaggaaaaaaca

SEQ ID NO: 1756 - DNA, 201 bp, Homo sapiens
acaacatgttctgtgctggcttccatgaaggaggtagagattcatgtcaaggagatagtgggggaccccatgttactgaagtggaagggaccagtttcttmactggaattattagctggggtgaagagtgtgcaatgaaaggcaaatatggaatatataccaaggtatcccggtatgtcaactggattaaggaaaaaacaa

SEQ ID NO: 1757 - DNA, 201 bp, Homo sapiens
tggaactggacgaacccttagtgctaaacagctacgttacacctatttgcattgctgacaaggaatacacgaacatcttcctcaaatttggatctggctadgtaagtggctggggaagagtcttccacaaagggagatcagctttagttcttcagtaccttagagttccacttgttgaccgagccacatgtcttcgatcta

SEQ ID NO: 1758 - DNA, 201 bp, Homo sapiens
gaactggacgaacccttagtgctaaacagctacgttacacctatttgcattgctgacaaggaatacacgaacatcttcctcaaatttggatctggctatgbaagtggctggggaagagtcttccacaaagggagatcagctttagttcttcagtaccttagagttccacttgttgaccgagccacatgtcttcgatctaca

SEQ ID NO: 1759 - DNA, 201 bp, Homo sapiens
ctggacgaacccttagtgctaaacagctacgttacacctatttgcattgctgacaaggaatacacgaacatcttcctcaaatttggatctggctatgtaavtggctggggaagagtcttccacaaagggagatcagctttagttcttcagtaccttagagttccacttgttgaccgagccacatgtcttcgatctacaaag

SEQ ID NO: 1760 - DNA, 201 bp, Homo sapiens
tggacgaacccttagtgctaaacagctacgttacacctatttgcattgctgacaaggaatacacgaacatcttcctcaaatttggatctggctatgtaagkggctggggaagagtcttccacaaagggagatcagctttagttcttcagtaccttagagttccacttgttgaccgagccacatgtcttcgatctacaaagt

SEQ ID NO: 1761 - DNA, 201 bp, Homo sapiens
ccgagccacatgtcttcgatctacaaagttcaccatctataacaacatgttctgtgctggcttccatgaaggaggtagagattcatgtcaaggagatagtkggggaccccatgttactgaagtggaagggaccagtttcttaactggaattattagctggggtgaagagtgtgcaatgaaaggcaaatatggaatatatac

SEQ ID NO: 1762 - DNA, 201 bp, Homo sapiens
aactacaatgcagctattaataagtacaaccatgacattgcccttctggaactggacgaacccttagtgctaaacagctacgttacacctatttgcattgytgacaaggaatacacgaacatcttcctcaaatttggatctggctatgtaagtggctggggaagagtcttccacaaagggagatcagctttagttcttcag

SEQ ID NO: 1763 - DNA, 201 bp, Homo sapiens
caacatgttctgtgctggcttccatgaaggaggtagagattcatgtcaaggagatagtgggggaccccatgttactgaagtggaagggaccagtttcttamctggaattattagctggggtgaagagtgtgcaatgaaaggcaaatatggaatatataccaaggtatcccggtatgtcaactggattaaggaaaaaacaaa

SEQ ID NO: 1764 - DNA, 201 bp, Homo sapiens
  misc_feature (1)...(201): n = A,T,C or G, or insertion/deletion polymorphism (see Tables 1-2)
aacatgttctgtgctggcttccatgaaggaggtagagattcatgtcaaggagatagtgggggaccccatgttactgaagtggaagggaccagtttcttaantggaattattagctggggtgaagagtgtgcaatgaaaggcaaatatggaatatataccaaggtatcccggtatgtcaactggattaaggaaaaaacaaag

SEQ ID NO: 1765 - DNA, 201 bp, Homo sapiens
tggtaaagttgatgcattctgtggaggctctatcgttaatgaaaaatggattgtaactgctgcccactgtgttgaaactggtgttaaaattacagttgtcrcaggtgaacataatattgaggagacagaacatacagagcaaaagcgaaatgtgattcgaattattcctcaccacaactacaatgcagctattaataagta

SEQ ID NO: 1766 - DNA, 201 bp, Homo sapiens
gctggcttccatgaaggaggtagagattcatgtcaaggagatagtgggggaccccatgttactgaagtggaagggaccagtttcttaactggaattattabctggggtgaagagtgtgcaatgaaaggcaaatatggaatatataccaaggtatcccggtatgtcaactggattaaggaaaaaacaaagctcacttaatga

SEQ ID NO: 1767 - DNA, 201 bp, Homo sapiens
aaagttgatgcattctgtggaggctctatcgttaatgaaaaatggattgtaactgctgcccactgtgttgaaactggtgttaaaattacagttgtcgcagbtgaacataatattgaggagacagaacatacagagcaaaagcgaaatgtgattcgaattattcctcaccacaactacaatgcagctattaataagtacaac

SEQ ID NO: 1768 - DNA, 201 bp, Homo sapiens
  misc_feature (1)...(201): n = A,T,C or G, or insertion/deletion polymorphism (see Tables 1-2)
tggcttccatgaaggaggtagagattcatgtcaaggagatagtgggggaccccatgttactgaagtggaagggaccagtttcttaactggaattattagcnggggtgaagagtgtgcaatgaaaggcaaatatggaatatataccaaggtatcccggtatgtcaactggattaaggaaaaaacaaagctcacttaatgaaa

SEQ ID NO: 1769 - DNA, 201 bp, Homo sapiens
ggacgaacccttagtgctaaacagctacgttacacctatttgcattgctgacaaggaatacacgaacatcttcctcaaatttggatctggctatgtaagtrgctggggaagagtcttccacaaagggagatcagctttagttcttcagtaccttagagttccacttgttgaccgagccacatgtcttcgatctacaaagtt

SEQ ID NO: 1770 - DNA, 201 bp, Homo sapiens
gcttccatgaaggaggtagagattcatgtcaaggagatagtgggggaccccatgttactgaagtggaagggaccagtttcttaactggaattattagctgdggtgaagagtgtgcaatgaaaggcaaatatggaatatataccaaggtatcccggtatgtcaactggattaaggaaaaaacaaagctcacttaatgaaaga

SEQ ID NO: 1771 - DNA, 201 bp, Homo sapiens
gatgcattctgtggaggctctatcgttaatgaaaaatggattgtaactgctgcccactgtgttgaaactggtgttaaaattacagttgtcgcaggtgaacrtaatattgaggagacagaacatacagagcaaaagcgaaatgtgattcgaattattcctcaccacaactacaatgcagctattaataagtacaaccatgac

SEQ ID NO: 1772 - DNA, 201 bp, Homo sapiens
gacgaacccttagtgctaaacagctacgttacacctatttgcattgctgacaaggaatacacgaacatcttcctcaaatttggatctggctatgtaagtgdctggggaagagtcttccacaaagggagatcagctttagttcttcagtaccttagagttccacttgttgaccgagccacatgtcttcgatctacaaagttc

SEQ ID NO: 1773 - DNA, 201 bp, Homo sapiens
tgcattctgtggaggctctatcgttaatgaaaaatggattgtaactgctgcccactgtgttgaaactggtgttaaaattacagttgtcgcaggtgaacatratattgaggagacagaacatacagagcaaaagcgaaatgtgattcgaattattcctcaccacaactacaatgcagctattaataagtacaaccatgacat

SEQ ID NO: 1774 - DNA, 201 bp, Homo sapiens
cttccatgaaggaggtagagattcatgtcaaggagatagtgggggaccccatgttactgaagtggaagggaccagtttcttaactggaattattagctggrgtgaagagtgtgcaatgaaaggcaaatatggaatatataccaaggtatcccggtatgtcaactggattaaggaaaaaacaaagctcacttaatgaaagat

SEQ ID NO: 1775 - DNA, 201 bp, Homo sapiens
cgaacccttagtgctaaacagctacgttacacctatttgcattgctgacaaggaatacacgaacatcttcctcaaatttggatctggctatgtaagtggchggggaagagtcttccacaaagggagatcagctttagttcttcagtaccttagagttccacttgttgaccgagccacatgtcttcgatctacaaagttcac

SEQ ID NO: 1776 - DNA, 201 bp, Homo sapiens
gaacccttagtgctaaacagctacgttacacctatttgcattgctgacaaggaatacacgaacatcttcctcaaatttggatctggctatgtaagtggctdgggaagagtcttccacaaagggagatcagctttagttcttcagtaccttagagttccacttgttgaccgagccacatgtcttcgatctacaaagttcacc

SEQ ID NO: 1777 - DNA, 201 bp, Homo sapiens
ttctgtggaggctctatcgttaatgaaaaatggattgtaactgctgcccactgtgttgaaactggtgttaaaattacagttgtcgcaggtgaacataatawtgaggagacagaacatacagagcaaaagcgaaatgtgattcgaattattcctcaccacaactacaatgcagctattaataagtacaaccatgacattgcc

SEQ ID NO: 1778 - DNA, 201 bp, Homo sapiens
  misc_feature (1)...(201): n = A,T,C or G, or insertion/deletion polymorphism (see Tables 1-2)
ttccatgaaggaggtagagattcatgtcaaggagatagtgggggaccccatgttactgaagtggaagggaccagtttcttaactggaattattagctgggntgaagagtgtgcaatgaaaggcaaatatggaatatataccaaggtatcccggtatgtcaactggattaaggaaaaaacaaagctcacttaatgaaagatg

SEQ ID NO: 1779 - DNA, 201 bp, Homo sapiens
  misc_feature (1)...(201): n = A,T,C or G, or insertion/deletion polymorphism (see Tables 1-2)
aacccttagtgctaaacagctacgttacacctatttgcattgctgacaaggaatacacgaacatcttcctcaaatttggatctggctatgtaagtggctgnggaagagtcttccacaaagggagatcagctttagttcttcagtaccttagagttccacttgttgaccgagccacatgtcttcgatctacaaagttcacca

SEQ ID NO: 1780 - DNA, 201 bp, Homo sapiens
acccttagtgctaaacagctacgttacacctatttgcattgctgacaaggaatacacgaacatcttcctcaaatttggatctggctatgtaagtggctggdgaagagtcttccacaaagggagatcagctttagttcttcagtaccttagagttccacttgttgaccgagccacatgtcttcgatctacaaagttcaccat

SEQ ID NO: 1781 - DNA, 201 bp, Homo sapiens
tattcctcaccacaactacaatgcagctattaataagtacaaccatgacattgcccttctggaactggacgaacccttagtgctaaacagctacgttacamctatttgcattgctgacaaggaatacacgaacatcttcctcaaatttggatctggctatgtaagtggctggggaagagtcttccacaaagggagatcagc

SEQ ID NO: 1782 - DNA, 201 bp, Homo sapiens
catgaaggaggtagagattcatgtcaaggagatagtgggggaccccatgttactgaagtggaagggaccagtttcttaactggaattattagctggggtgvagagtgtgcaatgaaaggcaaatatggaatatataccaaggtatcccggtatgtcaactggattaaggaaaaaacaaagctcacttaatgaaagatggat

SEQ ID NO: 1783 - DNA, 201 bp, Homo sapiens
tgaaggaggtagagattcatgtcaaggagatagtgggggaccccatgttactgaagtggaagggaccagtttcttaactggaattattagctggggtgaakagtgtgcaatgaaaggcaaatatggaatatataccaaggtatcccggtatgtcaactggattaaggaaaaaacaaagctcacttaatgaaagatggattt

SEQ ID NO: 1784 - DNA, 201 bp, Homo sapiens
cccttagtgctaaacagctacgttacacctatttgcattgctgacaaggaatacacgaacatcttcctcaaatttggatctggctatgtaagtggctgggdaagagtcttccacaaagggagatcagctttagttcttcagtaccttagagttccacttgttgaccgagccacatgtcttcgatctacaaagttcaccatc

SEQ ID NO: 1785 - DNA, 201 bp, Homo sapiens
gtgctaaacagctacgttacacctatttgcattgctgacaaggaatacacgaacatcttcctcaaatttggatctggctatgtaagtggctggggaagagdcttccacaaagggagatcagctttagttcttcagtaccttagagttccacttgttgaccgagccacatgtcttcgatctacaaagttcaccatctataac

SEQ ID NO: 1786 - DNA, 201 bp, Homo sapiens
cagctacgttacacctatttgcattgctgacaaggaatacacgaacatcttcctcaaatttggatctggctatgtaagtggctggggaagagtcttccacraagggagatcagctttagttcttcagtaccttagagttccacttgttgaccgagccacatgtcttcgatctacaaagttcaccatctataacaacatgtt

SEQ ID NO: 1787 - DNA, 201 bp, Homo sapiens
ctacgttacacctatttgcattgctgacaaggaatacacgaacatcttcctcaaatttggatctggctatgtaagtggctggggaagagtcttccacaaabggagatcagctttagttcttcagtaccttagagttccacttgttgaccgagccacatgtcttcgatctacaaagttcaccatctataacaacatgttctg

SEQ ID NO: 1788 - DNA, 201 bp, Homo sapiens
cttcactcgggttgttggtggagaagatgccaaaccaggtcaattcccttggcaggttgttttgaatggtaaagttgatgcattctgtggaggctctatckttaatgaaaaatggattgtaactgctgcccactgtgttgaaactggtgttaaaattacagttgtcgcaggtgaacataatattgaggagacagaacatac

SEQ ID NO: 1789 - DNA, 201 bp, Homo sapiens
ctaaacagctacgttacacctatttgcattgctgacaaggaatacacgaacatcttcctcaaatttggatctggctatgtaagtggctggggaagagtctyccacaaagggagatcagctttagttcttcagtaccttagagttccacttgttgaccgagccacatgtcttcgatctacaaagttcaccatctataacaac

SEQ ID NO: 1790 - DNA, 201 bp, Homo sapiens
atggattgtaactgctgcccactgtgttgaaactggtgttaaaattacagttgtcgcaggtgaacataatattgaggagacagaacatacagagcaaaagbgaaatgtgattcgaattattcctcaccacaactacaatgcagctattaataagtacaaccatgacattgcccttctggaactggacgaacccttagtgct

SEQ ID NO: 1791 - DNA, 201 bp, Homo sapiens
tggattgtaactgctgcccactgtgttgaaactggtgttaaaattacagttgtcgcaggtgaacataatattgaggagacagaacatacagagcaaaagcraaatgtgattcgaattattcctcaccacaactacaatgcagctattaataagtacaaccatgacattgcccttctggaactggacgaacccttagtgcta

SEQ ID NO: 1792 - DNA, 201 bp, Homo sapiens
attgctgacaaggaatacacgaacatcttcctcaaatttggatctggctatgtaagtggctggggaagagtcttccacaaagggagatcagctttagttcytcagtaccttagagttccacttgttgaccgagccacatgtcttcgatctacaaagttcaccatctataacaacatgttctgtgctggcttccatgaagga

SEQ ID NO: 1793 - DNA, 201 bp, Homo sapiens
tgtaactgctgcccactgtgttgaaactggtgttaaaattacagttgtcgcaggtgaacataatattgaggagacagaacatacagagcaaaagcgaaatrtgattcgaattattcctcaccacaactacaatgcagctattaataagtacaaccatgacattgcccttctggaactggacgaacccttagtgctaaacag

SEQ ID NO: 1794 - DNA, 201 bp, Homo sapiens
gacaaggaatacacgaacatcttcctcaaatttggatctggctatgtaagtggctggggaagagtcttccacaaagggagatcagctttagttcttcagtmccttagagttccacttgttgaccgagccacatgtcttcgatctacaaagttcaccatctataacaacatgttctgtgctggcttccatgaaggaggtaga

SEQ ID NO: 1795 - DNA, 201 bp, Homo sapiens
actgctgcccactgtgttgaaactggtgttaaaattacagttgtcgcaggtgaacataatattgaggagacagaacatacagagcaaaagcgaaatgtgawtcgaattattcctcaccacaactacaatgcagctattaataagtacaaccatgacattgcccttctggaactggacgaacccttagtgctaaacagctac

SEQ ID NO: 1796 - DNA, 201 bp, Homo sapiens
tgctgcccactgtgttgaaactggtgttaaaattacagttgtcgcaggtgaacataatattgaggagacagaacatacagagcaaaagcgaaatgtgattygaattattcctcaccacaactacaatgcagctattaataagtacaaccatgacattgcccttctggaactggacgaacccttagtgctaaacagctacgt

SEQ ID NO: 1797 - DNA, 201 bp, Homo sapiens
aggaggtagagattcatgtcaaggagatagtgggggaccccatgttactgaagtggaagggaccagtttcttaactggaattattagctggggtgaagagkgtgcaatgaaaggcaaatatggaatatataccaaggtatcccggtatgtcaactggattaaggaaaaaacaaagctcacttaatgaaagatggatttcca

SEQ ID NO: 1798 - DNA, 201 bp, Homo sapiens
caccatctgccttttaggatatctactcagtgctgaatgtacagtttttcttgatcatgaaaacgccaacaaaattctgaatcggccaaagaggtataatycaggtaaattggaagagtttgttcaagggaaccttgagagagaatgtatggaagaaaagtgtagttttgaagaagcacgagaagtttttgaaaacactga

SEQ ID NO: 1799 - DNA, 201 bp, Homo sapiens
ggaggtagagattcatgtcaaggagatagtgggggaccccatgttactgaagtggaagggaccagtttcttaactggaattattagctggggtgaagagtrtgcaatgaaaggcaaatatggaatatataccaaggtatcccggtatgtcaactggattaaggaaaaaacaaagctcacttaatgaaagatggatttccaa

SEQ ID NO: 1800 - DNA, 201 bp, Homo sapiens
aggtagagattcatgtcaaggagatagtgggggaccccatgttactgaagtggaagggaccagtttcttaactggaattattagctggggtgaagagtgtdcaatgaaaggcaaatatggaatatataccaaggtatcccggtatgtcaactggattaaggaaaaaacaaagctcacttaatgaaagatggatttccaagg

SEQ ID NO: 1801 - DNA, 201 bp, Homo sapiens
tacgttacacctatttgcattgctgacaaggaatacacgaacatcttcctcaaatttggatctggctatgtaagtggctggggaagagtcttccacaaagrgagatcagctttagttcttcagtaccttagagttccacttgttgaccgagccacatgtcttcgatctacaaagttcaccatctataacaacatgttctgt

SEQ ID NO: 1802 - DNA, 201 bp, Homo sapiens
ggtagagattcatgtcaaggagatagtgggggaccccatgttactgaagtggaagggaccagtttcttaactggaattattagctggggtgaagagtgtghaatgaaaggcaaatatggaatatataccaaggtatcccggtatgtcaactggattaaggaaaaaacaaagctcacttaatgaaagatggatttccaaggt

SEQ ID NO: 1803 - DNA, 201 bp, Homo sapiens
cctatttgcattgctgacaaggaatacacgaacatcttcctcaaatttggatctggctatgtaagtggctggggaagagtcttccacaaagggagatcaghtttagttcttcagtaccttagagttccacttgttgaccgagccacatgtcttcgatctacaaagttcaccatctataacaacatgttctgtgctggcttc

SEQ ID NO: 1804 - DNA, 201 bp, Homo sapiens
gtcaaggagatagtgggggaccccatgttactgaagtggaagggaccagtttcttaactggaattattagctggggtgaagagtgtgcaatgaaaggcaamtatggaatatataccaaggtatcccggtatgtcaactggattaaggaaaaaacaaagctcacttaatgaaagatggatttccaaggttaattcattggaa

SEQ ID NO: 1805 - DNA, 201 bp, Homo sapiens
tgctgacaaggaatacacgaacatcttcctcaaatttggatctggctatgtaagtggctggggaagagtcttccacaaagggagatcagctttagttcttbagtaccttagagttccacttgttgaccgagccacatgtcttcgatctacaaagttcaccatctataacaacatgttctgtgctggcttccatgaaggagg

SEQ ID NO: 1806 - DNA, 201 bp, Homo sapiens
gctgacaaggaatacacgaacatcttcctcaaatttggatctggctatgtaagtggctggggaagagtcttccacaaagggagatcagctttagttcttcmgtaccttagagttccacttgttgaccgagccacatgtcttcgatctacaaagttcaccatctataacaacatgttctgtgctggcttccatgaaggaggt

SEQ ID NO: 1807 - DNA, 201 bp, Homo sapiens
caaggagatagtgggggaccccatgttactgaagtggaagggaccagtttcttaactggaattattagctggggtgaagagtgtgcaatgaaaggcaaatrtggaatatataccaaggtatcccggtatgtcaactggattaaggaaaaaacaaagctcacttaatgaaagatggatttccaaggttaattcattggaatt

SEQ ID NO: 1808 - DNA, 201 bp, Homo sapiens
aggagatagtgggggaccccatgttactgaagtggaagggaccagtttcttaactggaattattagctggggtgaagagtgtgcaatgaaaggcaaatatrgaatatataccaaggtatcccggtatgtcaactggattaaggaaaaaacaaagctcacttaatgaaagatggatttccaaggttaattcattggaattga

SEQ ID NO: 1809 - DNA, 201 bp, Homo sapiens
acaaggaatacacgaacatcttcctcaaatttggatctggctatgtaagtggctggggaagagtcttccacaaagggagatcagctttagttcttcagtavcttagagttccacttgttgaccgagccacatgtcttcgatctacaaagttcaccatctataacaacatgttctgtgctggcttccatgaaggaggtagag

SEQ ID NO: 1810 - DNA, 201 bp, Homo sapiens
atacacgaacatcttcctcaaatttggatctggctatgtaagtggctggggaagagtcttccacaaagggagatcagctttagttcttcagtaccttagadttccacttgttgaccgagccacatgtcttcgatctacaaagttcaccatctataacaacatgttctgtgctggcttccatgaaggaggtagagattcatg

SEQ ID NO: 1811 - DNA, 201 bp, Homo sapiens
ggagatagtgggggaccccatgttactgaagtggaagggaccagtttcttaactggaattattagctggggtgaagagtgtgcaatgaaaggcaaatatgbaatatataccaaggtatcccggtatgtcaactggattaaggaaaaaacaaagctcacttaatgaaagatggatttccaaggttaattcattggaattgaa

SEQ ID NO: 1812 - DNA, 201 bp, Homo sapiens
aacatcttcctcaaatttggatctggctatgtaagtggctggggaagagtcttccacaaagggagatcagctttagttcttcagtaccttagagttccacytgttgaccgagccacatgtcttcgatctacaaagttcaccatctataacaacatgttctgtgctggcttccatgaaggaggtagagattcatgtcaagga

SEQ ID NO: 1813 - DNA, 201 bp, Homo sapiens
gatagtgggggaccccatgttactgaagtggaagggaccagtttcttaactggaattattagctggggtgaagagtgtgcaatgaaaggcaaatatggaayatataccaaggtatcccggtatgtcaactggattaaggaaaaaacaaagctcacttaatgaaagatggatttccaaggttaattcattggaattgaaaat

SEQ ID NO: 1814 - DNA, 201 bp, Homo sapiens
atcttcctcaaatttggatctggctatgtaagtggctggggaagagtcttccacaaagggagatcagctttagttcttcagtaccttagagttccacttghtgaccgagccacatgtcttcgatctacaaagttcaccatctataacaacatgttctgtgctggcttccatgaaggaggtagagattcatgtcaaggagat

SEQ ID NO: 1815 - DNA, 201 bp, Homo sapiens
cttcctcaaatttggatctggctatgtaagtggctggggaagagtcttccacaaagggagatcagctttagttcttcagtaccttagagttccacttgttkaccgagccacatgtcttcgatctacaaagttcaccatctataacaacatgttctgtgctggcttccatgaaggaggtagagattcatgtcaaggagatag

SEQ ID NO: 1816 - DNA, 201 bp, Homo sapiens
agttgtcgcaggtgaacataatattgaggagacagaacatacagagcaaaagcgaaatgtgattcgaattattcctcaccacaactacaatgcagctattwataagtacaaccatgacattgcccttctggaactggacgaacccttagtgctaaacagctacgttacacctatttgcattgctgacaaggaatacacgaa

SEQ ID NO: 1817 - DNA, 201 bp, Homo sapiens
ggcctcatcaccatctgccttttaggatatctactcagtgctgaatgtacagtttttcttgatcatgaaaacgccaacaaaattctgaatcggccaaagasgtataattcaggtaaattggaagagtttgttcaagggaaccttgagagagaatgtatggaagaaaagtgtagttttgaagaagcacgagaagtttttgaa

SEQ ID NO: 1818 - DNA, 201 bp, Homo sapiens
ggagaagatgccaaaccaggtcaattcccttggcaggttgttttgaatggtaaagttgatgcattctgtggaggctctatcgttaatgaaaaatggattgwaactgctgcccactgtgttgaaactggtgttaaaattacagttgtcgcaggtgaacataatattgaggagacagaacatacagagcaaaagcgaaatgtg

SEQ ID NO: 1819 - DNA, 201 bp, Homo sapiens
agtcttccacaaagggagatcagctttagttcttcagtaccttagagttccacttgttgaccgagccacatgtcttcgatctacaaagttcaccatctatracaacatgttctgtgctggcttccatgaaggaggtagagattcatgtcaaggagatagtgggggaccccatgttactgaagtggaagggaccagtttctt

SEQ ID NO: 1820 - DNA, 201 bp, Homo sapiens
tggtgttaaaattacagttgtcgcaggtgaacataatattgaggagacagaacatacagagcaaaagcgaaatgtgattcgaattattcctcaccacaacwacaatgcagctattaataagtacaaccatgacattgcccttctggaactggacgaacccttagtgctaaacagctacgttacacctatttgcattgctga

SEQ ID NO: 1821 - DNA, 201 bp, Homo sapiens
catgttctgtgctggcttccatgaaggaggtagagattcatgtcaaggagatagtgggggaccccatgttactgaagtggaagggaccagtttcttaactrgaattattagctggggtgaagagtgtgcaatgaaaggcaaatatggaatatataccaaggtatcccggtatgtcaactggattaaggaaaaaacaaagct

SEQ ID NO: 1822 - DNA, 201 bp, Homo sapiens
atgttctgtgctggcttccatgaaggaggtagagattcatgtcaaggagatagtgggggaccccatgttactgaagtggaagggaccagtttcttaactgsaattattagctggggtgaagagtgtgcaatgaaaggcaaatatggaatatataccaaggtatcccggtatgtcaactggattaaggaaaaaacaaagctc

SEQ ID NO: 1823 - DNA, 201 bp, Homo sapiens
agtgggggaccccatgttactgaagtggaagggaccagtttcttaactggaattattagctggggtgaagagtgtgcaatgaaaggcaaatatggaatatmtaccaaggtatcccggtatgtcaactggattaaggaaaaaacaaagctcacttaatgaaagatggatttccaaggttaattcattggaattgaaaattaa

SEQ ID NO: 1824 - DNA, 201 bp, Homo sapiens
catgttactgaagtggaagggaccagtttcttaactggaattattagctggggtgaagagtgtgcaatgaaaggcaaatatggaatatataccaaggtatyccggtatgtcaactggattaaggaaaaaacaaagctcacttaatgaaagatggatttccaaggttaattcattggaattgaaaattaacagggcctctca

SEQ ID NO: 1825 - DNA, 166 bp, Homo sapiens
cttgtactttggtacaactaatcgaccttaccactttcacaatctgctagcaaaggttatgcagcrcgtgaacatgatcatggcagaatcaccaggcctcatcaccatctgccttttaggatatctactcagtgctgaatgtacagtttttcttgatcatgaaaac

SEQ ID NO: 1826 - DNA, 201 bp, Homo sapiens
tgttactgaagtggaagggaccagtttcttaactggaattattagctggggtgaagagtgtgcaatgaaaggcaaatatggaatatataccaaggtatccyggtatgtcaactggattaaggaaaaaacaaagctcacttaatgaaagatggatttccaaggttaattcattggaattgaaaattaacagggcctctcact

SEQ ID NO: 1827 - DNA, 177 bp, Homo sapiens
cttgtactttggtacaactaatcgaccttaccactttcacaatctgctagcaaaggttatgcagcgcgtgaacatgwtcatggcagaatcaccaggcctcatcaccatctgccttttaggatatctactcagtgctgaatgtacagtttttcttgatcatgaaaacgccaacaaaat

SEQ ID NO: 1828 - DNA, 201 bp, Homo sapiens
gttactgaagtggaagggaccagtttcttaactggaattattagctggggtgaagagtgtgcaatgaaaggcaaatatggaatatataccaaggtatcccrgtatgtcaactggattaaggaaaaaacaaagctcacttaatgaaagatggatttccaaggttaattcattggaattgaaaattaacagggcctctcacta

SEQ ID NO: 1829 - DNA, 201 bp, Homo sapiens
cctcaaatttggatctggctatgtaagtggctggggaagagtcttccacaaagggagatcagctttagttcttcagtaccttagagttccacttgttgacbgagccacatgtcttcgatctacaaagttcaccatctataacaacatgttctgtgctggcttccatgaaggaggtagagattcatgtcaaggagatagtgg

SEQ ID NO: 1830 - DNA, 201 bp, Homo sapiens
ctcaaatttggatctggctatgtaagtggctggggaagagtcttccacaaagggagatcagctttagttcttcagtaccttagagttccacttgttgaccdagccacatgtcttcgatctacaaagttcaccatctataacaacatgttctgtgctggcttccatgaaggaggtagagattcatgtcaaggagatagtggg

SEQ ID NO: 1831 - DNA, 201 bp, Homo sapiens
tactgaagtggaagggaccagtttcttaactggaattattagctggggtgaagagtgtgcaatgaaaggcaaatatggaatatataccaaggtatcccggyatgtcaactggattaaggaaaaaacaaagctcacttaatgaaagatggatttccaaggttaattcattggaattgaaaattaacagggcctctcactaac

SEQ ID NO: 1832 - DNA, 201 bp, Homo sapiens
caaatttggatctggctatgtaagtggctggggaagagtcttccacaaagggagatcagctttagttcttcagtaccttagagttccacttgttgaccgarccacatgtcttcgatctacaaagttcaccatctataacaacatgttctgtgctggcttccatgaaggaggtagagattcatgtcaaggagatagtggggg

SEQ ID NO: 1833 - DNA, 201 bp, Homo sapiens
actgaagtggaagggaccagtttcttaactggaattattagctggggtgaagagtgtgcaatgaaaggcaaatatggaatatataccaaggtatcccggtrtgtcaactggattaaggaaaaaacaaagctcacttaatgaaagatggatttccaaggttaattcattggaattgaaaattaacagggcctctcactaact

SEQ ID NO: 1834 - DNA, 201 bp, Homo sapiens
aaatttggatctggctatgtaagtggctggggaagagtcttccacaaagggagatcagctttagttcttcagtaccttagagttccacttgttgaccgagmcacatgtcttcgatctacaaagttcaccatctataacaacatgttctgtgctggcttccatgaaggaggtagagattcatgtcaaggagatagtggggga

SEQ ID NO: 1835 - DNA, 201 bp, Homo sapiens
tggatctggctatgtaagtggctggggaagagtcttccacaaagggagatcagctttagttcttcagtaccttagagttccacttgttgaccgagccacaygtcttcgatctacaaagttcaccatctataacaacatgttctgtgctggcttccatgaaggaggtagagattcatgtcaaggagatagtgggggacccca

SEQ ID NO: 1836 - DNA, 201 bp, Homo sapiens
ggaagggaccagtttcttaactggaattattagctggggtgaagagtgtgcaatgaaaggcaaatatggaatatataccaaggtatcccggtatgtcaachggattaaggaaaaaacaaagctcacttaatgaaagatggatttccaaggttaattcattggaattgaaaattaacagggcctctcactaactaatcactt

SEQ ID NO: 1837 - DNA, 201 bp, Homo sapiens
ggatctggctatgtaagtggctggggaagagtcttccacaaagggagatcagctttagttcttcagtaccttagagttccacttgttgaccgagccacatrtcttcgatctacaaagttcaccatctataacaacatgttctgtgctggcttccatgaaggaggtagagattcatgtcaaggagatagtgggggaccccat

SEQ ID NO: 1838 - DNA, 201 bp, Homo sapiens
gaagggaccagtttcttaactggaattattagctggggtgaagagtgtgcaatgaaaggcaaatatggaatatataccaaggtatcccggtatgtcaactrgattaaggaaaaaacaaagctcacttaatgaaagatggatttccaaggttaattcattggaattgaaaattaacagggcctctcactaactaatcacttt

SEQ ID NO: 1839 - DNA, 201 bp, Homo sapiens
tttaggatatctactcagtgctgaatgtacagtttttcttgatcatgaaaacgccaacaaaattctgaatcggccaaagaggtataattcaggtaaattgraagagtttgttcaagggaaccttgagagagaatgtatggaagaaaagtgtagttttgaagaagcacgagaagtttttgaaaacactgaaagaacaactga

SEQ ID NO: 1840 - DNA, 201 bp, Homo sapiens
gatctggctatgtaagtggctggggaagagtcttccacaaagggagatcagctttagttcttcagtaccttagagttccacttgttgaccgagccacatgwcttcgatctacaaagttcaccatctataacaacatgttctgtgctggcttccatgaaggaggtagagattcatgtcaaggagatagtgggggaccccatg

SEQ ID NO: 1841 - DNA, 201 bp, Homo sapiens
atctggctatgtaagtggctggggaagagtcttccacaaagggagatcagctttagttcttcagtaccttagagttccacttgttgaccgagccacatgthttcgatctacaaagttcaccatctataacaacatgttctgtgctggcttccatgaaggaggtagagattcatgtcaaggagatagtgggggaccccatgt

SEQ ID NO: 1842 - DNA, 201 bp, Homo sapiens
tggctatgtaagtggctggggaagagtcttccacaaagggagatcagctttagttcttcagtaccttagagttccacttgttgaccgagccacatgtcttygatctacaaagttcaccatctataacaacatgttctgtgctggcttccatgaaggaggtagagattcatgtcaaggagatagtgggggaccccatgttac

SEQ ID NO: 1843 - DNA, 201 bp, Homo sapiens
ggctatgtaagtggctggggaagagtcttccacaaagggagatcagctttagttcttcagtaccttagagttccacttgttgaccgagccacatgtcttcsatctacaaagttcaccatctataacaacatgttctgtgctggcttccatgaaggaggtagagattcatgtcaaggagatagtgggggaccccatgttact

SEQ ID NO: 1844 - DNA, 201 bp, Homo sapiens
gaaggaggtagagattcatgtcaaggagatagtgggggaccccatgttactgaagtggaagggaccagtttcttaactggaattattagctggggtgaagrgtgtgcaatgaaaggcaaatatggaatatataccaaggtatcccggtatgtcaactggattaaggaaaaaacaaagctcacttaatgaaagatggatttc

SEQ ID NO: 1845 - DNA, 201 bp, Homo sapiens
tctggctatgtaagtggctggggaagagtcttccacaaagggagatcagctttagttcttcagtaccttagagttccacttgttgaccgagccacatgtcytcgatctacaaagttcaccatctataacaacatgttctgtgctggcttccatgaaggaggtagagattcatgtcaaggagatagtgggggaccccatgtt

SEQ ID NO: 1846 - DNA, 201 bp, Homo sapiens
ctatgtaagtggctggggaagagtcttccacaaagggagatcagctttagttcttcagtaccttagagttccacttgttgaccgagccacatgtcttcgayctacaaagttcaccatctataacaacatgttctgtgctggcttccatgaaggaggtagagattcatgtcaaggagatagtgggggaccccatgttactga

SEQ ID NO: 1847 - DNA, 201 bp, Homo sapiens
tttcttaactggaattattagctggggtgaagagtgtgcaatgaaaggcaaatatggaatatataccaaggtatcccggtatgtcaactggattaaggaawaaacaaagctcacttaatgaaagatggatttccaaggttaattcattggaattgaaaattaacagggcctctcactaactaatcactttcccatcttttg

SEQ ID NO: 1848 - DNA, 201 bp, Homo sapiens
gtaagtggctggggaagagtcttccacaaagggagatcagctttagttcttcagtaccttagagttccacttgttgaccgagccacatgtcttcgatctabaaagttcaccatctataacaacatgttctgtgctggcttccatgaaggaggtagagattcatgtcaaggagatagtgggggaccccatgttactgaagtg

SEQ ID NO: 1849 - DNA, 201 bp, Homo sapiens
gggaagagtcttccacaaagggagatcagctttagttcttcagtaccttagagttccacttgttgaccgagccacatgtcttcgatctacaaagttcaccwtctataacaacatgttctgtgctggcttccatgaaggaggtagagattcatgtcaaggagatagtgggggaccccatgttactgaagtggaagggaccag

SEQ ID NO: 1850 - DNA, 201 bp, Homo sapiens
tcaaggagatagtgggggaccccatgttactgaagtggaagggaccagtttcttaactggaattattagctggggtgaagagtgtgcaatgaaaggcaaayatggaatatataccaaggtatcccggtatgtcaactggattaaggaaaaaacaaagctcacttaatgaaagatggatttccaaggttaattcattggaat

SEQ ID NO: 1851 - DNA, 201 bp, Homo sapiens
gagtcttccacaaagggagatcagctttagttcttcagtaccttagagttccacttgttgaccgagccacatgtcttcgatctacaaagttcaccatctawaacaacatgttctgtgctggcttccatgaaggaggtagagattcatgtcaaggagatagtgggggaccccatgttactgaagtggaagggaccagtttct

SEQ ID NO: 1852 - DNA, 201 bp, Homo sapiens
ttccacaaagggagatcagctttagttcttcagtaccttagagttccacttgttgaccgagccacatgtcttcgatctacaaagttcaccatctataacawcatgttctgtgctggcttccatgaaggaggtagagattcatgtcaaggagatagtgggggaccccatgttactgaagtggaagggaccagtttcttaact

SEQ ID NO: 1853 - DNA, 201 bp, Homo sapiens
ccacaaagggagatcagctttagttcttcagtaccttagagttccacttgttgaccgagccacatgtcttcgatctacaaagttcaccatctataacaacrtgttctgtgctggcttccatgaaggaggtagagattcatgtcaaggagatagtgggggaccccatgttactgaagtggaagggaccagtttcttaactgg

SEQ ID NO: 1854 - DNA, 201 bp, Homo sapiens
cacaaagggagatcagctttagttcttcagtaccttagagttccacttgttgaccgagccacatgtcttcgatctacaaagttcaccatctataacaacawgttctgtgctggcttccatgaaggaggtagagattcatgtcaaggagatagtgggggaccccatgttactgaagtggaagggaccagtttcttaactgga

SEQ ID NO: 1855 - DNA, 201 bp, Homo sapiens
acaaagggagatcagctttagttcttcagtaccttagagttccacttgttgaccgagccacatgtcttcgatctacaaagttcaccatctataacaacatrttctgtgctggcttccatgaaggaggtagagattcatgtcaaggagatagtgggggaccccatgttactgaagtggaagggaccagtttcttaactggaa

SEQ ID NO: 1856 - DNA, 201 bp, Homo sapiens
caaagggagatcagctttagttcttcagtaccttagagttccacttgttgaccgagccacatgtcttcgatctacaaagttcaccatctataacaacatgytctgtgctggcttccatgaaggaggtagagattcatgtcaaggagatagtgggggaccccatgttactgaagtggaagggaccagtttcttaactggaat

SEQ ID NO: 1857 - DNA, 201 bp, Homo sapiens
gtggctggggaagagtcttccacaaagggagatcagctttagttcttcagtaccttagagttccacttgttgaccgagccacatgtcttcgatctacaaasttcaccatctataacaacatgttctgtgctggcttccatgaaggaggtagagattcatgtcaaggagatagtgggggaccccatgttactgaagtggaag

SEQ ID NO: 1858 - DNA, 201 bp, Homo sapiens
agatagtgggggaccccatgttactgaagtggaagggaccagtttcttaactggaattattagctggggtgaagagtgtgcaatgaaaggcaaatatggamtatataccaaggtatcccggtatgtcaactggattaaggaaaaaacaaagctcacttaatgaaagatggatttccaaggttaattcattggaattgaaaa

SEQ ID NO: 1859 - DNA, 201 bp, Homo sapiens
ggaagagtcttccacaaagggagatcagctttagttcttcagtaccttagagttccacttgttgaccgagccacatgtcttcgatctacaaagttcaccabctataacaacatgttctgtgctggcttccatgaaggaggtagagattcatgtcaaggagatagtgggggaccccatgttactgaagtggaagggaccagt

SEQ ID NO: 1860 - DNA, 201 bp, Homo sapiens
gggggaccccatgttactgaagtggaagggaccagtttcttaactggaattattagctggggtgaagagtgtgcaatgaaaggcaaatatggaatatatahcaaggtatcccggtatgtcaactggattaaggaaaaaacaaagctcacttaatgaaagatggatttccaaggttaattcattggaattgaaaattaacag

SEQ ID NO: 1861 - DNA, 201 bp, Homo sapiens
tgaagtggaagggaccagtttcttaactggaattattagctggggtgaagagtgtgcaatgaaaggcaaatatggaatatataccaaggtatcccggtatktcaactggattaaggaaaaaacaaagctcacttaatgaaagatggatttccaaggttaattcattggaattgaaaattaacagggcctctcactaactaa

SEQ ID NO: 1862 - DNA, 201 bp, Homo sapiens
aagggaccagtttcttaactggaattattagctggggtgaagagtgtgcaatgaaaggcaaatatggaatatataccaaggtatcccggtatgtcaactgsattaaggaaaaaacaaagctcacttaatgaaagatggatttccaaggttaattcattggaattgaaaattaacagggcctctcactaactaatcactttc

SEQ ID NO: 1863 - DNA, 201 bp, Homo sapiens
aaagggagatcagctttagttcttcagtaccttagagttccacttgttgaccgagccacatgtcttcgatctacaaagttcaccatctataacaacatgtwctgtgctggcttccatgaaggaggtagagattcatgtcaaggagatagtgggggaccccatgttactgaagtggaagggaccagtttcttaactggaatt

SEQ ID NO: 1864 - DNA, 201 bp, Homo sapiens
acaactgaattttggaagcagtatgttgatggagatcagtgtgagtccaatccatgtttaaatggcggcagttgcaaggatgacattaattcctatgaatvttggtgtccctttggatttgaaggaaagaactgtgaattagatgtaacatgtaacattaagaatggcagatgcgagcagttttgtaaaaatagtgctgat

SEQ ID NO: 1865 - DNA, 201 bp, Homo sapiens
acactgaaagaacaactgaattttggaagcagtatgttgatggagatcagtgtgagtccaatccatgtttaaatggcggcagttgcaaggatgacattaawtcctatgaatgttggtgtccctttggatttgaaggaaagaactgtgaattagatgtaacatgtaacattaagaatggcagatgcgagcagttttgtaaaa

SEQ ID NO: 1866 - DNA, 201 bp, Homo sapiens
gggaccagtttcttaactggaattattagctggggtgaagagtgtgcaatgaaaggcaaatatggaatatataccaaggtatcccggtatgtcaactggaytaaggaaaaaacaaagctcacttaatgaaagatggatttccaaggttaattcattggaattgaaaattaacagggcctctcactaactaatcactttccc

SEQ ID NO: 1867 - DNA, 201 bp, Homo sapiens
ttaactggaattattagctggggtgaagagtgtgcaatgaaaggcaaatatggaatatataccaaggtatcccggtatgtcaactggattaaggaaaaaamaaagctcacttaatgaaagatggatttccaaggttaattcattggaattgaaaattaacagggcctctcactaactaatcactttcccatcttttgttag

SEQ ID NO: 1868 - DNA, 201 bp, Homo sapiens
tcttcagtaccttagagttccacttgttgaccgagccacatgtcttcgatctacaaagttcaccatctataacaacatgttctgtgctggcttccatgaargaggtagagattcatgtcaaggagatagtgggggaccccatgttactgaagtggaagggaccagtttcttaactggaattattagctggggtgaagagtg

SEQ ID NO: 1869 - DNA, 201 bp, Homo sapiens
aaaccaggtcaattcccttggcaggttgttttgaatggtaaagttgatgcattctgtggaggctctatcgttaatgaaaaatggattgtaactgctgcccrctgtgttgaaactggtgttaaaattacagttgtcgcaggtgaacataatattgaggagacagaacatacagagcaaaagcgaaatgtgattcgaattatt

SEQ ID NO: 1870 - DNA, 201 bp, Homo sapiens
accaggcctcatcaccatctgccttttaggatatctactcagtgctgaatgtacagtttttcttgatcatgaaaacgccaacaaaattctgaatcggccawagaggtataattcaggtaaattggaagagtttgttcaagggaaccttgagagagaatgtatggaagaaaagtgtagttttgaagaagcacgagaagtttt

SEQ ID NO: 1871 - DNA, 201 bp, Homo sapiens
taccttagagttccacttgttgaccgagccacatgtcttcgatctacaaagttcaccatctataacaacatgttctgtgctggcttccatgaaggaggtasagattcatgtcaaggagatagtgggggaccccatgttactgaagtggaagggaccagtttcttaactggaattattagctggggtgaagagtgtgcaatg

SEQ ID NO: 1872 - DNA, 201 bp, Homo sapiens
accatctgccttttaggatatctactcagtgctgaatgtacagtttttcttgatcatgaaaacgccaacaaaattctgaatcggccaaagaggtataattsaggtaaattggaagagtttgttcaagggaaccttgagagagaatgtatggaagaaaagtgtagttttgaagaagcacgagaagtttttgaaaacactgaa

SEQ ID NO: 1873 - DNA, 201 bp, Homo sapiens
ggagatcagctttagttcttcagtaccttagagttccacttgttgaccgagccacatgtcttcgatctacaaagttcaccatctataacaacatgttctgwgctggcttccatgaaggaggtagagattcatgtcaaggagatagtgggggaccccatgttactgaagtggaagggaccagtttcttaactggaattatta

SEQ ID NO: 1874 - DNA, 201 bp, Homo sapiens
gatatctactcagtgctgaatgtacagtttttcttgatcatgaaaacgccaacaaaattctgaatcggccaaagaggtataattcaggtaaattggaagastttgttcaagggaaccttgagagagaatgtatggaagaaaagtgtagttttgaagaagcacgagaagtttttgaaaacactgaaagaacaactgaatttt

SEQ ID NO: 1875 - DNA, 201 bp, Homo sapiens
gtttttcttgatcatgaaaacgccaacaaaattctgaatcggccaaagaggtataattcaggtaaattggaagagtttgttcaagggaaccttgagagagmatgtatggaagaaaagtgtagttttgaagaagcacgagaagtttttgaaaacactgaaagaacaactgaattttggaagcagtatgttgatggagatcag

SEQ ID NO: 1876 - DNA, 201 bp, Homo sapiens
gatcatgaaaacgccaacaaaattctgaatcggccaaagaggtataattcaggtaaattggaagagtttgttcaagggaaccttgagagagaatgtatggwagaaaagtgtagttttgaagaagcacgagaagtttttgaaaacactgaaagaacaactgaattttggaagcagtatgttgatggagatcagtgtgagtcc

SEQ ID NO: 1877 - DNA, 201 bp, Homo sapiens
tcatgaaaacgccaacaaaattctgaatcggccaaagaggtataattcaggtaaattggaagagtttgttcaagggaaccttgagagagaatgtatggaaraaaagtgtagttttgaagaagcacgagaagtttttgaaaacactgaaagaacaactgaattttggaagcagtatgttgatggagatcagtgtgagtccaa

SEQ ID NO: 1878 - DNA, 201 bp, Homo sapiens
aaacgccaacaaaattctgaatcggccaaagaggtataattcaggtaaattggaagagtttgttcaagggaaccttgagagagaatgtatggaagaaaagygtagttttgaagaagcacgagaagtttttgaaaacactgaaagaacaactgaattttggaagcagtatgttgatggagatcagtgtgagtccaatccatg

SEQ ID NO: 1879 - DNA, 201 bp, Homo sapiens
aacgccaacaaaattctgaatcggccaaagaggtataattcaggtaaattggaagagtttgttcaagggaaccttgagagagaatgtatggaagaaaagtrtagttttgaagaagcacgagaagtttttgaaaacactgaaagaacaactgaattttggaagcagtatgttgatggagatcagtgtgagtccaatccatgt

SEQ ID NO: 1880 - DNA, 201 bp, Homo sapiens
atgcgagcagttttgtaaaaatagtgctgataacaaggtggtttgctcctgtactgagggatatcgactttcacaaacttctaagctcacccgtgctgagrctgtttttcctgatgtggactatgtaaattctactgaagctgaaaccattttggataacatcactcaaagcacccaatcatttaatgacttcactcgggt

SEQ ID NO: 1881 - DNA, 201 bp, Homo sapiens
tgtttttcctgatgtggactatgtaaattctactgaagctgaaaccattttggataacatcactcaaagcacccaatcatttaatgacttcactcgggttbttggtggagaagatgccaaaccaggtcaattcccttggcaggttgttttgaatggtaaagttgatgcattctgtggaggctctatcgttaatgaaaaatg

SEQ ID NO: 1882 - DNA, 201 bp, Homo sapiens
gtttttcctgatgtggactatgtaaattctactgaagctgaaaccattttggataacatcactcaaagcacccaatcatttaatgacttcactcgggttgbtggtggagaagatgccaaaccaggtcaattcccttggcaggttgttttgaatggtaaagttgatgcattctgtggaggctctatcgttaatgaaaaatgg

SEQ ID NO: 1883 - DNA, 201 bp, Homo sapiens
cattaattcctatgaatgttggtgtccctttggatttgaaggaaagaactgtgaattagatgtaacatgtaacattaagaatggcagatgcgagcagtttygtaaaaatagtgctgataacaaggtggtttgctcctgtactgagggatatcgactttcacaaacttctaagctcacccgtgctgagactgtttttcctga

SEQ ID NO: 1884 - DNA, 201 bp, Homo sapiens
tgctggcttccatgaaggaggtagagattcatgtcaaggagatagtgggggaccccatgttactgaagtggaagggaccagtttcttaactggaattattwgctggggtgaagagtgtgcaatgaaaggcaaatatggaatatataccaaggtatcccggtatgtcaactggattaaggaaaaaacaaagctcacttaatg

SEQ ID NO: 1885 - DNA, 201 bp, Homo sapiens
atgtgattcgaattattcctcaccacaactacaatgcagctattaataagtacaaccatgacattgcccttctggaactggacgaacccttagtgctaaasagctacgttacacctatttgcattgctgacaaggaatacacgaacatcttcctcaaatttggatctggctatgtaagtggctggggaagagtcttccaca

SEQ ID NO: 1886 - DNA, 201 bp, Homo sapiens
agtttttgaaaacactgaaagaacaactgaattttggaagcagtatgttgatggagatcagtgtgagtccaatccatgtttaaatggcggcagttgcaagdatgacattaattcctatgaatgttggtgtccctttggatttgaaggaaagaactgtgaattagatgtaacatgtaacattaagaatggcagatgcgagca

SEQ ID NO: 1887 - DNA, 201 bp, Homo sapiens
gtttttgaaaacactgaaagaacaactgaattttggaagcagtatgttgatggagatcagtgtgagtccaatccatgtttaaatggcggcagttgcaaggrtgacattaattcctatgaatgttggtgtccctttggatttgaaggaaagaactgtgaattagatgtaacatgtaacattaagaatggcagatgcgagcag

SEQ ID NO: 1888 - DNA, 201 bp, Homo sapiens
agaatcaccaggcctcatcaccatctgccttttaggatatctactcagtgctgaatgtacagtttttcttgatcatgaaaacgccaacaaaattctgaatyggccaaagaggtataattcaggtaaattggaagagtttgttcaagggaaccttgagagagaatgtatggaagaaaagtgtagttttgaagaagcacgaga

SEQ ID NO: 1889 - DNA, 201 bp, Homo sapiens
attaattcctatgaatgttggtgtccctttggatttgaaggaaagaactgtgaattagatgtaacatgtaacattaagaatggcagatgcgagcagttttrtaaaaatagtgctgataacaaggtggtttgctcctgtactgagggatatcgactttcacaaacttctaagctcacccgtgctgagactgtttttcctgat

SEQ ID NO: 1890 - DNA, 201 bp, Homo sapiens
  misc_feature (1)...(201): n = A,T,C or G, or insertion/deletion polymorphism (see Tables 1-2)
ggatttgaaggaaagaactgtgaattagatgtaacatgtaacattaagaatggcagatgcgagcagttttgtaaaaatagtgctgataacaaggtggtttnctcctgtactgagggatatcgactttcacaaacttctaagctcacccgtgctgagactgtttttcctgatgtggactatgtaaattctactgaagctgaa

SEQ ID NO: 1891 - DNA, 201 bp, Homo sapiens
atttgaaggaaagaactgtgaattagatgtaacatgtaacattaagaatggcagatgcgagcagttttgtaaaaatagtgctgataacaaggtggtttgcycctgtactgagggatatcgactttcacaaacttctaagctcacccgtgctgagactgtttttcctgatgtggactatgtaaattctactgaagctgaaac

SEQ ID NO: 1892 - DNA, 201 bp, Homo sapiens
gaatcaccaggcctcatcaccatctgccttttaggatatctactcagtgctgaatgtacagtttttcttgatcatgaaaacgccaacaaaattctgaatcdgccaaagaggtataattcaggtaaattggaagagtttgttcaagggaaccttgagagagaatgtatggaagaaaagtgtagttttgaagaagcacgagaa

SEQ ID NO: 1893 - DNA, 201 bp, Homo sapiens
caggcctcatcaccatctgccttttaggatatctactcagtgctgaatgtacagtttttcttgatcatgaaaacgccaacaaaattctgaatcggccaaakaggtataattcaggtaaattggaagagtttgttcaagggaaccttgagagagaatgtatggaagaaaagtgtagttttgaagaagcacgagaagtttttg

SEQ ID NO: 1894 - DNA, 201 bp, Homo sapiens
gcctcatcaccatctgccttttaggatatctactcagtgctgaatgtacagtttttcttgatcatgaaaacgccaacaaaattctgaatcggccaaagagstataattcaggtaaattggaagagtttgttcaagggaaccttgagagagaatgtatggaagaaaagtgtagttttgaagaagcacgagaagtttttgaaa

SEQ ID NO: 1895 - DNA, 201 bp, Homo sapiens
catcaccatctgccttttaggatatctactcagtgctgaatgtacagtttttcttgatcatgaaaacgccaacaaaattctgaatcggccaaagaggtatdattcaggtaaattggaagagtttgttcaagggaaccttgagagagaatgtatggaagaaaagtgtagttttgaagaagcacgagaagtttttgaaaacac

SEQ ID NO: 1896 - DNA, 201 bp, Homo sapiens
atcaccatctgccttttaggatatctactcagtgctgaatgtacagtttttcttgatcatgaaaacgccaacaaaattctgaatcggccaaagaggtatawttcaggtaaattggaagagtttgttcaagggaaccttgagagagaatgtatggaagaaaagtgtagttttgaagaagcacgagaagtttttgaaaacact

SEQ ID NO: 1897 - DNA, 201 bp, Homo sapiens
catctgccttttaggatatctactcagtgctgaatgtacagtttttcttgatcatgaaaacgccaacaaaattctgaatcggccaaagaggtataattcargtaaattggaagagtttgttcaagggaaccttgagagagaatgtatggaagaaaagtgtagttttgaagaagcacgagaagtttttgaaaacactgaaag

SEQ ID NO: 1898 - DNA, 201 bp, Homo sapiens
atctgccttttaggatatctactcagtgctgaatgtacagtttttcttgatcatgaaaacgccaacaaaattctgaatcggccaaagaggtataattcagrtaaattggaagagtttgttcaagggaaccttgagagagaatgtatggaagaaaagtgtagttttgaagaagcacgagaagtttttgaaaacactgaaaga

SEQ ID NO: 1899 - DNA, 201 bp, Homo sapiens
ctgccttttaggatatctactcagtgctgaatgtacagtttttcttgatcatgaaaacgccaacaaaattctgaatcggccaaagaggtataattcaggtraattggaagagtttgttcaagggaaccttgagagagaatgtatggaagaaaagtgtagttttgaagaagcacgagaagtttttgaaaacactgaaagaac

SEQ ID NO: 1900 - DNA, 201 bp, Homo sapiens
caaagttcaccatctataacaacatgttctgtgctggcttccatgaaggaggtagagattcatgtcaaggagatagtgggggaccccatgttactgaagtkgaagggaccagtttcttaactggaattattagctggggtgaagagtgtgcaatgaaaggcaaatatggaatatataccaaggtatcccggtatgtcaact

SEQ ID NO: 1901 - DNA, 201 bp, Homo sapiens
tgaaggaaagaactgtgaattagatgtaacatgtaacattaagaatggcagatgcgagcagttttgtaaaaatagtgctgataacaaggtggtttgctccygtactgagggatatcgactttcacaaacttctaagctcacccgtgctgagactgtttttcctgatgtggactatgtaaattctactgaagctgaaaccat

SEQ ID NO: 1902 - DNA, 201 bp, Homo sapiens
gaaggaaagaactgtgaattagatgtaacatgtaacattaagaatggcagatgcgagcagttttgtaaaaatagtgctgataacaaggtggtttgctcctvtactgagggatatcgactttcacaaacttctaagctcacccgtgctgagactgtttttcctgatgtggactatgtaaattctactgaagctgaaaccatt

SEQ ID NO: 1903 - DNA, 201 bp, Homo sapiens
gaactgtgaattagatgtaacatgtaacattaagaatggcagatgcgagcagttttgtaaaaatagtgctgataacaaggtggtttgctcctgtactgagrgatatcgactttcacaaacttctaagctcacccgtgctgagactgtttttcctgatgtggactatgtaaattctactgaagctgaaaccattttggataa

SEQ ID NO: 1904 - DNA, 201 bp, Homo sapiens
aactgtgaattagatgtaacatgtaacattaagaatggcagatgcgagcagttttgtaaaaatagtgctgataacaaggtggtttgctcctgtactgaggvatatcgactttcacaaacttctaagctcacccgtgctgagactgtttttcctgatgtggactatgtaaattctactgaagctgaaaccattttggataac

SEQ ID NO: 1905 - DNA, 201 bp, Homo sapiens
tgttggtggagaagatgccaaaccaggtcaattcccttggcaggttgttttgaatggtaaagttgatgcattctgtggaggctctatcgttaatgaaaaabggattgtaactgctgcccactgtgttgaaactggtgttaaaattacagttgtcgcaggtgaacataatattgaggagacagaacatacagagcaaaagcg

SEQ ID NO: 1906 - DNA, 201 bp, Homo sapiens
ttaggatatctactcagtgctgaatgtacagtttttcttgatcatgaaaacgccaacaaaattctgaatcggccaaagaggtataattcaggtaaattgghagagtttgttcaagggaaccttgagagagaatgtatggaagaaaagtgtagttttgaagaagcacgagaagtttttgaaaacactgaaagaacaactgaa

SEQ ID NO: 1907 - DNA, 201 bp, Homo sapiens
ggatatctactcagtgctgaatgtacagtttttcttgatcatgaaaacgccaacaaaattctgaatcggccaaagaggtataattcaggtaaattggaagvgtttgttcaagggaaccttgagagagaatgtatggaagaaaagtgtagttttgaagaagcacgagaagtttttgaaaacactgaaagaacaactgaattt

SEQ ID NO: 1908 - DNA, 201 bp, Homo sapiens
atatctactcagtgctgaatgtacagtttttcttgatcatgaaaacgccaacaaaattctgaatcggccaaagaggtataattcaggtaaattggaagagwttgttcaagggaaccttgagagagaatgtatggaagaaaagtgtagttttgaagaagcacgagaagtttttgaaaacactgaaagaacaactgaattttg

SEQ ID NO: 1909 - DNA, 201 bp, Homo sapiens
tatctactcagtgctgaatgtacagtttttcttgatcatgaaaacgccaacaaaattctgaatcggccaaagaggtataattcaggtaaattggaagagtktgttcaagggaaccttgagagagaatgtatggaagaaaagtgtagttttgaagaagcacgagaagtttttgaaaacactgaaagaacaactgaattttgg

SEQ ID NO: 1910 - DNA, 201 bp, Homo sapiens
actcagtgctgaatgtacagtttttcttgatcatgaaaacgccaacaaaattctgaatcggccaaagaggtataattcaggtaaattggaagagtttgttyaagggaaccttgagagagaatgtatggaagaaaagtgtagttttgaagaagcacgagaagtttttgaaaacactgaaagaacaactgaattttggaagca

SEQ ID NO: 1911 - DNA, 201 bp, Homo sapiens
cagtgctgaatgtacagtttttcttgatcatgaaaacgccaacaaaattctgaatcggccaaagaggtataattcaggtaaattggaagagtttgttcaarggaaccttgagagagaatgtatggaagaaaagtgtagttttgaagaagcacgagaagtttttgaaaacactgaaagaacaactgaattttggaagcagta

SEQ ID NO: 1912 - DNA, 201 bp, Homo sapiens
agtgctgaatgtacagtttttcttgatcatgaaaacgccaacaaaattctgaatcggccaaagaggtataattcaggtaaattggaagagtttgttcaagvgaaccttgagagagaatgtatggaagaaaagtgtagttttgaagaagcacgagaagtttttgaaaacactgaaagaacaactgaattttggaagcagtat

SEQ ID NO: 1913 - DNA, 201 bp, Homo sapiens
agtttttcttgatcatgaaaacgccaacaaaattctgaatcggccaaagaggtataattcaggtaaattggaagagtttgttcaagggaaccttgagagavaatgtatggaagaaaagtgtagttttgaagaagcacgagaagtttttgaaaacactgaaagaacaactgaattttggaagcagtatgttgatggagatca

SEQ ID NO: 1914 - DNA, 201 bp, Homo sapiens
ttttcttgatcatgaaaacgccaacaaaattctgaatcggccaaagaggtataattcaggtaaattggaagagtttgttcaagggaaccttgagagagaaygtatggaagaaaagtgtagttttgaagaagcacgagaagtttttgaaaacactgaaagaacaactgaattttggaagcagtatgttgatggagatcagtg

SEQ ID NO: 1915 - DNA, 201 bp, Homo sapiens
catcttcctcaaatttggatctggctatgtaagtggctggggaagagtcttccacaaagggagatcagctttagttcttcagtaccttagagttccacttkttgaccgagccacatgtcttcgatctacaaagttcaccatctataacaacatgttctgtgctggcttccatgaaggaggtagagattcatgtcaaggaga

SEQ ID NO: 1916 - DNA, 201 bp, Homo sapiens
gcaggtgaacataatattgaggagacagaacatacagagcaaaagcgaaatgtgattcgaattattcctcaccacaactacaatgcagctattaataagtrcaaccatgacattgcccttctggaactggacgaacccttagtgctaaacagctacgttacacctatttgcattgctgacaaggaatacacgaacatcttc

SEQ ID NO: 1917 - DNA, 201 bp, Homo sapiens
caggtgaacataatattgaggagacagaacatacagagcaaaagcgaaatgtgattcgaattattcctcaccacaactacaatgcagctattaataagtamaaccatgacattgcccttctggaactggacgaacccttagtgctaaacagctacgttacacctatttgcattgctgacaaggaatacacgaacatcttcc

SEQ ID NO: 1918 - DNA, 201 bp, Homo sapiens
ttcactcgggttgttggtggagaagatgccaaaccaggtcaattcccttggcaggttgttttgaatggtaaagttgatgcattctgtggaggctctatcgwtaatgaaaaatggattgtaactgctgcccactgtgttgaaactggtgttaaaattacagttgtcgcaggtgaacataatattgaggagacagaacataca

SEQ ID NO: 1919 - DNA, 201 bp, Homo sapiens
tttttgaaaacactgaaagaacaactgaattttggaagcagtatgttgatggagatcagtgtgagtccaatccatgtttaaatggcggcagttgcaaggakgacattaattcctatgaatgttggtgtccctttggatttgaaggaaagaactgtgaattagatgtaacatgtaacattaagaatggcagatgcgagcagt

SEQ ID NO: 1920 - DNA, 201 bp, Homo sapiens
gaaaacactgaaagaacaactgaattttggaagcagtatgttgatggagatcagtgtgagtccaatccatgtttaaatggcggcagttgcaaggatgacabtaattcctatgaatgttggtgtccctttggatttgaaggaaagaactgtgaattagatgtaacatgtaacattaagaatggcagatgcgagcagttttgt

SEQ ID NO: 1921 - DNA, 201 bp, Homo sapiens
ctcgggttgttggtggagaagatgccaaaccaggtcaattcccttggcaggttgttttgaatggtaaagttgatgcattctgtggaggctctatcgttaakgaaaaatggattgtaactgctgcccactgtgttgaaactggtgttaaaattacagttgtcgcaggtgaacataatattgaggagacagaacatacagagc

SEQ ID NO: 1922 - DNA, 201 bp, Homo sapiens
cgagaagtttttgaaaacactgaaagaacaactgaattttggaagcagtatgttgatggagatcagtgtgagtccaatccatgtttaaatggcggcagttvcaaggatgacattaattcctatgaatgttggtgtccctttggatttgaaggaaagaactgtgaattagatgtaacatgtaacattaagaatggcagatgc

SEQ ID NO: 1923 - DNA, 201 bp, Homo sapiens
gaaagaacaactgaattttggaagcagtatgttgatggagatcagtgtgagtccaatccatgtttaaatggcggcagttgcaaggatgacattaattcctrtgaatgttggtgtccctttggatttgaaggaaagaactgtgaattagatgtaacatgtaacattaagaatggcagatgcgagcagttttgtaaaaatagt

SEQ ID NO: 1924 - DNA, 201 bp, Homo sapiens
aacaactgaattttggaagcagtatgttgatggagatcagtgtgagtccaatccatgtttaaatggcggcagttgcaaggatgacattaattcctatgaawgttggtgtccctttggatttgaaggaaagaactgtgaattagatgtaacatgtaacattaagaatggcagatgcgagcagttttgtaaaaatagtgctga

SEQ ID NO: 1925 - DNA, 201 bp, Homo sapiens
gatgacattaattcctatgaatgttggtgtccctttggatttgaaggaaagaactgtgaattagatgtaacatgtaacattaagaatggcagatgcgagcmgttttgtaaaaatagtgctgataacaaggtggtttgctcctgtactgagggatatcgactttcacaaacttctaagctcacccgtgctgagactgttttt

SEQ ID NO: 1926 - DNA, 201 bp, Homo sapiens
caatgcagctattaataagtacaaccatgacattgcccttctggaactggacgaacccttagtgctaaacagctacgttacacctatttgcattgctgacraggaatacacgaacatcttcctcaaatttggatctggctatgtaagtggctggggaagagtcttccacaaagggagatcagctttagttcttcagtacct

SEQ ID NO: 1927 - DNA, 201 bp, Homo sapiens
tttcttgatcatgaaaacgccaacaaaattctgaatcggccaaagaggtataattcaggtaaattggaagagtttgttcaagggaaccttgagagagaatrtatggaagaaaagtgtagttttgaagaagcacgagaagtttttgaaaacactgaaagaacaactgaattttggaagcagtatgttgatggagatcagtgt

SEQ ID NO: 1928 - DNA, 201 bp, Homo sapiens
tttggatttgaaggaaagaactgtgaattagatgtaacatgtaacattaagaatggcagatgcgagcagttttgtaaaaatagtgctgataacaaggtggyttgctcctgtactgagggatatcgactttcacaaacttctaagctcacccgtgctgagactgtttttcctgatgtggactatgtaaattctactgaagct

SEQ ID NO: 1929 - DNA, 201 bp, Homo sapiens
ccttttaccctccatggtcgttaaaggagagatggggagcatcattctgttatacttctgtacacagttatacatgtctatcaaacccagacttgcttccrtagtggagacttgcttttcagaacatagggatgaagtaaggtgcctgaaaagtttgggggaaaagtttctttcagagagttaagttattttatatatata

SEQ ID NO: 1930 - DNA, 201 bp, Homo sapiens; identical to SEQ ID NO: 1657

SEQ ID NO: 1931 - DNA, 201 bp, Homo sapiens; identical to SEQ ID NO: 1658

SEQ ID NO: 1932 - DNA, 201 bp, Homo sapiens; identical to SEQ ID NO: 1659

SEQ ID NO: 1933 - DNA, 201 bp, Homo sapiens; identical to SEQ ID NO: 1660

SEQ ID NO: 1934 - DNA, 201 bp, Homo sapiens; identical to SEQ ID NO: 1661

SEQ ID NO: 1935 - DNA, 201 bp, Homo sapiens; identical to SEQ ID NO: 1662

SEQ ID NO: 1936 - DNA, 201 bp, Homo sapiens; identical to SEQ ID NO: 1663

SEQ ID NO: 1937 - DNA, 201 bp, Homo sapiens; identical to SEQ ID NO: 1664

SEQ ID NO: 1938 - DNA, 201 bp, Homo sapiens; identical to SEQ ID NO: 1665

SEQ ID NO: 1939 - DNA, 201 bp, Homo sapiens; identical to SEQ ID NO: 1666

SEQ ID NO: 1940 - DNA, 201 bp, Homo sapiens; identical to SEQ ID NO: 1667

SEQ ID NO: 1941 - DNA, 201 bp, Homo sapiens; identical to SEQ ID NO: 1668

SEQ ID NO: 1942 - DNA, 201 bp, Homo sapiens; identical to SEQ ID NO: 1669

SEQ ID NO: 1943 - DNA, 201 bp, Homo sapiens; identical to SEQ ID NO: 1670

SEQ ID NO: 1944 - DNA, 201 bp, Homo sapiens; identical to SEQ ID NO: 1671

SEQ ID NO: 1945 - DNA, 201 bp, Homo sapiens; identical to SEQ ID NO: 1672

SEQ ID NO: 1946 - DNA, 201 bp, Homo sapiens; identical to SEQ ID NO: 1673

SEQ ID NO: 1947 - DNA, 201 bp, Homo sapiens; identical to SEQ ID NO: 1674

SEQ ID NO: 1948 - DNA, 201 bp, Homo sapiens; identical to SEQ ID NO: 1675

SEQ ID NO: 1949 - DNA, 201 bp, Homo sapiens; identical to SEQ ID NO: 1676

SEQ ID NO: 1950 - DNA, 201 bp, Homo sapiens; identical to SEQ ID NO: 1677
  misc_feature (1)...(201): n = A,T,C or G, or insertion/deletion polymorphism (see Tables 1-2)

SEQ ID NO: 1951 - DNA, 201 bp, Homo sapiens; identical to SEQ ID NO: 1678

SEQ ID NO: 1952 - DNA, 201 bp, Homo sapiens; identical to SEQ ID NO: 1679

SEQ ID NO: 1953 - DNA, 201 bp, Homo sapiens; identical to SEQ ID NO: 1680

SEQ ID NO: 1954 - DNA, 201 bp, Homo sapiens; identical to SEQ ID NO: 1681

SEQ ID NO: 1955 - DNA, 201 bp, Homo sapiens; identical to SEQ ID NO: 1682

SEQ ID NO: 1956 - DNA, 201 bp, Homo sapiens; identical to SEQ ID NO: 1683

SEQ ID NO: 1957 - DNA, 201 bp, Homo sapiens; identical to SEQ ID NO: 1684

SEQ ID NO: 1958 - DNA, 201 bp, Homo sapiens; identical to SEQ ID NO: 1685
  misc_feature (1)...(201): n = A,T,C or G, or insertion/deletion polymorphism (see Tables 1-2)

SEQ ID NO: 1959 - DNA, 201 bp, Homo sapiens; identical to SEQ ID NO: 1686

SEQ ID NO: 1960 - DNA, 201 bp, Homo sapiens; identical to SEQ ID NO: 1687
  misc_feature (1)...(201): n = A,T,C or G, or insertion/deletion polymorphism (see Tables 1-2)

SEQ ID NO: 1961 - DNA, 201 bp, Homo sapiens; identical to SEQ ID NO: 1688

SEQ ID NO: 1962 - DNA, 201 bp, Homo sapiens; identical to SEQ ID NO: 1689

SEQ ID NO: 1963 - DNA, 201 bp, Homo sapiens; identical to SEQ ID NO: 1690

SEQ ID NO: 1964 - DNA, 201 bp, Homo sapiens; identical to SEQ ID NO: 1691

SEQ ID NO: 1965 - DNA, 201 bp, Homo sapiens; identical to SEQ ID NO: 1692

SEQ ID NO: 1966 - DNA, 201 bp, Homo sapiens
tactgagggatatcgacttgcagaaaaccagaagtcctgtgaaccagcagtgccatttccatgtggaagagtttctgtttcacaaacttctaagctcacchgtgctgagactgtttttcctgatgtggactatgtaaattctactgaagctgaaaccattttggataacatcactcaaagcacccaatcatttaatgactt

SEQ ID NO: 1967 - DNA, 201 bp, Homo sapiens; identical to SEQ ID NO: 1694
  misc_feature (1)...(201): n = A,T,C or G, or insertion/deletion polymorphism (see Tables 1-2)

SEQ ID NO: 1968 - DNA, 201 bp, Homo sapiens
  misc_feature (1)...(201): n = A,T,C or G, or insertion/deletion polymorphism (see Tables 1-2)
actgagggatatcgacttgcagaaaaccagaagtcctgtgaaccagcagtgccatttccatgtggaagagtttctgtttcacaaacttctaagctcacccntgctgagactgtttttcctgatgtggactatgtaaattctactgaagctgaaaccattttggataacatcactcaaagcacccaatcatttaatgacttc

SEQ ID NO: 1969 - DNA, 201 bp, Homo sapiens
tgagggatatcgacttgcagaaaaccagaagtcctgtgaaccagcagtgccatttccatgtggaagagtttctgtttcacaaacttctaagctcacccgtsctgagactgtttttcctgatgtggactatgtaaattctactgaagctgaaaccattttggataacatcactcaaagcacccaatcatttaatgacttcac

SEQ ID NO: 1970 - DNA, 201 bp, Homo sapiens
agtcctgtgaaccagcagtgccatttccatgtggaagagtttctgtttcacaaacttctaagctcacccgtgctgagactgtttttcctgatgtggactakgtaaattctactgaagctgaaaccattttggataacatcactcaaagcacccaatcatttaatgacttcactcgggttgttggtggagaagatgccaaac

SEQ ID NO: 1971 - DNA, 201 bp, Homo sapiens; identical to SEQ ID NO: 1698

SEQ ID NO: 1972 - DNA, 201 bp, Homo sapiens
aagggaaccttgagagagaatgtatggaagaaaagtgtagttttgaagaagcacgagaagttttttgtgagtccaatccatgtttaaatggcggcagttgmaaggatgacattaattcctatgaatgttggtgtccctttggatttgaaggaaagaactgtgaattagatgtaacatgtaacattaagaatggcagatgcg

SEQ ID NO: 1973 - DNA, 201 bp, Homo sapiens; identical to SEQ ID NO: 1700

SEQ ID NO: 1974 - DNA, 201 bp, Homo sapiens; identical to SEQ ID NO: 1701

SEQ ID NO: 1975 - DNA, 201 bp, Homo sapiens; identical to SEQ ID NO: 1702

SEQ ID NO: 1976 - DNA, 201 bp, Homo sapiens; identical to SEQ ID NO: 1703

SEQ ID NO: 1977 - DNA, 201 bp, Homo sapiens; identical to SEQ ID NO: 1704

SEQ ID NO: 1978 - DNA, 201 bp, Homo sapiens; identical to SEQ ID NO: 1705

SEQ ID NO: 1979 - DNA, 201 bp, Homo sapiens; identical to SEQ ID NO: 1706
  misc_feature (1)...(201): n = A,T,C or G, or insertion/deletion polymorphism (see Tables 1-2)

SEQ ID NO: 1980 - DNA, 201 bp, Homo sapiens; identical to SEQ ID NO: 1707

SEQ ID NO: 1981 - DNA, 201 bp, Homo sapiens; identical to SEQ ID NO: 1708

SEQ ID NO: 1982 - DNA, 201 bp, Homo sapiens; identical to SEQ ID NO: 1709
  misc_feature (1)...(201): n = A,T,C or G, or insertion/deletion polymorphism (see Tables 1-2)

SEQ ID NO: 1983 - DNA, 201 bp, Homo sapiens
aacaaaattctgaatcggccaaagaggtataattcaggtaaattggaagagtttgttcaagggaaccttgagagagaatgtatggaagaaaagtgtagttytgaagaagcacgagaagttttttgtgagtccaatccatgtttaaatggcggcagttgcaaggatgacattaattcctatgaatgttggtgtccctttgga

SEQ ID NO: 1984 - DNA, 201 bp, Homo sapiens; identical to SEQ ID NO: 1711

SEQ ID NO: 1985 - DNA, 201 bp, Homo sapiens; identical to SEQ ID NO: 1712

SEQ ID NO: 1986 - DNA, 201 bp, Homo sapiens; identical to SEQ ID NO: 1714

SEQ ID NO: 1987 - DNA, 201 bp, Homo sapiens; identical to SEQ ID NO: 1715

SEQ ID NO: 1988 - DNA, 201 bp, Homo sapiens; identical to SEQ ID NO: 1716

SEQ ID NO: 1989 - DNA, 201 bp, Homo sapiens; identical to SEQ ID NO: 1718

SEQ ID NO: 1990 - DNA, 201 bp, Homo sapiens; identical to SEQ ID NO: 1720

SEQ ID NO: 1991 - DNA, 201 bp, Homo sapiens; identical to SEQ ID NO: 1722

SEQ ID NO: 1992 - DNA, 201 bp, Homo sapiens; identical to SEQ ID NO: 1723

SEQ ID NO: 1993 - DNA, 201 bp, Homo sapiens; identical to SEQ ID NO: 1724

SEQ ID NO: 1994 - DNA, 201 bp, Homo sapiens
gccatttccatgtggaagagtttctgtttcacaaacttctaagctcacccgtgctgagactgtttttcctgatgtggactatgtaaattctactgaagctkaaaccattttggataacatcactcaaagcacccaatcatttaatgacttcactcgggttgttggtggagaagatgccaaaccaggtcaattcccttggca

SEQ ID NO: 1995 - DNA, 201 bp, Homo sapiens; identical to SEQ ID NO: 1727

SEQ ID NO: 1996 - DNA, 201 bp, Homo sapiens; identical to SEQ ID NO: 1728

SEQ ID NO: 1997 - DNA, 201 bp, Homo sapiens; identical to SEQ ID NO: 1729

SEQ ID NO: 1998 - DNA, 201 bp, Homo sapiens; identical to SEQ ID NO: 1730

SEQ ID NO: 1999 - DNA, 201 bp, Homo sapiens; identical to SEQ ID NO: 1731

SEQ ID NO: 2000 - DNA, 201 bp, Homo sapiens; identical to SEQ ID NO: 1732

SEQ ID NO: 2001 - DNA, 201 bp, Homo sapiens; identical to SEQ ID NO: 1733

SEQ ID NO: 2002 - DNA, 201 bp, Homo sapiens; identical to SEQ ID NO: 1734

SEQ ID NO: 2003 - DNA, 201 bp, Homo sapiens; identical to SEQ ID NO: 1735

SEQ ID NO: 2004 - DNA, 201 bp, Homo sapiens; identical to SEQ ID NO: 1736

SEQ ID NO: 2005 - DNA, 201 bp, Homo sapiens; identical to SEQ ID NO: 1737

SEQ ID NO: 2006 - DNA, 201 bp, Homo sapiens; identical to SEQ ID NO: 1738

SEQ ID NO: 2007 - DNA, 201 bp, Homo sapiens
cttttaggatatctactcagtgctgaatgtacagtttttcttgatcatgaaaacgccaacaaaattctgaatcggccaaagaggtataattcaggtaaatyggaagagtttgttcaagggaaccttgagagagaatgtatggaagaaaagtgtagttttgaagaagcacgagaagttttttgtgagtccaatccatgttta

SEQ ID NO: 2008 - DNA, 201 bp, Homo sapiens
gtaacattaagaatggcagatgcgagcagttttgtaaaaatagtgctgataacaaggtggtttgctcctgtactgagggatatcgacttgcagaaaaccakaagtcctgtgaaccagcagtgccatttccatgtggaagagtttctgtttcacaaacttctaagctcacccgtgctgagactgtttttcctgatgtggact

SEQ ID NO: 2009 - DNA, 201 bp, Homo sapiens; identical to SEQ ID NO: 1741

SEQ ID NO: 2010 - DNA, 201 bp, Homo sapiens
attaagaatggcagatgcgagcagttttgtaaaaatagtgctgataacaaggtggtttgctcctgtactgagggatatcgacttgcagaaaaccagaagtsctgtgaaccagcagtgccatttccatgtggaagagtttctgtttcacaaacttctaagctcacccgtgctgagactgtttttcctgatgtggactatgta

SEQ ID NO: 2011 - DNA, 201 bp, Homo sapiens; identical to SEQ ID NO: 1742

SEQ ID NO: 2012 - DNA, 201 bp, Homo sapiens
cattaagaatggcagatgcgagcagttttgtaaaaatagtgctgataacaaggtggtttgctcctgtactgagggatatcgacttgcagaaaaccagaagycctgtgaaccagcagtgccatttccatgtggaagagtttctgtttcacaaacttctaagctcacccgtgctgagactgtttttcctgatgtggactatgt

SEQ ID NO: 2013 - DNA, 201 bp, Homo sapiens; identical to SEQ ID NO: 1743

SEQ ID NO: 2014 - DNA, 201 bp, Homo sapiens
taagaatggcagatgcgagcagttttgtaaaaatagtgctgataacaaggtggtttgctcctgtactgagggatatcgacttgcagaaaaccagaagtccygtgaaccagcagtgccatttccatgtggaagagtttctgtttcacaaacttctaagctcacccgtgctgagactgtttttcctgatgtggactatgtaaa

SEQ ID NO: 2015 - DNA, 201 bp, Homo sapiens; identical to SEQ ID NO: 1744

SEQ ID NO: 2016 - DNA, 201 bp, Homo sapiens
aagaatggcagatgcgagcagttttgtaaaaatagtgctgataacaaggtggtttgctcctgtactgagggatatcgacttgcagaaaaccagaagtcctdtgaaccagcagtgccatttccatgtggaagagtttctgtttcacaaacttctaagctcacccgtgctgagactgtttttcctgatgtggactatgtaaat

SEQ ID NO: 2017 - DNA, 201 bp, Homo sapiens; identical to SEQ ID NO: 1745

SEQ ID NO: 2018 - DNA, 201 bp, Homo sapiens
agatgcgagcagttttgtaaaaatagtgctgataacaaggtggtttgctcctgtactgagggatatcgacttgcagaaaaccagaagtcctgtgaaccagyagtgccatttccatgtggaagagtttctgtttcacaaacttctaagctcacccgtgctgagactgtttttcctgatgtggactatgtaaattctactgaa

SEQ ID NO: 2019 - DNA, 201 bp, Homo sapiens; identical to SEQ ID NO: 1746

SEQ ID NO: 2020 - DNA, 201 bp, Homo sapiens
atgcgagcagttttgtaaaaatagtgctgataacaaggtggtttgctcctgtactgagggatatcgacttgcagaaaaccagaagtcctgtgaaccagcartgccatttccatgtggaagagtttctgtttcacaaacttctaagctcacccgtgctgagactgtttttcctgatgtggactatgtaaattctactgaagc

SEQ ID NO: 2021 - DNA, 201 bp, Homo sapiens; identical to SEQ ID NO: 1747

SEQ ID NO: 2022 - DNA, 201 bp, Homo sapiens; identical to SEQ ID NO: 1748

SEQ ID NO: 2023 - DNA, 201 bp, Homo sapiens
ttttgtaaaaatagtgctgataacaaggtggtttgctcctgtactgagggatatcgacttgcagaaaaccagaagtcctgtgaaccagcagtgccatttcyatgtggaagagtttctgtttcacaaacttctaagctcacccgtgctgagactgtttttcctgatgtggactatgtaaattctactgaagctgaaaccatt

SEQ ID NO: 2024 - DNA, 201 bp, Homo sapiens; identical to SEQ ID NO: 1749

SEQ ID NO: 2025 - DNA, 201 bp, Homo sapiens; identical to SEQ ID NO: 1750

SEQ ID NO: 2026 - DNA, 201 bp, Homo sapiens; identical to SEQ ID NO: 1751

SEQ ID NO: 2027 - DNA, 201 bp, Homo sapiens
gttttgtaaaaatagtgctgataacaaggtggtttgctcctgtactgagggatatcgacttgcagaaaaccagaagtcctgtgaaccagcagtgccatttycatgtggaagagtttctgtttcacaaacttctaagctcacccgtgctgagactgtttttcctgatgtggactatgtaaattctactgaagctgaaaccat

SEQ ID NO: 2028 - DNA, 201 bp, Homo sapiens; identical to SEQ ID NO: 1752

SEQ ID NO: 2029 - DNA, 201 bp, Homo sapiens; identical to SEQ ID NO: 1753

SEQ ID NO: 2030 - DNA, 201 bp, Homo sapiens; identical to SEQ ID NO: 1754

SEQ ID NO: 2031 - DNA, 201 bp, Homo sapiens; identical to SEQ ID NO: 1755

SEQ ID NO: 2032 - DNA, 201 bp, Homo sapiens; identical to SEQ ID NO: 1756

SEQ ID NO: 2033 - DNA, 201 bp, Homo sapiens; identical to SEQ ID NO: 1757

SEQ ID NO: 2034 - DNA, 201 bp, Homo sapiens; identical to SEQ ID NO: 1758

SEQ ID NO: 2035 - DNA, 201 bp, Homo sapiens; identical to SEQ ID NO: 1759

SEQ ID NO: 2036 - DNA, 201 bp, Homo sapiens; identical to SEQ ID NO: 1760

SEQ ID NO: 2037 - DNA, 201 bp, Homo sapiens; identical to SEQ ID NO: 1761

SEQ ID NO: 2038 - DNA, 201 bp, Homo sapiens
ttgtaaaaatagtgctgataacaaggtggtttgctcctgtactgagggatatcgacttgcagaaaaccagaagtcctgtgaaccagcagtgccatttccabgtggaagagtttctgtttcacaaacttctaagctcacccgtgctgagactgtttttcctgatgtggactatgtaaattctactgaagctgaaaccatttt

SEQ ID NO: 2039 - DNA, 201 bp, Homo sapiens
  misc_feature (1)...(201): n = A,T,C or G, or insertion/deletion polymorphism (see Tables 1-2)
tgtaaaaatagtgctgataacaaggtggtttgctcctgtactgagggatatcgacttgcagaaaaccagaagtcctgtgaaccagcagtgccatttccatntggaagagtttctgtttcacaaacttctaagctcacccgtgctgagactgtttttcctgatgtggactatgtaaattctactgaagctgaaaccattttg

SEQ ID NO: 2040 - DNA, 201 bp, Homo sapiens
gtaaaaatagtgctgataacaaggtggtttgctcctgtactgagggatatcgacttgcagaaaaccagaagtcctgtgaaccagcagtgccatttccatgkggaagagtttctgtttcacaaacttctaagctcacccgtgctgagactgtttttcctgatgtggactatgtaaattctactgaagctgaaaccattttgg

SEQ ID NO: 2041 - DNA, 201 bp, Homo sapiens; identical to SEQ ID NO: 1762

SEQ ID NO: 2042 - DNA, 201 bp, Homo sapiens; identical to SEQ ID NO: 1763

SEQ ID NO: 2043 - DNA, 201 bp, Homo sapiens
taaaaatagtgctgataacaaggtggtttgctcctgtactgagggatatcgacttgcagaaaaccagaagtcctgtgaaccagcagtgccatttccatgtrgaagagtttctgtttcacaaacttctaagctcacccgtgctgagactgtttttcctgatgtggactatgtaaattctactgaagctgaaaccattttgga

SEQ ID NO: 2044 - DNA, 201 bp, Homo sapiens; identical to SEQ ID NO: 1764
  misc_feature (1)...(201): n = A,T,C or G, or insertion/deletion polymorphism (see Tables 1-2)

SEQ ID NO: 2045 - DNA, 201 bp, Homo sapiens
aaaaatagtgctgataacaaggtggtttgctcctgtactgagggatatcgacttgcagaaaaccagaagtcctgtgaaccagcagtgccatttccatgtgraagagtttctgtttcacaaacttctaagctcacccgtgctgagactgtttttcctgatgtggactatgtaaattctactgaagctgaaaccattttggat

SEQ ID NO: 2046 - DNA, 201 bp, Homo sapiens; identical to SEQ ID NO: 1765

SEQ ID NO: 2047 - DNA, 201 bp, Homo sapiens; identical to SEQ ID NO: 1766

SEQ ID NO: 2048 - DNA, 201 bp, Homo sapiens; identical to SEQ ID NO: 1767

SEQ ID NO: 2049 - DNA, 201 bp, Homo sapiens; identical to SEQ ID NO: 1768
  misc_feature (1)...(201): n = A,T,C or G, or insertion/deletion polymorphism (see Tables 1-2)

SEQ ID NO: 2050 - DNA, 201 bp, Homo sapiens; identical to SEQ ID NO: 1769

SEQ ID NO: 2051 - DNA, 201 bp, Homo sapiens; identical to SEQ ID NO: 1770

SEQ ID NO: 2052 - DNA, 201 bp, Homo sapiens; identical to SEQ ID NO: 1771

SEQ ID NO: 2053 - DNA, 201 bp, Homo sapiens; identical to SEQ ID NO: 1772

SEQ ID NO: 2054 - DNA, 201 bp, Homo sapiens; identical to SEQ ID NO: 1773

SEQ ID NO: 2055 - DNA, 201 bp, Homo sapiens; identical to SEQ ID NO: 1774

SEQ ID NO: 2056 - DNA, 201 bp, Homo sapiens; identical to SEQ ID NO: 1775

SEQ ID NO: 2057 - DNA, 201 bp, Homo sapiens; identical to SEQ ID NO: 1778
  misc_feature (1)...(201): n = A,T,C or G, or insertion/deletion polymorphism (see Tables 1-2)

SEQ ID NO: 2058 - DNA, 201 bp, Homo sapiens; identical to SEQ ID NO: 1777

SEQ ID NO: 2059 - DNA, 201 bp, Homo sapiens; identical to SEQ ID NO: 1776

SEQ ID NO: 2060 - DNA, 201 bp, Homo sapiens; identical to SEQ ID NO: 1779
  misc_feature (1)...(201): n = A,T,C or G, or insertion/deletion polymorphism (see Tables 1-2)

SEQ ID NO: 2061 - DNA, 201 bp, Homo sapiens; identical to SEQ ID NO: 1782

SEQ ID NO: 2062 - DNA, 201 bp, Homo sapiens; identical to SEQ ID NO: 1781

SEQ ID NO: 2063 - DNA, 201 bp, Homo sapiens; identical to SEQ ID NO: 1780

SEQ ID NO: 2064 - DNA, 201 bp, Homo sapiens; identical to SEQ ID NO: 1784

SEQ ID NO: 2065 - DNA, 201 bp, Homo sapiens; identical to SEQ ID NO: 1783

SEQ ID NO: 2066 - DNA, 201 bp, Homo sapiens; identical to SEQ ID NO: 1785

SEQ ID NO: 2067 - DNA, 201 bp, Homo sapiens; identical to SEQ ID NO: 1786

SEQ ID NO: 2068 - DNA, 201 bp, Homo sapiens; identical to SEQ ID NO: 1787

SEQ ID NO: 2069 - DNA, 201 bp, Homo sapiens; identical to SEQ ID NO: 1788

SEQ ID NO: 2070 - DNA, 201 bp, Homo sapiens; identical to SEQ ID NO: 1789

SEQ ID NO: 2071 - DNA, 201 bp, Homo sapiens; identical to SEQ ID NO: 1790

SEQ ID NO: 2072 - DNA, 201 bp, Homo sapiens; identical to SEQ ID NO: 1791

SEQ ID NO: 2073 - DNA, 201 bp, Homo sapiens; identical to SEQ ID NO: 1792

SEQ ID NO: 2074 - DNA, 201 bp, Homo sapiens; identical to SEQ ID NO: 1793

SEQ ID NO: 2075 - DNA, 201 bp, Homo sapiens; identical to SEQ ID NO: 1794

SEQ ID NO: 2076 - DNA, 201 bp, Homo sapiens; identical to SEQ ID NO: 1795

SEQ ID NO: 2077 - DNA, 201 bp, Homo sapiens; identical to SEQ ID NO: 1796

SEQ ID NO: 2078 - DNA, 201 bp, Homo sapiens; identical to SEQ ID NO: 1797

SEQ ID NO: 2079 - DNA, 201 bp, Homo sapiens
caccatctgccttttaggatatctactcagtgctgaatgtacagtttttcttgatcatgaaaacgccaacaaaattctgaatcggccaaagaggtataatycaggtaaattggaagagtttgttcaagggaaccttgagagagaatgtatggaagaaaagtgtagttttgaagaagcacgagaagttttttgtgagtccaa

SEQ ID NO: 2080 - DNA, 201 bp, Homo sapiens; identical to SEQ ID NO: 1799

SEQ ID NO: 2081 - DNA, 201 bp, Homo sapiens; identical to SEQ ID NO: 1800

SEQ ID NO: 2082 - DNA, 201 bp, Homo sapiens; identical to SEQ ID NO: 1801

SEQ ID NO: 2083 - DNA, 201 bp, Homo sapiens; identical to SEQ ID NO: 1802

SEQ ID NO: 2084 - DNA, 201 bp, Homo sapiens; identical to SEQ ID NO: 1803

SEQ ID NO: 2085 - DNA, 201 bp, Homo sapiens; identical to SEQ ID NO: 1804

SEQ ID NO: 2086 - DNA, 201 bp, Homo sapiens; identical to SEQ ID NO: 1805

SEQ ID NO: 2087 - DNA, 201 bp, Homo sapiens; identical to SEQ ID NO: 1806

SEQ ID NO: 2088 - DNA, 201 bp, Homo sapiens; identical to SEQ ID NO: 1807

SEQ ID NO: 2089 - DNA, 201 bp, Homo sapiens; identical to SEQ ID NO: 1808

SEQ ID NO: 2090 - DNA, 201 bp, Homo sapiens; identical to SEQ ID NO: 1809

SEQ ID NO: 2091 - DNA, 201 bp, Homo sapiens; identical to SEQ ID NO: 1810

SEQ ID NO: 2092 - DNA, 201 bp, Homo sapiens; identical to SEQ ID NO: 1811

SEQ ID NO: 2093 - DNA, 201 bp, Homo sapiens; identical to SEQ ID NO: 1812

SEQ ID NO: 2094 - DNA, 201 bp, Homo sapiens; identical to SEQ ID NO: 1813

SEQ ID NO: 2095 - DNA, 201 bp, Homo sapiens; identical to SEQ ID NO: 1814

SEQ ID NO: 2096 - DNA, 201 bp, Homo sapiens; identical to SEQ ID NO: 1815

SEQ ID NO: 2097 - DNA, 201 bp, Homo sapiens; identical to SEQ ID NO: 1816

SEQ ID NO: 2098 - DNA, 201 bp, Homo sapiens
ggcctcatcaccatctgccttttaggatatctactcagtgctgaatgtacagtttttcttgatcatgaaaacgccaacaaaattctgaatcggccaaagasgtataattcaggtaaattggaagagtttgttcaagggaaccttgagagagaatgtatggaagaaaagtgtagttttgaagaagcacgagaagttttttgt

SEQ ID NO: 2099 - DNA, 201 bp, Homo sapiens; identical to SEQ ID NO: 1818

SEQ ID NO: 2100 - DNA, 201 bp, Homo sapiens; identical to SEQ ID NO: 1819

SEQ ID NO: 2101 - DNA, 201 bp, Homo sapiens; identical to SEQ ID NO: 1820

SEQ ID NO: 2102 - DNA, 201 bp, Homo sapiens; identical to SEQ ID NO: 1821

SEQ ID NO: 2103 - DNA, 201 bp, Homo sapiens; identical to SEQ ID NO: 1822

SEQ ID NO: 2104 - DNA, 201 bp, Homo sapiens; identical to SEQ ID NO: 1823

SEQ ID NO: 2105 - DNA, 201 bp, Homo sapiens; identical to SEQ ID NO: 1824

SEQ ID NO: 2106 - DNA, 166 bp, Homo sapiens; identical to SEQ ID NO: 1825

SEQ ID NO: 2107 - DNA, 201 bp, Homo sapiens; identical to SEQ ID NO: 1826

SEQ ID NO: 2108 - DNA, 177 bp, Homo sapiens; identical to SEQ ID NO: 1827

SEQ ID NO: 2109 - DNA, 201 bp, Homo sapiens; identical to SEQ ID NO: 1828

SEQ ID NO: 2110 - DNA, 201 bp, Homo sapiens; identical to SEQ ID NO: 1829

SEQ ID NO: 2111 - DNA, 201 bp, Homo sapiens; identical to SEQ ID NO: 1830

SEQ ID NO: 2112 - DNA, 201 bp, Homo sapiens; identical to SEQ ID NO: 1831

SEQ ID NO: 2113 - DNA, 201 bp, Homo sapiens; identical to SEQ ID NO: 1832

SEQ ID NO: 2114 - DNA, 201 bp, Homo sapiens; identical to SEQ ID NO: 1833

SEQ ID NO: 2115 - DNA, 201 bp, Homo sapiens; identical to SEQ ID NO: 1834

SEQ ID NO: 2116 - DNA, 201 bp, Homo sapiens; identical to SEQ ID NO: 1835

SEQ ID NO: 2117 - DNA, 201 bp, Homo sapiens; identical to SEQ ID NO: 1836

SEQ ID NO: 2118 - DNA, 201 bp, Homo sapiens; identical to SEQ ID NO: 1837

SEQ ID NO: 2119 - DNA, 201 bp, Homo sapiens; identical to SEQ ID NO: 1838

SEQ ID NO: 2120 - DNA, 201 bp, Homo sapiens
tttaggatatctactcagtgctgaatgtacagtttttcttgatcatgaaaacgccaacaaaattctgaatcggccaaagaggtataattcaggtaaattgraagagtttgttcaagggaaccttgagagagaatgtatggaagaaaagtgtagttttgaagaagcacgagaagttttttgtgagtccaatccatgtttaaa

SEQ ID NO: 2121 - DNA, 201 bp, Homo sapiens; identical to SEQ ID NO: 1840

SEQ ID NO: 2122 - DNA, 201 bp, Homo sapiens; identical to SEQ ID NO: 1841

SEQ ID NO: 2123 - DNA, 201 bp, Homo sapiens; identical to SEQ ID NO: 1842

SEQ ID NO: 2124 - DNA, 201 bp, Homo sapiens; identical to SEQ ID NO: 1843

SEQ ID NO: 2125 - DNA, 201 bp, Homo sapiens; identical to SEQ ID NO: 1844

SEQ ID NO: 2126 - DNA, 201 bp, Homo sapiens; identical to SEQ ID NO: 1845

SEQ ID NO: 2127 - DNA, 201 bp, Homo sapiens; identical to SEQ ID NO: 1846

SEQ ID NO: 2128 - DNA, 201 bp, Homo sapiens; identical to SEQ ID NO: 1847

SEQ ID NO: 2129 - DNA, 201 bp, Homo sapiens; identical to SEQ ID NO: 1848

SEQ ID NO: 2130 - DNA, 201 bp, Homo sapiens; identical to SEQ ID NO: 1849

SEQ ID NO: 2131 - DNA, 201 bp, Homo sapiens; identical to SEQ ID NO: 1850

SEQ ID NO: 2132 - DNA, 201 bp, Homo sapiens; identical to SEQ ID NO: 1851

SEQ ID NO: 2133 - DNA, 201 bp, Homo sapiens; identical to SEQ ID NO: 1852

SEQ ID NO: 2134 - DNA, 201 bp, Homo sapiens; identical to SEQ ID NO: 1853

SEQ ID NO: 2135 - DNA, 201 bp, Homo sapiens; identical to SEQ ID NO: 1854

SEQ ID NO: 2136 - DNA, 201 bp, Homo sapiens; identical to SEQ ID NO: 1855

SEQ ID NO: 2137 - DNA, 201 bp, Homo sapiens; identical to SEQ ID NO: 1856

SEQ ID NO: 2138 - DNA, 201 bp, Homo sapiens; identical to SEQ ID NO: 1857

SEQ ID NO: 2139 - DNA, 201 bp, Homo sapiens; identical to SEQ ID NO: 1858

SEQ ID NO: 2140 - DNA, 201 bp, Homo sapiens; identical to SEQ ID NO: 1859

SEQ ID NO: 2141 - DNA, 201 bp, Homo sapiens; identical to SEQ ID NO: 1860

SEQ ID NO: 2142 - DNA, 201 bp, Homo sapiens; identical to SEQ ID NO: 1861

SEQ ID NO: 2143 - DNA, 201 bp, Homo sapiens; identical to SEQ ID NO: 1862

SEQ ID NO: 2144 - DNA, 201 bp, Homo sapiens; identical to SEQ ID NO: 1863

SEQ ID NO: 2145 - DNA, 201 bp, Homo sapiens
gaagaaaagtgtagttttgaagaagcacgagaagttttttgtgagtccaatccatgtttaaatggcggcagttgcaaggatgacattaattcctatgaatvttggtgtccctttggatttgaaggaaagaactgtgaattagatgtaacatgtaacattaagaatggcagatgcgagcagttttgtaaaaatagtgctgat

SEQ ID NO: 2146 - DNA, 201 bp, Homo sapiens
gagaatgtatggaagaaaagtgtagttttgaagaagcacgagaagttttttgtgagtccaatccatgtttaaatggcggcagttgcaaggatgacattaawtcctatgaatgttggtgtccctttggatttgaaggaaagaactgtgaattagatgtaacatgtaacattaagaatggcagatgcgagcagttttgtaaaa

SEQ ID NO: 2147 - DNA, 201 bp, Homo sapiens; identical to SEQ ID NO: 1866

SEQ ID NO: 2148 - DNA, 201 bp, Homo sapiens; identical to SEQ ID NO: 1867

SEQ ID NO: 2149 - DNA, 201 bp, Homo sapiens; identical to SEQ ID NO: 1868

SEQ ID NO: 2150 - DNA, 201 bp, Homo sapiens; identical to SEQ ID NO: 1869

SEQ ID NO: 2151 - DNA, 201 bp, Homo sapiens; identical to SEQ ID NO: 1870

SEQ ID NO: 2152 - DNA, 201 bp, Homo sapiens; identical to SEQ ID NO: 1871

SEQ ID NO: 2153 - DNA, 201 bp, Homo sapiens
accatctgccttttaggatatctactcagtgctgaatgtacagtttttcttgatcatgaaaacgccaacaaaattctgaatcggccaaagaggtataattsaggtaaattggaagagtttgttcaagggaaccttgagagagaatgtatggaagaaaagtgtagttttgaagaagcacgagaagttttttgtgagtccaat

SEQ ID NO: 2154 - DNA, 201 bp, Homo sapiens; identical to SEQ ID NO: 1873

SEQ ID NO: 2155 - DNA, 201 bp, Homo sapiens
gatatctactcagtgctgaatgtacagtttttcttgatcatgaaaacgccaacaaaattctgaatcggccaaagaggtataattcaggtaaattggaagastttgttcaagggaaccttgagagagaatgtatggaagaaaagtgtagttttgaagaagcacgagaagttttttgtgagtccaatccatgtttaaatggcg

SEQ ID NO: 2156 - DNA, 201 bp, Homo sapiens
gtttttcttgatcatgaaaacgccaacaaaattctgaatcggccaaagaggtataattcaggtaaattggaagagtttgttcaagggaaccttgagagagmatgtatggaagaaaagtgtagttttgaagaagcacgagaagttttttgtgagtccaatccatgtttaaatggcggcagttgcaaggatgacattaattcc

SEQ ID NO: 2157 - DNA, 201 bp, Homo sapiens
gatcatgaaaacgccaacaaaattctgaatcggccaaagaggtataattcaggtaaattggaagagtttgttcaagggaaccttgagagagaatgtatggwagaaaagtgtagttttgaagaagcacgagaagttttttgtgagtccaatccatgtttaaatggcggcagttgcaaggatgacattaattcctatgaatgt

SEQ ID NO: 2158 - DNA, 201 bp, Homo sapiens
tcatgaaaacgccaacaaaattctgaatcggccaaagaggtataattcaggtaaattggaagagtttgttcaagggaaccttgagagagaatgtatggaaraaaagtgtagttttgaagaagcacgagaagttttttgtgagtccaatccatgtttaaatggcggcagttgcaaggatgacattaattcctatgaatgttg

SEQ ID NO: 2159 - DNA, 201 bp, Homo sapiens
aaacgccaacaaaattctgaatcggccaaagaggtataattcaggtaaattggaagagtttgttcaagggaaccttgagagagaatgtatggaagaaaagygtagttttgaagaagcacgagaagttttttgtgagtccaatccatgtttaaatggcggcagttgcaaggatgacattaattcctatgaatgttggtgtcc

SEQ ID NO: 2160 - DNA, 201 bp, Homo sapiens
aacgccaacaaaattctgaatcggccaaagaggtataattcaggtaaattggaagagtttgttcaagggaaccttgagagagaatgtatggaagaaaagtrtagttttgaagaagcacgagaagttttttgtgagtccaatccatgtttaaatggcggcagttgcaaggatgacattaattcctatgaatgttggtgtccc

SEQ ID NO: 2161 - DNA, 201 bp, Homo sapiens
atatcgacttgcagaaaaccagaagtcctgtgaaccagcagtgccatttccatgtggaagagtttctgtttcacaaacttctaagctcacccgtgctgagrctgtttttcctgatgtggactatgtaaattctactgaagctgaaaccattttggataacatcactcaaagcacccaatcatttaatgacttcactcgggt

SEQ ID NO: 2162 - DNA, 201 bp, Homo sapiens; identical to SEQ ID NO: 1881

SEQ ID NO: 2163 - DNA, 201 bp, Homo sapiens; identical to SEQ ID NO: 1882

SEQ ID NO: 2164 - DNA, 201 bp, Homo sapiens
cattaattcctatgaatgttggtgtccctttggatttgaaggaaagaactgtgaattagatgtaacatgtaacattaagaatggcagatgcgagcagtttygtaaaaatagtgctgataacaaggtggtttgctcctgtactgagggatatcgacttgcagaaaaccagaagtcctgtgaaccagcagtgccatttccatg

SEQ ID NO: 2165 - DNA, 201 bp, Homo sapiens; identical to SEQ ID NO: 1884

SEQ ID NO: 2166 - DNA, 201 bp, Homo sapiens; identical to SEQ ID NO: 1885

SEQ ID NO: 2167 - DNA, 201 bp, Homo sapiens
gaaccttgagagagaatgtatggaagaaaagtgtagttttgaagaagcacgagaagttttttgtgagtccaatccatgtttaaatggcggcagttgcaagdatgacattaattcctatgaatgttggtgtccctttggatttgaaggaaagaactgtgaattagatgtaacatgtaacattaagaatggcagatgcgagca

SEQ ID NO: 2168 - DNA, 201 bp, Homo sapiens
aaccttgagagagaatgtatggaagaaaagtgtagttttgaagaagcacgagaagttttttgtgagtccaatccatgtttaaatggcggcagttgcaaggrtgacattaattcctatgaatgttggtgtccctttggatttgaaggaaagaactgtgaattagatgtaacatgtaacattaagaatggcagatgcgagcag

SEQ ID NO: 2169 - DNA, 201 bp, Homo sapiens; identical to SEQ ID NO: 1888

SEQ ID NO: 2170 - DNA, 201 bp, Homo sapiens
attaattcctatgaatgttggtgtccctttggatttgaaggaaagaactgtgaattagatgtaacatgtaacattaagaatggcagatgcgagcagttttrtaaaaatagtgctgataacaaggtggtttgctcctgtactgagggatatcgacttgcagaaaaccagaagtcctgtgaaccagcagtgccatttccatgt

SEQ ID NO: 2171 - DNA, 201 bp, Homo sapiens
  misc_feature (1)...(201): n = A,T,C or G, or insertion/deletion polymorphism (see Tables 1-2)
ggatttgaaggaaagaactgtgaattagatgtaacatgtaacattaagaatggcagatgcgagcagttttgtaaaaatagtgctgataacaaggtggtttnctcctgtactgagggatatcgacttgcagaaaaccagaagtcctgtgaaccagcagtgccatttccatgtggaagagtttctgtttcacaaacttctaag

SEQ ID NO: 2172 - DNA, 201 bp, Homo sapiens
atttgaaggaaagaactgtgaattagatgtaacatgtaacattaagaatggcagatgcgagcagttttgtaaaaatagtgctgataacaaggtggtttgcycctgtactgagggatatcgacttgcagaaaaccagaagtcctgtgaaccagcagtgccatttccatgtggaagagtttctgtttcacaaacttctaagct

SEQ ID NO: 2173 - DNA, 201 bp, Homo sapiens; identical to SEQ ID NO: 1892

SEQ ID NO: 2174 - DNA, 201 bp, Homo sapiens
caggcctcatcaccatctgccttttaggatatctactcagtgctgaatgtacagtttttcttgatcatgaaaacgccaacaaaattctgaatcggccaaakaggtataattcaggtaaattggaagagtttgttcaagggaaccttgagagagaatgtatggaagaaaagtgtagttttgaagaagcacgagaagtttttt

SEQ ID NO: 2175 - DNA, 201 bp, Homo sapiens
gcctcatcaccatctgccttttaggatatctactcagtgctgaatgtacagtttttcttgatcatgaaaacgccaacaaaattctgaatcggccaaagagstataattcaggtaaattggaagagtttgttcaagggaaccttgagagagaatgtatggaagaaaagtgtagttttgaagaagcacgagaagttttttgtg

SEQ ID NO: 2176 - DNA, 201 bp, Homo sapiens
catcaccatctgccttttaggatatctactcagtgctgaatgtacagtttttcttgatcatgaaaacgccaacaaaattctgaatcggccaaagaggtatdattcaggtaaattggaagagtttgttcaagggaaccttgagagagaatgtatggaagaaaagtgtagttttgaagaagcacgagaagttttttgtgagtc

SEQ ID NO: 2177 - DNA, 201 bp, Homo sapiens
atcaccatctgccttttaggatatctactcagtgctgaatgtacagtttttcttgatcatgaaaacgccaacaaaattctgaatcggccaaagaggtatawttcaggtaaattggaagagtttgttcaagggaaccttgagagagaatgtatggaagaaaagtgtagttttgaagaagcacgagaagttttttgtgagtcc

SEQ ID NO: 2178 - DNA, 201 bp, Homo sapiens
catctgccttttaggatatctactcagtgctgaatgtacagtttttcttgatcatgaaaacgccaacaaaattctgaatcggccaaagaggtataattcargtaaattggaagagtttgttcaagggaaccttgagagagaatgtatggaagaaaagtgtagttttgaagaagcacgagaagttttttgtgagtccaatcc

SEQ ID NO: 2179 - DNA, 201 bp, Homo sapiens
atctgccttttaggatatctactcagtgctgaatgtacagtttttcttgatcatgaaaacgccaacaaaattctgaatcggccaaagaggtataattcagrtaaattggaagagtttgttcaagggaaccttgagagagaatgtatggaagaaaagtgtagttttgaagaagcacgagaagttttttgtgagtccaatcca

SEQ ID NO: 2180 - DNA, 201 bp, Homo sapiens
ctgccttttaggatatctactcagtgctgaatgtacagtttttcttgatcatgaaaacgccaacaaaattctgaatcggccaaagaggtataattcaggtraattggaagagtttgttcaagggaaccttgagagagaatgtatggaagaaaagtgtagttttgaagaagcacgagaagttttttgtgagtccaatccatg

SEQ ID NO: 2181 - DNA, 201 bp, Homo sapiens; identical to SEQ ID NO: 1900

SEQ ID NO: 2182 - DNA, 201 bp, Homo sapiens
tgaaggaaagaactgtgaattagatgtaacatgtaacattaagaatggcagatgcgagcagttttgtaaaaatagtgctgataacaaggtggtttgctccygtactgagggatatcgacttgcagaaaaccagaagtcctgtgaaccagcagtgccatttccatgtggaagagtttctgtttcacaaacttctaagctcac

SEQ ID NO: 2183 - DNA, 201 bp, Homo sapiens
gaaggaaagaactgtgaattagatgtaacatgtaacattaagaatggcagatgcgagcagttttgtaaaaatagtgctgataacaaggtggtttgctcctvtactgagggatatcgacttgcagaaaaccagaagtcctgtgaaccagcagtgccatttccatgtggaagagtttctgtttcacaaacttctaagctcacc

SEQ ID NO: 2184 - DNA, 201 bp, Homo sapiens
gaactgtgaattagatgtaacatgtaacattaagaatggcagatgcgagcagttttgtaaaaatagtgctgataacaaggtggtttgctcctgtactgagrgatatcgacttgcagaaaaccagaagtcctgtgaaccagcagtgccatttccatgtggaagagtttctgtttcacaaacttctaagctcacccgtgctga

SEQ ID NO: 2185 - DNA, 201 bp, Homo sapiens
aactgtgaattagatgtaacatgtaacattaagaatggcagatgcgagcagttttgtaaaaatagtgctgataacaaggtggtttgctcctgtactgaggvatatcgacttgcagaaaaccagaagtcctgtgaaccagcagtgccatttccatgtggaagagtttctgtttcacaaacttctaagctcacccgtgctgag

SEQ ID NO: 2186 - DNA, 201 bp, Homo sapiens; identical to SEQ ID NO: 1905

SEQ ID NO: 2187 - DNA, 201 bp, Homo sapiens
ttaggatatctactcagtgctgaatgtacagtttttcttgatcatgaaaacgccaacaaaattctgaatcggccaaagaggtataattcaggtaaattgghagagtttgttcaagggaaccttgagagagaatgtatggaagaaaagtgtagttttgaagaagcacgagaagttttttgtgagtccaatccatgtttaaat

SEQ ID NO: 2188 - DNA, 201 bp, Homo sapiens
ggatatctactcagtgctgaatgtacagtttttcttgatcatgaaaacgccaacaaaattctgaatcggccaaagaggtataattcaggtaaattggaagvgtttgttcaagggaaccttgagagagaatgtatggaagaaaagtgtagttttgaagaagcacgagaagttttttgtgagtccaatccatgtttaaatggc

SEQ ID NO: 2189 - DNA, 201 bp, Homo sapiens
atatctactcagtgctgaatgtacagtttttcttgatcatgaaaacgccaacaaaattctgaatcggccaaagaggtataattcaggtaaattggaagagwttgttcaagggaaccttgagagagaatgtatggaagaaaagtgtagttttgaagaagcacgagaagttttttgtgagtccaatccatgtttaaatggcgg

SEQ ID NO: 2190 - DNA, 201 bp, Homo sapiens
tatctactcagtgctgaatgtacagtttttcttgatcatgaaaacgccaacaaaattctgaatcggccaaagaggtataattcaggtaaattggaagagtktgttcaagggaaccttgagagagaatgtatggaagaaaagtgtagttttgaagaagcacgagaagttttttgtgagtccaatccatgtttaaatggcggc

SEQ ID NO: 2191 - DNA, 201 bp, Homo sapiens
actcagtgctgaatgtacagtttttcttgatcatgaaaacgccaacaaaattctgaatcggccaaagaggtataattcaggtaaattggaagagtttgttyaagggaaccttgagagagaatgtatggaagaaaagtgtagttttgaagaagcacgagaagttttttgtgagtccaatccatgtttaaatggcggcagttg

SEQ ID NO: 2192 - DNA, 201 bp, Homo sapiens
cagtgctgaatgtacagtttttcttgatcatgaaaacgccaacaaaattctgaatcggccaaagaggtataattcaggtaaattggaagagtttgttcaarggaaccttgagagagaatgtatggaagaaaagtgtagttttgaagaagcacgagaagttttttgtgagtccaatccatgtttaaatggcggcagttgcaa

SEQ ID NO: 2193 - DNA, 201 bp, Homo sapiens
agtgctgaatgtacagtttttcttgatcatgaaaacgccaacaaaattctgaatcggccaaagaggtataattcaggtaaattggaagagtttgttcaagvgaaccttgagagagaatgtatggaagaaaagtgtagttttgaagaagcacgagaagttttttgtgagtccaatccatgtttaaatggcggcagttgcaag

SEQ ID NO: 2194 - DNA, 201 bp, Homo sapiens
agtttttcttgatcatgaaaacgccaacaaaattctgaatcggccaaagaggtataattcaggtaaattggaagagtttgttcaagggaaccttgagagavaatgtatggaagaaaagtgtagttttgaagaagcacgagaagttttttgtgagtccaatccatgtttaaatggcggcagttgcaaggatgacattaattc

SEQ ID NO: 2195 - DNA, 201 bp, Homo sapiens
ttttcttgatcatgaaaacgccaacaaaattctgaatcggccaaagaggtataattcaggtaaattggaagagtttgttcaagggaaccttgagagagaaygtatggaagaaaagtgtagttttgaagaagcacgagaagttttttgtgagtccaatccatgtttaaatggcggcagttgcaaggatgacattaattccta

SEQ ID NO: 2196 - DNA, 201 bp, Homo sapiens; identical to SEQ ID NO: 1915

SEQ ID NO: 2197 - DNA, 201 bp, Homo sapiens; identical to SEQ ID NO: 1916

SEQ ID NO: 2198 - DNA, 201 bp, Homo sapiens; identical to SEQ ID NO: 1917

SEQ ID NO: 2199 - DNA, 201 bp, Homo sapiens; identical to SEQ ID NO: 1918

SEQ ID NO: 2200 - DNA, 201 bp, Homo sapiens
accttgagagagaatgtatggaagaaaagtgtagttttgaagaagcacgagaagttttttgtgagtccaatccatgtttaaatggcggcagttgcaaggakgacattaattcctatgaatgttggtgtccctttggatttgaaggaaagaactgtgaattagatgtaacatgtaacattaagaatggcagatgcgagcagt

SEQ ID NO: 2201 - DNA, 201 bp, Homo sapiens
gagagagaatgtatggaagaaaagtgtagttttgaagaagcacgagaagttttttgtgagtccaatccatgtttaaatggcggcagttgcaaggatgacabtaattcctatgaatgttggtgtccctttggatttgaaggaaagaactgtgaattagatgtaacatgtaacattaagaatggcagatgcgagcagttttgt

SEQ ID NO: 2202 - DNA, 201 bp, Homo sapiens; identical to SEQ ID NO: 1921

SEQ ID NO: 2203 - DNA, 201 bp, Homo sapiens
caagggaaccttgagagagaatgtatggaagaaaagtgtagttttgaagaagcacgagaagttttttgtgagtccaatccatgtttaaatggcggcagttvcaaggatgacattaattcctatgaatgttggtgtccctttggatttgaaggaaagaactgtgaattagatgtaacatgtaacattaagaatggcagatgc

SEQ ID NO: 2204 - DNA, 201 bp, Homo sapiens
tgtatggaagaaaagtgtagttttgaagaagcacgagaagttttttgtgagtccaatccatgtttaaatggcggcagttgcaaggatgacattaattcctrtgaatgttggtgtccctttggatttgaaggaaagaactgtgaattagatgtaacatgtaacattaagaatggcagatgcgagcagttttgtaaaaatagt

SEQ ID NO: 2205 - DNA, 201 bp, Homo sapiens
ggaagaaaagtgtagttttgaagaagcacgagaagttttttgtgagtccaatccatgtttaaatggcggcagttgcaaggatgacattaattcctatgaawgttggtgtccctttggatttgaaggaaagaactgtgaattagatgtaacatgtaacattaagaatggcagatgcgagcagttttgtaaaaatagtgctga

SEQ ID NO: 2206 - DNA, 201 bp, Homo sapiens
gatgacattaattcctatgaatgttggtgtccctttggatttgaaggaaagaactgtgaattagatgtaacatgtaacattaagaatggcagatgcgagcmgttttgtaaaaatagtgctgataacaaggtggtttgctcctgtactgagggatatcgacttgcagaaaaccagaagtcctgtgaaccagcagtgccattt

SEQ ID NO: 2207 - DNA, 201 bp, Homo sapiens; identical to SEQ ID NO: 1926

SEQ ID NO: 2208 - DNA, 201 bp, Homo sapiens
tttcttgatcatgaaaacgccaacaaaattctgaatcggccaaagaggtataattcaggtaaattggaagagtttgttcaagggaaccttgagagagaatrtatggaagaaaagtgtagttttgaagaagcacgagaagttttttgtgagtccaatccatgtttaaatggcggcagttgcaaggatgacattaattcctat

SEQ ID NO: 2209 - DNA, 201 bp, Homo sapiens
tttggatttgaaggaaagaactgtgaattagatgtaacatgtaacattaagaatggcagatgcgagcagttttgtaaaaatagtgctgataacaaggtggyttgctcctgtactgagggatatcgacttgcagaaaaccagaagtcctgtgaaccagcagtgccatttccatgtggaagagtttctgtttcacaaacttct

SEQ ID NO: 2210 - DNA, 201 bp, Homo sapiens; identical to SEQ ID NO: 1929

SEQ ID NO: 2211 - DNA, 201 bp, Homo sapiens; identical to SEQ ID NO: 1657

SEQ ID NO: 2212 - DNA, 201 bp, Homo sapiens; identical to SEQ ID NO: 1658

SEQ ID NO: 2213 - DNA, 201 bp, Homo sapiens; identical to SEQ ID NO: 1659

SEQ ID NO: 2214 - DNA, 201 bp, Homo sapiens; identical to SEQ ID NO: 1660

SEQ ID NO: 2215 - DNA, 201 bp, Homo sapiens; identical to SEQ ID NO: 1661

SEQ ID NO: 2216 - DNA, 201 bp, Homo sapiens; identical to SEQ ID NO: 1662

SEQ ID NO: 2217 - DNA, 201 bp, Homo sapiens; identical to SEQ ID NO: 1663

SEQ ID NO: 2218 - DNA, 201 bp, Homo sapiens; identical to SEQ ID NO: 1664

SEQ ID NO: 2219 - DNA, 201 bp, Homo sapiens; identical to SEQ ID NO: 1665

SEQ ID NO: 2220 - DNA, 201 bp, Homo sapiens; identical to SEQ ID NO: 1666

SEQ ID NO: 2221 - DNA, 201 bp, Homo sapiens; identical to SEQ ID NO: 1667

SEQ ID NO: 2222 - DNA, 201 bp, Homo sapiens; identical to SEQ ID NO: 1668

SEQ ID NO: 2223 - DNA, 201 bp, Homo sapiens; identical to SEQ ID NO: 1669

SEQ ID NO: 2224 - DNA, 201 bp, Homo sapiens; identical to SEQ ID NO: 1670

SEQ ID NO: 2225 - DNA, 201 bp, Homo sapiens; identical to SEQ ID NO: 1671

SEQ ID NO: 2226 - DNA, 201 bp, Homo sapiens; identical to SEQ ID NO: 1672

SEQ ID NO: 2227 - DNA, 201 bp, Homo sapiens; identical to SEQ ID NO: 1673

SEQ ID NO: 2228 - DNA, 201 bp, Homo sapiens; identical to SEQ ID NO: 1674

SEQ ID NO: 2229 - DNA, 201 bp, Homo sapiens; identical to SEQ ID NO: 1675

SEQ ID NO: 2230 - DNA, 201 bp, Homo sapiens; identical to SEQ ID NO: 1676

SEQ ID NO: 2231 - DNA, 201 bp, Homo sapiens; identical to SEQ ID NO: 1677
  misc_feature (1)...(201): n = A,T,C or G, or insertion/deletion polymorphism (see Tables 1-2)

SEQ ID NO: 2232 - DNA, 201 bp, Homo sapiens; identical to SEQ ID NO: 1678

SEQ ID NO: 2233 - DNA, 201 bp, Homo sapiens; identical to SEQ ID NO: 1679

SEQ ID NO: 2234 - DNA, 201 bp, Homo sapiens; identical to SEQ ID NO: 1680

SEQ ID NO: 2235 - DNA, 201 bp, Homo sapiens; identical to SEQ ID NO: 1681

SEQ ID NO: 2236 - DNA, 201 bp, Homo sapiens; identical to SEQ ID NO: 1682

SEQ ID NO: 2237 - DNA, 201 bp, Homo sapiens; identical to SEQ ID NO: 1683

SEQ ID NO: 2238 - DNA, 201 bp, Homo sapiens; identical to SEQ ID NO: 1684

SEQ ID NO: 2239 - DNA, 201 bp, Homo sapiens; identical to SEQ ID NO: 1685
  misc_feature (1)...(201): n = A,T,C or G, or insertion/deletion polymorphism (see Tables 1-2)

SEQ ID NO: 2240 - DNA, 201 bp, Homo sapiens; identical to SEQ ID NO: 1686

SEQ ID NO: 2241 - DNA, 201 bp, Homo sapiens; identical to SEQ ID NO: 1687
  misc_feature (1)...(201): n = A,T,C or G, or insertion/deletion polymorphism (see Tables 1-2)

SEQ ID NO: 2242 - DNA, 201 bp, Homo sapiens; identical to SEQ ID NO: 1688

SEQ ID NO: 2243 - DNA, 201 bp, Homo sapiens; identical to SEQ ID NO: 1689

SEQ ID NO: 2244 - DNA, 201 bp, Homo sapiens; identical to SEQ ID NO: 1690

SEQ ID NO: 2245 - DNA, 201 bp, Homo sapiens; identical to SEQ ID NO: 1691

SEQ ID NO: 2246 - DNA, 201 bp, Homo sapiens; identical to SEQ ID NO: 1692

SEQ ID NO: 2247 - DNA, 201 bp, Homo sapiens; identical to SEQ ID NO: 1694
  misc_feature (1)...(201): n = A,T,C or G, or insertion/deletion polymorphism (see Tables 1-2)

SEQ ID NO: 2248 - DNA, 201 bp, Homo sapiens; identical to SEQ ID NO: 1698

SEQ ID NO: 2249 - DNA, 201 bp, Homo sapiens; identical to SEQ ID NO: 1700

SEQ ID NO: 2250 - DNA, 201 bp, Homo sapiens; identical to SEQ ID NO: 1699

SEQ ID NO: 2251 - DNA, 201 bp, Homo sapiens; identical to SEQ ID NO: 1701

SEQ ID NO: 2252 - DNA, 201 bp, Homo sapiens; identical to SEQ ID NO: 1702

SEQ ID NO: 2253 - DNA, 201 bp, Homo sapiens; identical to SEQ ID NO: 1704

SEQ ID NO: 2254 - DNA, 201 bp, Homo sapiens
cagtgccatttccatgtggaagagtttctgtttcacaaattctactgaagctgaaaccattttggataacatcactcaaagcacccaatcatttaatgacytcactcgggttgttggtggagaagatgccaaaccaggtcaattcccttggcaggttgttttgaatggtaaagttgatgcattctgtggaggctctatcgt

SEQ ID NO: 2255 - DNA, 201 bp, Homo sapiens
catttccatgtggaagagtttctgtttcacaaattctactgaagctgaaaccattttggataacatcactcaaagcacccaatcatttaatgacttcactbgggttgttggtggagaagatgccaaaccaggtcaattcccttggcaggttgttttgaatggtaaagttgatgcattctgtggaggctctatcgttaatga

SEQ ID NO: 2256 - DNA, 201 bp, Homo sapiens; identical to SEQ ID NO: 1706
  misc_feature (1)...(201): n = A,T,C or G, or insertion/deletion polymorphism (see Tables 1-2)

SEQ ID NO: 2257 - DNA, 201 bp, Homo sapiens; identical to SEQ ID NO: 1707

SEQ ID NO: 2258 - DNA, 201 bp, Homo sapiens; identical to SEQ ID NO: 1708

SEQ ID NO: 2259 - DNA, 201 bp, Homo sapiens
  misc_feature (1)...(201): n = A,T,C or G, or insertion/deletion polymorphism (see Tables 1-2)
atttccatgtggaagagtttctgtttcacaaattctactgaagctgaaaccattttggataacatcactcaaagcacccaatcatttaatgacttcactcnggttgttggtggagaagatgccaaaccaggtcaattcccttggcaggttgttttgaatggtaaagttgatgcattctgtggaggctctatcgttaatgaa

SEQ ID NO: 2260 - DNA, 201 bp, Homo sapiens; identical to SEQ ID NO: 1711

SEQ ID NO: 2261 - DNA, 201 bp, Homo sapiens
ttccatgtggaagagtttctgtttcacaaattctactgaagctgaaaccattttggataacatcactcaaagcacccaatcatttaatgacttcactcggkttgttggtggagaagatgccaaaccaggtcaattcccttggcaggttgttttgaatggtaaagttgatgcattctgtggaggctctatcgttaatgaaaa

SEQ ID NO: 2262 - DNA, 201 bp, Homo sapiens; identical to SEQ ID NO: 1710

SEQ ID NO: 2263 - DNA, 201 bp, Homo sapiens; identical to SEQ ID NO: 1714

SEQ ID NO: 2264 - DNA, 201 bp, Homo sapiens; identical to SEQ ID NO: 1715

SEQ ID NO: 2265 - DNA, 201 bp, Homo sapiens
tccatgtggaagagtttctgtttcacaaattctactgaagctgaaaccattttggataacatcactcaaagcacccaatcatttaatgacttcactcgggwtgttggtggagaagatgccaaaccaggtcaattcccttggcaggttgttttgaatggtaaagttgatgcattctgtggaggctctatcgttaatgaaaaa

SEQ ID NO: 2266 - DNA, 201 bp, Homo sapiens; identical to SEQ ID NO: 1713

SEQ ID NO: 2267 - DNA, 201 bp, Homo sapiens; identical to SEQ ID NO: 1718

SEQ ID NO: 2268 - DNA, 201 bp, Homo sapiens; identical to SEQ ID NO: 1717

SEQ ID NO: 2269 - DNA, 201 bp, Homo sapiens; identical to SEQ ID NO: 1720

SEQ ID NO: 2270 - DNA, 201 bp, Homo sapiens; identical to SEQ ID NO: 1719

SEQ ID NO: 2271 - DNA, 201 bp, Homo sapiens; identical to SEQ ID NO: 1722

SEQ ID NO: 2272 - DNA, 201 bp, Homo sapiens; identical to SEQ ID NO: 1723

SEQ ID NO: 2273 - DNA, 201 bp, Homo sapiens; identical to SEQ ID NO: 1721

SEQ ID NO: 2274 - DNA, 201 bp, Homo sapiens; identical to SEQ ID NO: 1727

SEQ ID NO: 2275 - DNA, 201 bp, Homo sapiens; identical to SEQ ID NO: 1724

SEQ ID NO: 2276 - DNA, 201 bp, Homo sapiens
gtactgagggatatcgacttgcagaaaaccagaagtcctgtgaaccagcagtgccatttccatgtggaagagtttctgtttcacaaattctactgaagctkaaaccattttggataacatcactcaaagcacccaatcatttaatgacttcactcgggttgttggtggagaagatgccaaaccaggtcaattcccttggca

SEQ ID NO: 2277 - DNA, 201 bp, Homo sapiens; identical to SEQ ID NO: 1726

SEQ ID NO: 2278 - DNA, 201 bp, Homo sapiens; identical to SEQ ID NO: 1729

SEQ ID NO: 2279 - DNA, 201 bp, Homo sapiens; identical to SEQ ID NO: 1730

SEQ ID NO: 2280 - DNA, 201 bp, Homo sapiens
agtcctgtgaaccagcagtgccatttccatgtggaagagtttctgtttcacaaattctactgaagctgaaaccattttggataacatcactcaaagcaccyaatcatttaatgacttcactcgggttgttggtggagaagatgccaaaccaggtcaattcccttggcaggttgttttgaatggtaaagttgatgcattctg

SEQ ID NO: 2281 - DNA, 201 bp, Homo sapiens; identical to SEQ ID NO: 1731

SEQ ID NO: 2282 - DNA, 201 bp, Homo sapiens; identical to SEQ ID NO: 1732

SEQ ID NO: 2283 - DNA, 201 bp, Homo sapiens; identical to SEQ ID NO: 1733

SEQ ID NO: 2284 - DNA, 201 bp, Homo sapiens; identical to SEQ ID NO: 1734

SEQ ID NO: 2285 - DNA, 201 bp, Homo sapiens; identical to SEQ ID NO: 1735

SEQ ID NO: 2286 - DNA, 201 bp, Homo sapiens; identical to SEQ ID NO: 1736

SEQ ID NO: 2287 - DNA, 201 bp, Homo sapiens; identical to SEQ ID NO: 1737

SEQ ID NO: 2288 - DNA, 201 bp, Homo sapiens; identical to SEQ ID NO: 1738

SEQ ID NO: 2289 - DNA, 201 bp, Homo sapiens; identical to SEQ ID NO: 1739

SEQ ID NO: 2290 - DNA, 201 bp, Homo sapiens; identical to SEQ ID NO: 1740

SEQ ID NO: 2291 - DNA, 201 bp, Homo sapiens
gtaacattaagaatggcagatgcgagcagttttgtaaaaatagtgctgataacaaggtggtttgctcctgtactgagggatatcgacttgcagaaaaccakaagtcctgtgaaccagcagtgccatttccatgtggaagagtttctgtttcacaaattctactgaagctgaaaccattttggataacatcactcaaagcac

SEQ ID NO: 2292 - DNA, 201 bp, Homo sapiens
attaagaatggcagatgcgagcagttttgtaaaaatagtgctgataacaaggtggtttgctcctgtactgagggatatcgacttgcagaaaaccagaagtsctgtgaaccagcagtgccatttccatgtggaagagtttctgtttcacaaattctactgaagctgaaaccattttggataacatcactcaaagcacccaat

SEQ ID NO: 2293 - DNA, 201 bp, Homo sapiens; identical to SEQ ID NO: 1741

SEQ ID NO: 2294 - DNA, 201 bp, Homo sapiens
cattaagaatggcagatgcgagcagttttgtaaaaatagtgctgataacaaggtggtttgctcctgtactgagggatatcgacttgcagaaaaccagaagycctgtgaaccagcagtgccatttccatgtggaagagtttctgtttcacaaattctactgaagctgaaaccattttggataacatcactcaaagcacccaa

SEQ ID NO: 2295 - DNA, 201 bp, Homo sapiens; identical to SEQ ID NO: 1742

SEQ ID NO: 2296 - DNA, 201 bp, Homo sapiens
taagaatggcagatgcgagcagttttgtaaaaatagtgctgataacaaggtggtttgctcctgtactgagggatatcgacttgcagaaaaccagaagtccygtgaaccagcagtgccatttccatgtggaagagtttctgtttcacaaattctactgaagctgaaaccattttggataacatcactcaaagcacccaatca

SEQ ID NO: 2297 - DNA, 201 bp, Homo sapiens; identical to SEQ ID NO: 1743

SEQ ID NO: 2298 - DNA, 201 bp, Homo sapiens
aagaatggcagatgcgagcagttttgtaaaaatagtgctgataacaaggtggtttgctcctgtactgagggatatcgacttgcagaaaaccagaagtcctdtgaaccagcagtgccatttccatgtggaagagtttctgtttcacaaattctactgaagctgaaaccattttggataacatcactcaaagcacccaatcat

SEQ ID NO: 2299 - DNA, 201 bp, Homo sapiens; identical to SEQ ID NO: 1744

SEQ ID NO: 2300 - DNA, 201 bp, Homo sapiens
agatgcgagcagttttgtaaaaatagtgctgataacaaggtggtttgctcctgtactgagggatatcgacttgcagaaaaccagaagtcctgtgaaccagyagtgccatttccatgtggaagagtttctgtttcacaaattctactgaagctgaaaccattttggataacatcactcaaagcacccaatcatttaatgact

SEQ ID NO: 2301 - DNA, 201 bp, Homo sapiens; identical to SEQ ID NO: 1745

SEQ ID NO: 2302 - DNA, 201 bp, Homo sapiens
atgcgagcagttttgtaaaaatagtgctgataacaaggtggtttgctcctgtactgagggatatcgacttgcagaaaaccagaagtcctgtgaaccagcartgccatttccatgtggaagagtttctgtttcacaaattctactgaagctgaaaccattttggataacatcactcaaagcacccaatcatttaatgacttc

SEQ ID NO: 2303 - DNA, 201 bp, Homo sapiens; identical to SEQ ID NO: 1747

SEQ ID NO: 2304 - DNA, 201 bp, Homo sapiens; identical to SEQ ID NO: 1746

SEQ ID NO: 2305 - DNA, 201 bp, Homo sapiens
ttttgtaaaaatagtgctgataacaaggtggtttgctcctgtactgagggatatcgacttgcagaaaaccagaagtcctgtgaaccagcagtgccatttcyatgtggaagagtttctgtttcacaaattctactgaagctgaaaccattttggataacatcactcaaagcacccaatcatttaatgacttcactcgggttg

SEQ ID NO: 2306 - DNA, 201 bp, Homo sapiens; identical to SEQ ID NO: 1748

SEQ ID NO: 2307 - DNA, 201 bp, Homo sapiens; identical to SEQ ID NO: 1749

SEQ ID NO: 2308 - DNA, 201 bp, Homo sapiens
gttttgtaaaaatagtgctgataacaaggtggtttgctcctgtactgagggatatcgacttgcagaaaaccagaagtcctgtgaaccagcagtgccatttycatgtggaagagtttctgtttcacaaattctactgaagctgaaaccattttggataacatcactcaaagcacccaatcatttaatgacttcactcgggtt

SEQ ID NO: 2309 - DNA, 201 bp, Homo sapiens; identical to SEQ ID NO: 1750

SEQ ID NO: 2310 - DNA, 201 bp, Homo sapiens; identical to SEQ ID NO: 1751

SEQ ID NO: 2311 - DNA, 201 bp, Homo sapiens; identical to SEQ ID NO: 1752

SEQ ID NO: 2312 - DNA, 201 bp, Homo sapiens; identical to SEQ ID NO: 1753

SEQ ID NO: 2313 - DNA, 201 bp, Homo sapiens; identical to SEQ ID NO: 1754

SEQ ID NO: 2314 - DNA, 201 bp, Homo sapiens; identical to SEQ ID NO: 1755

SEQ ID NO: 2315 - DNA, 201 bp, Homo sapiens; identical to SEQ ID NO: 1757

SEQ ID NO: 2316 - DNA, 201 bp, Homo sapiens; identical to SEQ ID NO: 1756

SEQ ID NO: 2317 - DNA, 201 bp, Homo sapiens; identical to SEQ ID NO: 1758

SEQ ID NO: 2318 - DNA, 201 bp, Homo sapiens; identical to SEQ ID NO: 1759

SEQ ID NO: 2319 - DNA, 201 bp, Homo sapiens; identical to SEQ ID NO: 1760

SEQ ID NO: 2320 - DNA, 201 bp, Homo sapiens; identical to SEQ ID NO: 1761

SEQ ID NO: 2321 - DNA, 201 bp, Homo sapiens
ttgtaaaaatagtgctgataacaaggtggtttgctcctgtactgagggatatcgacttgcagaaaaccagaagtcctgtgaaccagcagtgccatttccabgtggaagagtttctgtttcacaaattctactgaagctgaaaccattttggataacatcactcaaagcacccaatcatttaatgacttcactcgggttgtt

SEQ ID NO: 2322 - DNA, 201 bp, Homo sapiens
  misc_feature (1)...(201): n = A,T,C or G, or insertion/deletion polymorphism (see Tables 1-2)
tgtaaaaatagtgctgataacaaggtggtttgctcctgtactgagggatatcgacttgcagaaaaccagaagtcctgtgaaccagcagtgccatttccatntggaagagtttctgtttcacaaattctactgaagctgaaaccattttggataacatcactcaaagcacccaatcatttaatgacttcactcgggttgttg

SEQ ID NO: 2323 - DNA, 201 bp, Homo sapiens; identical to SEQ ID NO: 1762

SEQ ID NO: 2324 - DNA, 201 bp, Homo sapiens; identical to SEQ ID NO: 1763

SEQ ID NO: 2325 - DNA, 201 bp, Homo sapiens
gtaaaaatagtgctgataacaaggtggtttgctcctgtactgagggatatcgacttgcagaaaaccagaagtcctgtgaaccagcagtgccatttccatgkggaagagtttctgtttcacaaattctactgaagctgaaaccattttggataacatcactcaaagcacccaatcatttaatgacttcactcgggttgttgg

SEQ ID NO: 2326 - DNA, 201 bp, Homo sapiens; identical to SEQ ID NO: 1764
  misc_feature (1)...(201): n = A,T,C or G, or insertion/deletion polymorphism (see Tables 1-2)

SEQ ID NO: 2327 - DNA, 201 bp, Homo sapiens
taaaaatagtgctgataacaaggtggtttgctcctgtactgagggatatcgacttgcagaaaaccagaagtcctgtgaaccagcagtgccatttccatgtrgaagagtttctgtttcacaaattctactgaagctgaaaccattttggataacatcactcaaagcacccaatcatttaatgacttcactcgggttgttggt

SEQ ID NO: 2328 - DNA, 201 bp, Homo sapiens
aaaaatagtgctgataacaaggtggtttgctcctgtactgagggatatcgacttgcagaaaaccagaagtcctgtgaaccagcagtgccatttccatgtgraagagtttctgtttcacaaattctactgaagctgaaaccattttggataacatcactcaaagcacccaatcatttaatgacttcactcgggttgttggtg

SEQ ID NO: 2329 - DNA, 201 bp, Homo sapiens; identical to SEQ ID NO: 1765

SEQ ID NO: 2330 - DNA, 201 bp, Homo sapiens; identical to SEQ ID NO: 1766

SEQ ID NO: 2331 - DNA, 201 bp, Homo sapiens; identical to SEQ ID NO: 1767

SEQ ID NO: 2332 - DNA, 201 bp, Homo sapiens; identical to SEQ ID NO: 1768
  misc_feature (1)...(201): n = A,T,C or G, or insertion/deletion polymorphism (see Tables 1-2)

SEQ ID NO: 2333 - DNA, 201 bp, Homo sapiens; identical to SEQ ID NO: 1769

SEQ ID NO: 2334 - DNA, 201 bp, Homo sapiens; identical to SEQ ID NO: 1771

SEQ ID NO: 2335 - DNA, 201 bp, Homo sapiens; identical to SEQ ID NO: 1770

SEQ ID NO: 2336 - DNA, 201 bp, Homo sapiens; identical to SEQ ID NO: 1772

SEQ ID NO: 2337 - DNA, 201 bp, Homo sapiens; identical to SEQ ID NO: 1773

SEQ ID NO: 2338 - DNA, 201 bp, Homo sapiens; identical to SEQ ID NO: 1774

SEQ ID NO: 2339 - DNA, 201 bp, Homo sapiens; identical to SEQ ID NO: 1775

SEQ ID NO: 2340 - DNA, 201 bp, Homo sapiens; identical to SEQ ID NO: 1776

SEQ ID NO: 2341 - DNA, 201 bp, Homo sapiens; identical to SEQ ID NO: 1778
  misc_feature (1)...(201): n = A,T,C or G, or insertion/deletion polymorphism (see Tables 1-2)

SEQ ID NO: 2342 - DNA, 201 bp, Homo sapiens; identical to SEQ ID NO: 1777

SEQ ID NO: 2343 - DNA, 201 bp, Homo sapiens; identical to SEQ ID NO: 1779
  misc_feature (1)...(201): n = A,T,C or G, or insertion/deletion polymorphism (see Tables 1-2)

SEQ ID NO: 2344 - DNA, 201 bp, Homo sapiens; identical to SEQ ID NO: 1780

SEQ ID NO: 2345 - DNA, 201 bp, Homo sapiens; identical to SEQ ID NO: 1782

SEQ ID NO: 2346 - DNA, 201 bp, Homo sapiens; identical to SEQ ID NO: 1781

SEQ ID NO: 2347 - DNA, 201 bp, Homo sapiens; identical to SEQ ID NO: 1784

SEQ ID NO: 2348 - DNA, 201 bp, Homo sapiens; identical to SEQ ID NO: 1783

SEQ ID NO: 2349 - DNA, 201 bp, Homo sapiens; identical to SEQ ID NO: 1785

SEQ ID NO: 2350 - DNA, 201 bp, Homo sapiens; identical to SEQ ID NO: 1786

SEQ ID NO: 2351 - DNA, 201 bp, Homo sapiens; identical to SEQ ID NO: 1787

SEQ ID NO: 2352 - DNA, 201 bp, Homo sapiens; identical to SEQ ID NO: 1788

SEQ ID NO: 2353 - DNA, 201 bp, Homo sapiens; identical to SEQ ID NO: 1789

SEQ ID NO: 2354 - DNA, 201 bp, Homo sapiens; identical to SEQ ID NO: 1790

SEQ ID NO: 2355 - DNA, 201 bp, Homo sapiens; identical to SEQ ID NO: 1791

SEQ ID NO: 2356 - DNA, 201 bp, Homo sapiens; identical to SEQ ID NO: 1793

SEQ ID NO: 2357 - DNA, 201 bp, Homo sapiens; identical to SEQ ID NO: 1792

SEQ ID NO: 2358 - DNA, 201 bp, Homo sapiens; identical to SEQ ID NO: 1794

SEQ ID NO: 2359 - DNA, 201 bp, Homo sapiens; identical to SEQ ID NO: 1795

SEQ ID NO: 2360 - DNA, 201 bp, Homo sapiens; identical to SEQ ID NO: 1796

SEQ ID NO: 2361 - DNA, 201 bp, Homo sapiens; identical to SEQ ID NO: 1798

SEQ ID NO: 2362 - DNA, 201 bp, Homo sapiens; identical to SEQ ID NO: 1797

SEQ ID NO: 2363 - DNA, 201 bp, Homo sapiens; identical to SEQ ID NO: 1799

SEQ ID NO: 2364 - DNA, 201 bp, Homo sapiens; identical to SEQ ID NO: 1800

SEQ ID NO: 2365 - DNA, 201 bp, Homo sapiens; identical to SEQ ID NO: 1801

SEQ ID NO: 2366 - DNA, 201 bp, Homo sapiens; identical to SEQ ID NO: 1802

SEQ ID NO: 2367 - DNA, 201 bp, Homo sapiens; identical to SEQ ID NO: 1803

SEQ ID NO: 2368 - DNA, 201 bp, Homo sapiens; identical to SEQ ID NO: 1804

SEQ ID NO: 2369 - DNA, 201 bp, Homo sapiens; identical to SEQ ID NO: 1805

SEQ ID NO: 2370 - DNA, 201 bp, Homo sapiens; identical to SEQ ID NO: 1806

SEQ ID NO: 2371 - DNA, 201 bp, Homo sapiens; identical to SEQ ID NO: 1807

SEQ ID NO: 2372 - DNA, 201 bp, Homo sapiens; identical to SEQ ID NO: 1809

SEQ ID NO: 2373 - DNA, 201 bp, Homo sapiens; identical to SEQ ID NO: 1808

SEQ ID NO: 2374 - DNA, 201 bp, Homo sapiens; identical to SEQ ID NO: 1810

SEQ ID NO: 2375 - DNA, 201 bp, Homo sapiens; identical to SEQ ID NO: 1811

SEQ ID NO: 2376 - DNA, 201 bp, Homo sapiens; identical to SEQ ID NO: 1812

SEQ ID NO: 2377 - DNA, 201 bp, Homo sapiens; identical to SEQ ID NO: 1813

SEQ ID NO: 2378 - DNA, 201 bp, Homo sapiens; identical to SEQ ID NO: 1814

SEQ ID NO: 2379 - DNA, 201 bp, Homo sapiens; identical to SEQ ID NO: 1815

SEQ ID NO: 2380 - DNA, 201 bp, Homo sapiens; identical to SEQ ID NO: 1817

SEQ ID NO: 2381 - DNA, 201 bp, Homo sapiens; identical to SEQ ID NO: 1816

SEQ ID NO: 2382 - DNA, 201 bp, Homo sapiens; identical to SEQ ID NO: 1818

SEQ ID NO: 2383 - DNA, 201 bp, Homo sapiens; identical to SEQ ID NO: 1819

SEQ ID NO: 2384 - DNA, 201 bp, Homo sapiens; identical to SEQ ID NO: 1820

SEQ ID NO: 2385 - DNA, 201 bp, Homo sapiens; identical to SEQ ID NO: 1821

SEQ ID NO: 2386 - DNA, 201 bp, Homo sapiens; identical to SEQ ID NO: 1822

SEQ ID NO: 2387 - DNA, 201 bp, Homo sapiens; identical to SEQ ID NO: 1823

SEQ ID NO: 2388 - DNA, 115 bp, Homo sapiens
aaaggttatgcagcrcgtgaacatgatcatggcagaatcaccaggcctcatcaccatctgccttttaggatatctactcagtgctgaatgtacagtttttcttgatcatgaaaac

SEQ ID NO: 2389 - DNA, 201 bp, Homo sapiens; identical to SEQ ID NO: 1824

SEQ ID NO: 2390 - DNA, 126 bp, Homo sapiens
aaaggttatgcagcgcgtgaacatgwtcatggcagaatcaccaggcctcatcaccatctgccttttaggatatctactcagtgctgaatgtacagtttttcttgatcatgaaaacgccaacaaaat

SEQ ID NO: 2391 - DNA, 201 bp, Homo sapiens; identical to SEQ ID NO: 1826

SEQ ID NO: 2392 - DNA, 201 bp, Homo sapiens; identical to SEQ ID NO: 1829

SEQ ID NO: 2393 - DNA, 201 bp, Homo sapiens; identical to SEQ ID NO: 1828

SEQ ID NO: 2394 - DNA, 201 bp, Homo sapiens; identical to SEQ ID NO: 1830

SEQ ID NO: 2395 - DNA, 201 bp, Homo sapiens; identical to SEQ ID NO: 1831

SEQ ID NO: 2396 - DNA, 201 bp, Homo sapiens; identical to SEQ ID NO: 1832

SEQ ID NO: 2397 - DNA, 201 bp, Homo sapiens; identical to SEQ ID NO: 1833

SEQ ID NO: 2398 - DNA, 201 bp, Homo sapiens; identical to SEQ ID NO: 1834

SEQ ID NO: 2399 - DNA, 201 bp, Homo sapiens; identical to SEQ ID NO: 1835

SEQ ID NO: 2400 - DNA, 201 bp, Homo sapiens; identical to SEQ ID NO: 1836

SEQ ID NO: 2401 - DNA, 201 bp, Homo sapiens; identical to SEQ ID NO: 1837

SEQ ID NO: 2402 - DNA, 201 bp, Homo sapiens; identical to SEQ ID NO: 1838

SEQ ID NO: 2403 - DNA, 201 bp, Homo sapiens; identical to SEQ ID NO: 1839

SEQ ID NO: 2404 - DNA, 201 bp, Homo sapiens; identical to SEQ ID NO: 1840

SEQ ID NO: 2405 - DNA, 201 bp, Homo sapiens; identical to SEQ ID NO: 1841

SEQ ID NO: 2406 - DNA, 201 bp, Homo sapiens; identical to SEQ ID NO: 1842

SEQ ID NO: 2407 - DNA, 201 bp, Homo sapiens; identical to SEQ ID NO: 1843

SEQ ID NO: 2408 - DNA, 201 bp, Homo sapiens; identical to SEQ ID NO: 1844

SEQ ID NO: 2409 - DNA, 201 bp, Homo sapiens; identical to SEQ ID NO: 1845

SEQ ID NO: 2410 - DNA, 201 bp, Homo sapiens; identical to SEQ ID NO: 1846

SEQ ID NO: 2411 - DNA, 201 bp, Homo sapiens; identical to SEQ ID NO: 1847

SEQ ID NO: 2412 - DNA, 201 bp, Homo sapiens; identical to SEQ ID NO: 1848

SEQ ID NO: 2413 - DNA, 201 bp, Homo sapiens; identical to SEQ ID NO: 1849

SEQ ID NO: 2414 - DNA, 201 bp, Homo sapiens; identical to SEQ ID NO: 1850

SEQ ID NO: 2415 - DNA, 201 bp, Homo sapiens; identical to SEQ ID NO: 1851

SEQ ID NO: 2416 - DNA, 201 bp, Homo sapiens; identical to SEQ ID NO: 1852

SEQ ID NO: 2417 - DNA, 201 bp, Homo sapiens; identical to SEQ ID NO: 1853

SEQ ID NO: 2418 - DNA, 201 bp, Homo sapiens; identical to SEQ ID NO: 1854

SEQ ID NO: 2419 - DNA, 201 bp, Homo sapiens; identical to SEQ ID NO: 1855

SEQ ID NO: 2420 - DNA, 201 bp, Homo sapiens; identical to SEQ ID NO: 1856

SEQ ID NO: 2421 - DNA, 201 bp, Homo sapiens; identical to SEQ ID NO: 1857

SEQ ID NO: 2422 - DNA, 201 bp, Homo sapiens; identical to SEQ ID NO: 1858

SEQ ID NO: 2423 - DNA, 201 bp, Homo sapiens; identical to SEQ ID NO: 1859

SEQ ID NO: 2424 - DNA, 201 bp, Homo sapiens; identical to SEQ ID NO: 1860

SEQ ID NO: 2425 - DNA, 201 bp, Homo sapiens; identical to SEQ ID NO: 1861

SEQ ID NO: 2426 - DNA, 201 bp, Homo sapiens; identical to SEQ ID NO: 1862

SEQ ID NO: 2427 - DNA, 201 bp, Homo sapiens; identical to SEQ ID NO: 1863

SEQ ID NO: 2428 - DNA, 201 bp, Homo sapiens; identical to SEQ ID NO: 1864

SEQ ID NO: 2429 - DNA, 201 bp, Homo sapiens; identical to SEQ ID NO: 1865

SEQ ID NO: 2430 - DNA, 201 bp, Homo sapiens; identical to SEQ ID NO: 1866

SEQ ID NO: 2431 - DNA, 201 bp, Homo sapiens; identical to SEQ ID NO: 1867

SEQ ID NO: 2432 - DNA, 201 bp, Homo sapiens; identical to SEQ ID NO: 1868

SEQ ID NO: 2433 - DNA, 201 bp, Homo sapiens; identical to SEQ ID NO: 1869

SEQ ID NO: 2434 - DNA, 201 bp, Homo sapiens; identical to SEQ ID NO: 1870

SEQ ID NO: 2435 - DNA, 201 bp, Homo sapiens; identical to SEQ ID NO: 1871

SEQ ID NO: 2436 - DNA, 201 bp, Homo sapiens; identical to SEQ ID NO: 1872

SEQ ID NO: 2437 - DNA, 201 bp, Homo sapiens; identical to SEQ ID NO: 1873

SEQ ID NO: 2438 - DNA, 201 bp, Homo sapiens; identical to SEQ ID NO: 1874

SEQ ID NO: 2439 - DNA, 201 bp, Homo sapiens; identical to SEQ ID NO: 1875

SEQ ID NO: 2440 - DNA, 201 bp, Homo sapiens; identical to SEQ ID NO: 1876

SEQ ID NO: 2441 - DNA, 201 bp, Homo sapiens; identical to SEQ ID NO: 1877

SEQ ID NO: 2442 - DNA, 201 bp, Homo sapiens; identical to SEQ ID NO: 1878

SEQ ID NO: 2443 - DNA, 201 bp, Homo sapiens; identical to SEQ ID NO: 1879

SEQ ID NO: 2444 - DNA, 201 bp, Homo sapiens
catgtggaagagtttctgtttcacaaattctactgaagctgaaaccattttggataacatcactcaaagcacccaatcatttaatgacttcactcgggttbttggtggagaagatgccaaaccaggtcaattcccttggcaggttgttttgaatggtaaagttgatgcattctgtggaggctctatcgttaatgaaaaatg

SEQ ID NO: 2445 - DNA, 201 bp, Homo sapiens
atgtggaagagtttctgtttcacaaattctactgaagctgaaaccattttggataacatcactcaaagcacccaatcatttaatgacttcactcgggttgbtggtggagaagatgccaaaccaggtcaattcccttggcaggttgttttgaatggtaaagttgatgcattctgtggaggctctatcgttaatgaaaaatgg

SEQ ID NO: 2446 - DNA, 201 bp, Homo sapiens; identical to SEQ ID NO: 1884

SEQ ID NO: 2447 - DNA, 201 bp, Homo sapiens; identical to SEQ ID NO: 2164

SEQ ID NO: 2448 - DNA, 201 bp, Homo sapiens; identical to SEQ ID NO: 1885

SEQ ID NO: 2449 - DNA, 201 bp, Homo sapiens; identical to SEQ ID NO: 1886

SEQ ID NO: 2450 - DNA, 201 bp, Homo sapiens; identical to SEQ ID NO: 1887

SEQ ID NO: 2451 - DNA, 201 bp, Homo sapiens; identical to SEQ ID NO: 1888

SEQ ID NO: 2452 - DNA, 201 bp, Homo sapiens; identical to SEQ ID NO: 2170

SEQ ID NO: 2453 - DNA, 201 bp, Homo sapiens
  misc_feature (1)...(201): n = A,T,C or G, or insertion/deletion polymorphism (see Tables 1-2)
ggatttgaaggaaagaactgtgaattagatgtaacatgtaacattaagaatggcagatgcgagcagttttgtaaaaatagtgctgataacaaggtggtttnctcctgtactgagggatatcgacttgcagaaaaccagaagtcctgtgaaccagcagtgccatttccatgtggaagagtttctgtttcacaaattctactg

SEQ ID NO: 2454 - DNA, 201 bp, Homo sapiens
atttgaaggaaagaactgtgaattagatgtaacatgtaacattaagaatggcagatgcgagcagttttgtaaaaatagtgctgataacaaggtggtttgcycctgtactgagggatatcgacttgcagaaaaccagaagtcctgtgaaccagcagtgccatttccatgtggaagagtttctgtttcacaaattctactgaa

SEQ ID NO: 2455 - DNA, 201 bp, Homo sapiens; identical to SEQ ID NO: 1892

SEQ ID NO: 2456 - DNA, 201 bp, Homo sapiens; identical to SEQ ID NO: 1893

SEQ ID NO: 2457 - DNA, 201 bp, Homo sapiens; identical to SEQ ID NO: 1894

SEQ ID NO: 2458 - DNA, 201 bp, Homo sapiens; identical to SEQ ID NO: 1895

SEQ ID NO: 2459 - DNA, 201 bp, Homo sapiens; identical to SEQ ID NO: 1896

SEQ ID NO: 2460 - DNA, 201 bp, Homo sapiens; identical to SEQ ID NO: 1897

SEQ ID NO: 2461 - DNA, 201 bp, Homo sapiens; identical to SEQ ID NO: 1898

SEQ ID NO: 2462 - DNA, 201 bp, Homo sapiens; identical to SEQ ID NO: 1899

SEQ ID NO: 2463 - DNA, 201 bp, Homo sapiens; identical to SEQ ID NO: 1900

SEQ ID NO: 2464 - DNA, 201 bp, Homo sapiens
tgaaggaaagaactgtgaattagatgtaacatgtaacattaagaatggcagatgcgagcagttttgtaaaaatagtgctgataacaaggtggtttgctccygtactgagggatatcgacttgcagaaaaccagaagtcctgtgaaccagcagtgccatttccatgtggaagagtttctgtttcacaaattctactgaagct

SEQ ID NO: 2465 - DNA, 201 bp, Homo sapiens
gaaggaaagaactgtgaattagatgtaacatgtaacattaagaatggcagatgcgagcagttttgtaaaaatagtgctgataacaaggtggtttgctcctvtactgagggatatcgacttgcagaaaaccagaagtcctgtgaaccagcagtgccatttccatgtggaagagtttctgtttcacaaattctactgaagctg

SEQ ID NO: 2466 - DNA, 201 bp, Homo sapiens
gaactgtgaattagatgtaacatgtaacattaagaatggcagatgcgagcagttttgtaaaaatagtgctgataacaaggtggtttgctcctgtactgagrgatatcgacttgcagaaaaccagaagtcctgtgaaccagcagtgccatttccatgtggaagagtttctgtttcacaaattctactgaagctgaaaccatt

SEQ ID NO: 2467 - DNA, 201 bp, Homo sapiens
aactgtgaattagatgtaacatgtaacattaagaatggcagatgcgagcagttttgtaaaaatagtgctgataacaaggtggtttgctcctgtactgaggvatatcgacttgcagaaaaccagaagtcctgtgaaccagcagtgccatttccatgtggaagagtttctgtttcacaaattctactgaagctgaaaccattt

SEQ ID NO: 2468 - DNA, 201 bp, Homo sapiens; identical to SEQ ID NO: 1905

SEQ ID NO: 2469 - DNA, 201 bp, Homo sapiens; identical to SEQ ID NO: 1906

SEQ ID NO: 2470 - DNA, 201 bp, Homo sapiens; identical to SEQ ID NO: 1907

SEQ ID NO: 2471 - DNA, 201 bp, Homo sapiens; identical to SEQ ID NO: 1908

SEQ ID NO: 2472 - DNA, 201 bp, Homo sapiens; identical to SEQ ID NO: 1909

SEQ ID NO: 2473 - DNA, 201 bp, Homo sapiens; identical to SEQ ID NO: 1910

SEQ ID NO: 2474 - DNA, 201 bp, Homo sapiens; identical to SEQ ID NO: 1911

SEQ ID NO: 2475 - DNA, 201 bp, Homo sapiens; identical to SEQ ID NO: 1912

SEQ ID NO: 2476 - DNA, 201 bp, Homo sapiens; identical to SEQ ID NO: 1913

SEQ ID NO: 2477 - DNA, 201 bp, Homo sapiens; identical to SEQ ID NO: 1914

SEQ ID NO: 2478 - DNA, 201 bp, Homo sapiens; identical to SEQ ID NO: 1915

SEQ ID NO: 2479 - DNA, 201 bp, Homo sapiens; identical to SEQ ID NO: 1916

SEQ ID NO: 2480 - DNA, 201 bp, Homo sapiens; identical to SEQ ID NO: 1917

SEQ ID NO: 2481 - DNA, 201 bp, Homo sapiens; identical to SEQ ID NO: 1918

SEQ ID NO: 2482 - DNA, 201 bp, Homo sapiens; identical to SEQ ID NO: 1919

SEQ ID NO: 2483 - DNA, 201 bp, Homo sapiens; identical to SEQ ID NO: 1920

SEQ ID NO: 2484 - DNA, 201 bp, Homo sapiens; identical to SEQ ID NO: 1921

SEQ ID NO: 2485 - DNA, 201 bp, Homo sapiens; identical to SEQ ID NO: 1922

SEQ ID NO: 2486 - DNA, 201 bp, Homo sapiens; identical to SEQ ID NO: 1923

SEQ ID NO: 2487 - DNA, 201 bp, Homo sapiens; identical to SEQ ID NO: 1924

SEQ ID NO: 2488 - DNA, 201 bp, Homo sapiens; identical to SEQ ID NO: 2206

SEQ ID NO: 2489 - DNA, 201 bp, Homo sapiens; identical to SEQ ID NO: 1926

SEQ ID NO: 2490 - DNA, 201 bp, Homo sapiens; identical to SEQ ID NO: 1927

SEQ ID NO: 2491 - DNA, 201 bp, Homo sapiens
tttggatttgaaggaaagaactgtgaattagatgtaacatgtaacattaagaatggcagatgcgagcagttttgtaaaaatagtgctgataacaaggtggyttgctcctgtactgagggatatcgacttgcagaaaaccagaagtcctgtgaaccagcagtgccatttccatgtggaagagtttctgtttcacaaattcta

SEQ ID NO: 2492 - DNA, 201 bp, Homo sapiens; identical to SEQ ID NO: 1929

SEQ ID NO: 2493 - DNA, 201 bp, Homo sapiens; identical to SEQ ID NO: 1657

SEQ ID NO: 2494 - DNA, 201 bp, Homo sapiens; identical to SEQ ID NO: 1658

SEQ ID NO: 2495 - DNA, 201 bp, Homo sapiens; identical to SEQ ID NO: 1659

SEQ ID NO: 2496 - DNA, 201 bp, Homo sapiens; identical to SEQ ID NO: 1660

SEQ ID NO: 2497 - DNA, 201 bp, Homo sapiens; identical to SEQ ID NO: 1661

SEQ ID NO: 2498 - DNA, 201 bp, Homo sapiens; identical to SEQ ID NO: 1662

SEQ ID NO: 2499 - DNA, 201 bp, Homo sapiens; identical to SEQ ID NO: 1663

SEQ ID NO: 2500 - DNA, 201 bp, Homo sapiens; identical to SEQ ID NO: 1664

SEQ ID NO: 2501 - DNA, 201 bp, Homo sapiens; identical to SEQ ID NO: 1665

SEQ ID NO: 2502 - DNA, 201 bp, Homo sapiens; identical to SEQ ID NO: 1666

SEQ ID NO: 2503 - DNA, 201 bp, Homo sapiens; identical to SEQ ID NO: 1667

SEQ ID NO: 2504 - DNA, 201 bp, Homo sapiens; identical to SEQ ID NO: 1668

SEQ ID NO: 2505 - DNA, 201 bp, Homo sapiens; identical to SEQ ID NO: 1669

SEQ ID NO: 2506 - DNA, 201 bp, Homo sapiens; identical to SEQ ID NO: 1670

SEQ ID NO: 2507 - DNA, 201 bp, Homo sapiens; identical to SEQ ID NO: 1671

SEQ ID NO: 2508 - DNA, 201 bp, Homo sapiens; identical to SEQ ID NO: 1672

SEQ ID NO: 2509 - DNA, 201 bp, Homo sapiens; identical to SEQ ID NO: 1673

SEQ ID NO: 2510 - DNA, 201 bp, Homo sapiens; identical to SEQ ID NO: 1674

SEQ ID NO: 2511 - DNA, 201 bp, Homo sapiens; identical to SEQ ID NO: 1675

SEQ ID NO: 2512 - DNA, 201 bp, Homo sapiens; identical to SEQ ID NO: 1676

SEQ ID NO: 2513 - DNA, 201 bp, Homo sapiens; identical to SEQ ID NO: 1677
  misc_feature (1)...(201): n = A,T,C or G, or insertion/deletion polymorphism (see Tables 1-2)

SEQ ID NO: 2514 - DNA, 201 bp, Homo sapiens; identical to SEQ ID NO: 1678

SEQ ID NO: 2515 - DNA, 201 bp, Homo sapiens; identical to SEQ ID NO: 1679

SEQ ID NO: 2516 - DNA, 201 bp, Homo sapiens; identical to SEQ ID NO: 1680

SEQ ID NO: 2517 - DNA, 201 bp, Homo sapiens; identical to SEQ ID NO: 1681

SEQ ID NO: 2518 - DNA, 201 bp, Homo sapiens; identical to SEQ ID NO: 1682

SEQ ID NO: 2519 - DNA, 201 bp, Homo sapiens; identical to SEQ ID NO: 1683

SEQ ID NO: 2520 - DNA, 201 bp, Homo sapiens; identical to SEQ ID NO: 1684

SEQ ID NO: 2521 - DNA, 201 bp, Homo sapiens; identical to SEQ ID NO: 1685
  misc_feature (1)...(201): n = A,T,C or G, or insertion/deletion polymorphism (see Tables 1-2)

SEQ ID NO: 2522 - DNA, 201 bp, Homo sapiens; identical to SEQ ID NO: 1686

SEQ ID NO: 2523 - DNA, 201 bp, Homo sapiens; identical to SEQ ID NO: 1687
  misc_feature (1)...(201): n = A,T,C or G, or insertion/deletion polymorphism (see Tables 1-2)

SEQ ID NO: 2524 - DNA, 201 bp, Homo sapiens; identical to SEQ ID NO: 1688

SEQ ID NO: 2525 - DNA, 201 bp, Homo sapiens; identical to SEQ ID NO: 1689

SEQ ID NO: 2526 - DNA, 201 bp, Homo sapiens; identical to SEQ ID NO: 1690

SEQ ID NO: 2527 - DNA, 201 bp, Homo sapiens; identical to SEQ ID NO: 1691

SEQ ID NO: 2528 - DNA, 201 bp, Homo sapiens; identical to SEQ ID NO: 1692

SEQ ID NO: 2529 - DNA, 201 bp, Homo sapiens; identical to SEQ ID NO: 1966

SEQ ID NO: 2530 - DNA, 201 bp, Homo sapiens; identical to SEQ ID NO: 1694
  misc_feature (1)...(201): n = A,T,C or G, or insertion/deletion polymorphism (see Tables 1-2)

SEQ ID NO: 2531 - DNA, 201 bp, Homo sapiens; identical to SEQ ID NO: 1968
  misc_feature (1)...(201): n = A,T,C or G, or insertion/deletion polymorphism (see Tables 1-2)

SEQ ID NO: 2532 - DNA, 201 bp, Homo sapiens; identical to SEQ ID NO: 1969

SEQ ID NO: 2533 - DNA, 201 bp, Homo sapiens; identical to SEQ ID NO: 1970

SEQ ID NO: 2534 - DNA, 201 bp, Homo sapiens; identical to SEQ ID NO: 1698

SEQ ID NO: 2535 - DNA, 201 bp, Homo sapiens; identical to SEQ ID NO: 1699

SEQ ID NO: 2536 - DNA, 201 bp, Homo sapiens; identical to SEQ ID NO: 1700

SEQ ID NO: 2537 - DNA, 201 bp, Homo sapiens; identical to SEQ ID NO: 1701

SEQ ID NO: 2538 - DNA, 201 bp, Homo sapiens; identical to SEQ ID NO: 1702

SEQ ID NO: 2539 - DNA, 201 bp, Homo sapiens; identical to SEQ ID NO: 1703

SEQ ID NO: 2540 - DNA, 201 bp, Homo sapiens; identical to SEQ ID NO: 1704

SEQ ID NO: 2541 - DNA, 201 bp, Homo sapiens; identical to SEQ ID NO: 1705

SEQ ID NO: 2542 - DNA, 201 bp, Homo sapiens; identical to SEQ ID NO: 1706
  misc_feature (1)...(201): n = A,T,C or G, or insertion/deletion polymorphism (see Tables 1-2)

SEQ ID NO: 2543 - DNA, 201 bp, Homo sapiens; identical to SEQ ID NO: 1707

SEQ ID NO: 2544 - DNA, 201 bp, Homo sapiens; identical to SEQ ID NO: 1708

SEQ ID NO: 2545 - DNA, 201 bp, Homo sapiens; identical to SEQ ID NO: 1709
  misc_feature (1)...(201): n = A,T,C or G, or insertion/deletion polymorphism (see Tables 1-2)

SEQ ID NO: 2546 - DNA, 201 bp, Homo sapiens; identical to SEQ ID NO: 1710

SEQ ID NO: 2547 - DNA, 201 bp, Homo sapiens; identical to SEQ ID NO: 1711

SEQ ID NO: 2548 - DNA, 201 bp, Homo sapiens; identical to SEQ ID NO: 1712

SEQ ID NO: 2549 - DNA, 201 bp, Homo sapiens; identical to SEQ ID NO: 1713

SEQ ID NO: 2550 - DNA, 201 bp, Homo sapiens; identical to SEQ ID NO: 1714

SEQ ID NO: 2551 - DNA, 201 bp, Homo sapiens; identical to SEQ ID NO: 1715

SEQ ID NO: 2552 - DNA, 201 bp, Homo sapiens; identical to SEQ ID NO: 1716

SEQ ID NO: 2553 - DNA, 201 bp, Homo sapiens; identical to SEQ ID NO: 1717

SEQ ID NO: 2554 - DNA, 201 bp, Homo sapiens; identical to SEQ ID NO: 1718

SEQ ID NO: 2555 - DNA, 201 bp, Homo sapiens; identical to SEQ ID NO: 1719

SEQ ID NO: 2556 - DNA, 201 bp, Homo sapiens; identical to SEQ ID NO: 1720

SEQ ID NO: 2557 - DNA, 201 bp, Homo sapiens; identical to SEQ ID NO: 1721

SEQ ID NO: 2558 - DNA, 201 bp, Homo sapiens; identical to SEQ ID NO: 1722

SEQ ID NO: 2559 - DNA, 201 bp, Homo sapiens; identical to SEQ ID NO: 1723

SEQ ID NO: 2560 - DNA, 201 bp, Homo sapiens; identical to SEQ ID NO: 1724

SEQ ID NO: 2561 - DNA, 201 bp, Homo sapiens; identical to SEQ ID NO: 1994

SEQ ID NO: 2562 - DNA, 201 bp, Homo sapiens; identical to SEQ ID NO: 1726

SEQ ID NO: 2563 - DNA, 201 bp, Homo sapiens; identical to SEQ ID NO: 1727

SEQ ID NO: 2564 - DNA, 201 bp, Homo sapiens; identical to SEQ ID NO: 1728

SEQ ID NO: 2565 - DNA, 201 bp, Homo sapiens; identical to SEQ ID NO: 1729

SEQ ID NO: 2566 - DNA, 201 bp, Homo sapiens; identical to SEQ ID NO: 1730

SEQ ID NO: 2567 - DNA, 201 bp, Homo sapiens; identical to SEQ ID NO: 1731

SEQ ID NO: 2568 - DNA, 201 bp, Homo sapiens; identical to SEQ ID NO: 1732

SEQ ID NO: 2569 - DNA, 201 bp, Homo sapiens; identical to SEQ ID NO: 1733

SEQ ID NO: 2570 - DNA, 201 bp, Homo sapiens; identical to SEQ ID NO: 1734

SEQ ID NO: 2571 - DNA, 201 bp, Homo sapiens; identical to SEQ ID NO: 1735

SEQ ID NO: 2572 - DNA, 201 bp, Homo sapiens; identical to SEQ ID NO: 1736

SEQ ID NO: 2573 - DNA, 201 bp, Homo sapiens; identical to SEQ ID NO: 1737

SEQ ID NO: 2574 - DNA, 201 bp, Homo sapiens; identical to SEQ ID NO: 1738

SEQ ID NO: 2575 - DNA, 201 bp, Homo sapiens; identical to SEQ ID NO: 1739

SEQ ID NO: 2576 - DNA, 201 bp, Homo sapiens; identical to SEQ ID NO: 1740

SEQ ID NO: 2577 - DNA, 201 bp, Homo sapiens; identical to SEQ ID NO: 2008

SEQ ID NO: 2578 - DNA, 201 bp, Homo sapiens; identical to SEQ ID NO: 1741

SEQ ID NO: 2579 - DNA, 201 bp, Homo sapiens; identical to SEQ ID NO: 2010

SEQ ID NO: 2580 - DNA, 201 bp, Homo sapiens; identical to SEQ ID NO: 1742

SEQ ID NO: 2581 - DNA, 201 bp, Homo sapiens; identical to SEQ ID NO: 2012

SEQ ID NO: 2582 - DNA, 201 bp, Homo sapiens; identical to SEQ ID NO: 1743

SEQ ID NO: 2583 - DNA, 201 bp, Homo sapiens; identical to SEQ ID NO: 2014

SEQ ID NO: 2584 - DNA, 201 bp, Homo sapiens; identical to SEQ ID NO: 1744

SEQ ID NO: 2585 - DNA, 201 bp, Homo sapiens; identical to SEQ ID NO: 2016

SEQ ID NO: 2586 - DNA, 201 bp, Homo sapiens; identical to SEQ ID NO: 1745

SEQ ID NO: 2587 - DNA, 201 bp, Homo sapiens; identical to SEQ ID NO: 2018

SEQ ID NO: 2588 - DNA, 201 bp, Homo sapiens; identical to SEQ ID NO: 1746

SEQ ID NO: 2589 - DNA, 201 bp, Homo sapiens; identical to SEQ ID NO: 2020

SEQ ID NO: 2590 - DNA, 201 bp, Homo sapiens; identical to SEQ ID NO: 1747

SEQ ID NO: 2591 - DNA, 201 bp, Homo sapiens; identical to SEQ ID NO: 1748

SEQ ID NO: 2592 - DNA, 201 bp, Homo sapiens; identical to SEQ ID NO: 2023

SEQ ID NO: 2593 - DNA, 201 bp, Homo sapiens; identical to SEQ ID NO: 1749

SEQ ID NO: 2594 - DNA, 201 bp, Homo sapiens; identical to SEQ ID NO: 1750

SEQ ID NO: 2595 - DNA, 201 bp, Homo sapiens; identical to SEQ ID NO: 1751

SEQ ID NO: 2596 - DNA, 201 bp, Homo sapiens; identical to SEQ ID NO: 2027

SEQ ID NO: 2597 - DNA, 201 bp, Homo sapiens; identical to SEQ ID NO: 1752

SEQ ID NO: 2598 - DNA, 201 bp, Homo sapiens; identical to SEQ ID NO: 1753

SEQ ID NO: 2599 - DNA, 201 bp, Homo sapiens; identical to SEQ ID NO: 1754

SEQ ID NO: 2600 - DNA, 201 bp, Homo sapiens; identical to SEQ ID NO: 1755

SEQ ID NO: 2601 - DNA, 201 bp, Homo sapiens; identical to SEQ ID NO: 1756

SEQ ID NO: 2602 - DNA, 201 bp, Homo sapiens; identical to SEQ ID NO: 1757

SEQ ID NO: 2603 - DNA, 201 bp, Homo sapiens; identical to SEQ ID NO: 1758

SEQ ID NO: 2604 - DNA, 201 bp, Homo sapiens; identical to SEQ ID NO: 1759

SEQ ID NO: 2605 - DNA, 201 bp, Homo sapiens; identical to SEQ ID NO: 1760

SEQ ID NO: 2606 - DNA, 201 bp, Homo sapiens; identical to SEQ ID NO: 1761

SEQ ID NO: 2607 - DNA, 201 bp, Homo sapiens; identical to SEQ ID NO: 2038

SEQ ID NO: 2608 - DNA, 201 bp, Homo sapiens; identical to SEQ ID NO: 2039
  misc_feature (1)...(201): n = A,T,C or G, or insertion/deletion polymorphism (see Tables 1-2)

SEQ ID NO: 2609 - DNA, 201 bp, Homo sapiens; identical to SEQ ID NO: 2040

SEQ ID NO: 2610 - DNA, 201 bp, Homo sapiens; identical to SEQ ID NO: 1762

SEQ ID NO: 2611 - DNA, 201 bp, Homo sapiens; identical to SEQ ID NO: 1763

SEQ ID NO: 2612 - DNA, 201 bp, Homo sapiens; identical to SEQ ID NO: 2043

SEQ ID NO: 2613 - DNA, 201 bp, Homo sapiens; identical to SEQ ID NO: 1764
  misc_feature (1)...(201): n = A,T,C or G, or insertion/deletion polymorphism (see Tables 1-2)

SEQ ID NO: 2614 - DNA, 201 bp, Homo sapiens; identical to SEQ ID NO: 2045

SEQ ID NO: 2615 - DNA, 201 bp, Homo sapiens; identical to SEQ ID NO: 1765

SEQ ID NO: 2616 - DNA, 201 bp, Homo sapiens; identical to SEQ ID NO: 1766

SEQ ID NO: 2617 - DNA, 201 bp, Homo sapiens; identical to SEQ ID NO: 1767

SEQ ID NO: 2618 - DNA, 201 bp, Homo sapiens; identical to SEQ ID NO: 1768
  misc_feature (1)...(201): n = A,T,C or G, or insertion/deletion polymorphism (see Tables 1-2)

SEQ ID NO: 2619 - DNA, 201 bp, Homo sapiens; identical to SEQ ID NO: 1769

SEQ ID NO: 2620 - DNA, 201 bp, Homo sapiens; identical to SEQ ID NO: 1770

SEQ ID NO: 2621 - DNA, 201 bp, Homo sapiens; identical to SEQ ID NO: 1771

SEQ ID NO: 2622 - DNA, 201 bp, Homo sapiens; identical to SEQ ID NO: 1772

SEQ ID NO: 2623 - DNA, 201 bp, Homo sapiens; identical to SEQ ID NO: 1775

SEQ ID NO: 2624 - DNA, 201 bp, Homo sapiens; identical to SEQ ID NO: 1774

SEQ ID NO: 2625 - DNA, 201 bp, Homo sapiens; identical to SEQ ID NO: 1773

SEQ ID NO: 2626 - DNA, 201 bp, Homo sapiens; identical to SEQ ID NO: 1778
  misc_feature (1)...(201): n = A,T,C or G, or insertion/deletion polymorphism (see Tables 1-2)

SEQ ID NO: 2627 - DNA, 201 bp, Homo sapiens; identical to SEQ ID NO: 1777

SEQ ID NO: 2628 - DNA, 201 bp, Homo sapiens; identical to SEQ ID NO: 1776

SEQ ID NO: 2629 - DNA, 201 bp, Homo sapiens; identical to SEQ ID NO: 1779
  misc_feature (1)...(201): n = A,T,C or G, or insertion/deletion polymorphism (see Tables 1-2)

SEQ ID NO: 2630 - DNA, 201 bp, Homo sapiens; identical to SEQ ID NO: 1782

SEQ ID NO: 2631 - DNA, 201 bp, Homo sapiens; identical to SEQ ID NO: 1781

SEQ ID NO: 2632 - DNA, 201 bp, Homo sapiens; identical to SEQ ID NO: 1780

SEQ ID NO: 2633 - DNA, 201 bp, Homo sapiens; identical to SEQ ID NO: 1784

SEQ ID NO: 2634 - DNA, 201 bp, Homo sapiens; identical to SEQ ID NO: 1783

SEQ ID NO: 2635 - DNA, 201 bp, Homo sapiens; identical to SEQ ID NO: 1785

SEQ ID NO: 2636 - DNA, 201 bp, Homo sapiens; identical to SEQ ID NO: 1786

SEQ ID NO: 2637 - DNA, 201 bp, Homo sapiens; identical to SEQ ID NO: 1787

SEQ ID NO: 2638 - DNA, 201 bp, Homo sapiens; identical to SEQ ID NO: 1788

SEQ ID NO: 2639 - DNA, 201 bp, Homo sapiens; identical to SEQ ID NO: 1789

SEQ ID NO: 2640 - DNA, 201 bp, Homo sapiens; identical to SEQ ID NO: 1790

SEQ ID NO: 2641 - DNA, 201 bp, Homo sapiens; identical to SEQ ID NO: 1791

SEQ ID NO: 2642 - DNA, 201 bp, Homo sapiens; identical to SEQ ID NO: 1792

SEQ ID NO: 2643 - DNA, 201 bp, Homo sapiens; identical to SEQ ID NO: 1793

SEQ ID NO: 2644 - DNA, 201 bp, Homo sapiens; identical to SEQ ID NO: 1794

SEQ ID NO: 2645 - DNA, 201 bp, Homo sapiens; identical to SEQ ID NO: 1795

SEQ ID NO: 2646 - DNA, 201 bp, Homo sapiens; identical to SEQ ID NO: 1796

SEQ ID NO: 2647 - DNA, 201 bp, Homo sapiens; identical to SEQ ID NO: 1797

SEQ ID NO: 2648 - DNA, 201 bp, Homo sapiens; identical to SEQ ID NO: 1798

SEQ ID NO: 2649 - DNA, 201 bp, Homo sapiens; identical to SEQ ID NO: 1799

SEQ ID NO: 2650 - DNA, 201 bp, Homo sapiens; identical to SEQ ID NO: 1800

SEQ ID NO: 2651 - DNA, 201 bp, Homo sapiens; identical to SEQ ID NO: 1801

SEQ ID NO: 2652 - DNA, 201 bp, Homo sapiens; identical to SEQ ID NO: 1802

SEQ ID NO: 2653 - DNA, 201 bp, Homo sapiens; identical to SEQ ID NO: 1803

SEQ ID NO: 2654 - DNA, 201 bp, Homo sapiens; identical to SEQ ID NO: 1804

SEQ ID NO: 2655 - DNA, 201 bp, Homo sapiens; identical to SEQ ID NO: 1805

SEQ ID NO: 2656 - DNA, 201 bp, Homo sapiens; identical to SEQ ID NO: 1806

SEQ ID NO: 2657 - DNA, 201 bp, Homo sapiens; identical to SEQ ID NO: 1807

SEQ ID NO: 2658 - DNA, 201 bp, Homo sapiens; identical to SEQ ID NO: 1808

SEQ ID NO: 2659 - DNA, 201 bp, Homo sapiens; identical to SEQ ID NO: 1809

SEQ ID NO: 2660 - DNA, 201 bp, Homo sapiens; identical to SEQ ID NO: 1810

SEQ ID NO: 2661 - DNA, 201 bp, Homo sapiens; identical to SEQ ID NO: 1811

SEQ ID NO: 2662 - DNA, 201 bp, Homo sapiens; identical to SEQ ID NO: 1812

SEQ ID NO: 2663 - DNA, 201 bp, Homo sapiens; identical to SEQ ID NO: 1813

SEQ ID NO: 2664 - DNA, 201 bp, Homo sapiens; identical to SEQ ID NO: 1814

SEQ ID NO: 2665 - DNA, 201 bp, Homo sapiens; identical to SEQ ID NO: 1815

SEQ ID NO: 2666 - DNA, 201 bp, Homo sapiens; identical to SEQ ID NO: 1816

SEQ ID NO: 2667 - DNA, 201 bp, Homo sapiens; identical to SEQ ID NO: 1817

SEQ ID NO: 2668 - DNA, 201 bp, Homo sapiens; identical to SEQ ID NO: 1818

SEQ ID NO: 2669 - DNA, 201 bp, Homo sapiens; identical to SEQ ID NO: 1819

SEQ ID NO: 2670 - DNA, 201 bp, Homo sapiens; identical to SEQ ID NO: 1820

SEQ ID NO: 2671 - DNA, 201 bp, Homo sapiens; identical to SEQ ID NO: 1821

SEQ ID NO: 2672 - DNA, 201 bp, Homo sapiens; identical to SEQ ID NO: 1822

SEQ ID NO: 2673 - DNA, 201 bp, Homo sapiens; identical to SEQ ID NO: 1823

SEQ ID NO: 2674 - DNA, 201 bp, Homo sapiens; identical to SEQ ID NO: 1824

SEQ ID NO: 2675 - DNA, 166 bp, Homo sapiens; identical to SEQ ID NO: 1825

SEQ ID NO: 2676 - DNA, 201 bp, Homo sapiens; identical to SEQ ID NO: 1826

SEQ ID NO: 2677 - DNA, 177 bp, Homo sapiens; identical to SEQ ID NO: 1827

SEQ ID NO: 2678 - DNA, 201 bp, Homo sapiens; identical to SEQ ID NO: 1828

SEQ ID NO: 2679 - DNA, 201 bp, Homo sapiens; identical to SEQ ID NO: 1829

SEQ ID NO: 2680 - DNA, 201 bp, Homo sapiens; identical to SEQ ID NO: 1830

SEQ ID NO: 2681 - DNA, 201 bp, Homo sapiens; identical to SEQ ID NO: 1831

SEQ ID NO: 2682 - DNA, 201 bp, Homo sapiens; identical to SEQ ID NO: 1832

SEQ ID NO: 2683 - DNA, 201 bp, Homo sapiens; identical to SEQ ID NO: 1833

SEQ ID NO: 2684 - DNA, 201 bp, Homo sapiens; identical to SEQ ID NO: 1834

SEQ ID NO: 2685 - DNA, 201 bp, Homo sapiens; identical to SEQ ID NO: 1835

SEQ ID NO: 2686 - DNA, 201 bp, Homo sapiens; identical to SEQ ID NO: 1836

SEQ ID NO: 2687 - DNA, 201 bp, Homo sapiens; identical to SEQ ID NO: 1837

SEQ ID NO: 2688 - DNA, 201 bp, Homo sapiens; identical to SEQ ID NO: 1838

SEQ ID NO: 2689 - DNA, 201 bp, Homo sapiens; identical to SEQ ID NO: 1839

SEQ ID NO: 2690 - DNA, 201 bp, Homo sapiens; identical to SEQ ID NO: 1840

SEQ ID NO: 2691 - DNA, 201 bp, Homo sapiens; identical to SEQ ID NO: 1841

SEQ ID NO: 2692 - DNA, 201 bp, Homo sapiens; identical to SEQ ID NO: 1842

SEQ ID NO: 2693 - DNA, 201 bp, Homo sapiens; identical to SEQ ID NO: 1843

SEQ ID NO: 2694 - DNA, 201 bp, Homo sapiens; identical to SEQ ID NO: 1844

SEQ ID NO: 2695 - DNA, 201 bp, Homo sapiens; identical to SEQ ID NO: 1845

SEQ ID NO: 2696 - DNA, 201 bp, Homo sapiens; identical to SEQ ID NO: 1846

SEQ ID NO: 2697 - DNA, 201 bp, Homo sapiens; identical to SEQ ID NO: 1847

SEQ ID NO: 2698 - DNA, 201 bp, Homo sapiens; identical to SEQ ID NO: 1848

SEQ ID NO: 2699 - DNA, 201 bp, Homo sapiens; identical to SEQ ID NO: 1849

SEQ ID NO: 2700 - DNA, 201 bp, Homo sapiens; identical to SEQ ID NO: 1850

SEQ ID NO: 2701 - DNA, 201 bp, Homo sapiens; identical to SEQ ID NO: 1851

SEQ ID NO: 2702 - DNA, 201 bp, Homo sapiens; identical to SEQ ID NO: 1852

SEQ ID NO: 2703 - DNA, 201 bp, Homo sapiens; identical to SEQ ID NO: 1853

SEQ ID NO: 2704 - DNA, 201 bp, Homo sapiens; identical to SEQ ID NO: 1854

SEQ ID NO: 2705 - DNA, 201 bp, Homo sapiens; identical to SEQ ID NO: 1855

SEQ ID NO: 2706 - DNA, 201 bp, Homo sapiens; identical to SEQ ID NO: 1856

SEQ ID NO: 2707 - DNA, 201 bp, Homo sapiens; identical to SEQ ID NO: 1857

SEQ ID NO: 2708 - DNA, 201 bp, Homo sapiens; identical to SEQ ID NO: 1858

SEQ ID NO: 2709 - DNA, 201 bp, Homo sapiens; identical to SEQ ID NO: 1859

SEQ ID NO: 2710 - DNA, 201 bp, Homo sapiens; identical to SEQ ID NO: 1860

SEQ ID NO: 2711 - DNA, 201 bp, Homo sapiens; identical to SEQ ID NO: 1861

SEQ ID NO: 2712 - DNA, 201 bp, Homo sapiens; identical to SEQ ID NO: 1862

SEQ ID NO: 2713 - DNA, 201 bp, Homo sapiens; identical to SEQ ID NO: 1863

SEQ ID NO: 2714 - DNA, 201 bp, Homo sapiens; identical to SEQ ID NO: 1864

SEQ ID NO: 2715 - DNA, 201 bp, Homo sapiens; identical to SEQ ID NO: 1865

SEQ ID NO: 2716 - DNA, 201 bp, Homo sapiens; identical to SEQ ID NO: 1866

SEQ ID NO: 2717 - DNA, 201 bp, Homo sapiens; identical to SEQ ID NO: 1867

SEQ ID NO: 2718 - DNA, 201 bp, Homo sapiens; identical to SEQ ID NO: 1868

SEQ ID NO: 2719 - DNA, 201 bp, Homo sapiens; identical to SEQ ID NO: 1869

SEQ ID NO: 2720 - DNA, 201 bp, Homo sapiens; identical to SEQ ID NO: 1870

SEQ ID NO: 2721 - DNA, 201 bp, Homo sapiens; identical to SEQ ID NO: 1871

SEQ ID NO: 2722 - DNA, 201 bp, Homo sapiens; identical to SEQ ID NO: 1872

SEQ ID NO: 2723 - DNA, 201 bp, Homo sapiens; identical to SEQ ID NO: 1873

SEQ ID NO: 2724 - DNA, 201 bp, Homo sapiens; identical to SEQ ID NO: 1874

SEQ ID NO: 2725 - DNA, 201 bp, Homo sapiens; identical to SEQ ID NO: 1875

SEQ ID NO: 2726 - DNA, 201 bp, Homo sapiens; identical to SEQ ID NO: 1876

SEQ ID NO: 2727 - DNA, 201 bp, Homo sapiens; identical to SEQ ID NO: 1877

SEQ ID NO: 2728 - DNA, 201 bp, Homo sapiens; identical to SEQ ID NO: 1878

SEQ ID NO: 2729 - DNA, 201 bp, Homo sapiens; identical to SEQ ID NO: 1879

SEQ ID NO: 2730 - DNA, 201 bp, Homo sapiens; identical to SEQ ID NO: 2161

SEQ ID NO: 2731 - DNA, 201 bp, Homo sapiens; identical to SEQ ID NO: 1881

SEQ ID NO: 2732 - DNA, 201 bp, Homo sapiens; identical to SEQ ID NO: 1882

SEQ ID NO: 2733 - DNA, 201 bp, Homo sapiens; identical to SEQ ID NO: 2164

SEQ ID NO: 2734 - DNA, 201 bp, Homo sapiens; identical to SEQ ID NO: 1884

SEQ ID NO: 2735 - DNA, 201 bp, Homo sapiens; identical to SEQ ID NO: 1885

SEQ ID NO: 2736 - DNA, 201 bp, Homo sapiens; identical to SEQ ID NO: 1886

SEQ ID NO: 2737 - DNA, 201 bp, Homo sapiens; identical to SEQ ID NO: 1887

SEQ ID NO: 2738 - DNA, 201 bp, Homo sapiens; identical to SEQ ID NO: 1888

SEQ ID NO: 2739 - DNA, 201 bp, Homo sapiens; identical to SEQ ID NO: 2170

SEQ ID NO: 2740 - DNA, 201 bp, Homo sapiens; identical to SEQ ID NO: 2171
  misc_feature (1)...(201): n = A,T,C or G, or insertion/deletion polymorphism (see Tables 1-2)

SEQ ID NO: 2741 - DNA, 201 bp, Homo sapiens; identical to SEQ ID NO: 2172

SEQ ID NO: 2742 - DNA, 201 bp, Homo sapiens; identical to SEQ ID NO: 1892

SEQ ID NO: 2743 - DNA, 201 bp, Homo sapiens; identical to SEQ ID NO: 1893

SEQ ID NO: 2744 - DNA, 201 bp, Homo sapiens; identical to SEQ ID NO: 1894

SEQ ID NO: 2745 - DNA, 201 bp, Homo sapiens; identical to SEQ ID NO: 1895

SEQ ID NO: 2746 - DNA, 201 bp, Homo sapiens; identical to SEQ ID NO: 1896

SEQ ID NO: 2747 - DNA, 201 bp, Homo sapiens; identical to SEQ ID NO: 1897

SEQ ID NO: 2748 - DNA, 201 bp, Homo sapiens; identical to SEQ ID NO: 1898

SEQ ID NO: 2749 - DNA, 201 bp, Homo sapiens; identical to SEQ ID NO: 1899

SEQ ID NO: 2750 - DNA, 201 bp, Homo sapiens; identical to SEQ ID NO: 1900

SEQ ID NO: 2751 - DNA, 201 bp, Homo sapiens; identical to SEQ ID NO: 2182

SEQ ID NO: 2752 - DNA, 201 bp, Homo sapiens; identical to SEQ ID NO: 2183

SEQ ID NO: 2753 - DNA, 201 bp, Homo sapiens; identical to SEQ ID NO: 2184

SEQ ID NO: 2754 - DNA, 201 bp, Homo sapiens; identical to SEQ ID NO: 2185

SEQ ID NO: 2755 - DNA, 201 bp, Homo sapiens; identical to SEQ ID NO: 1905

SEQ ID NO: 2756 - DNA, 201 bp, Homo sapiens; identical to SEQ ID NO: 1906

SEQ ID NO: 2757 - DNA, 201 bp, Homo sapiens; identical to SEQ ID NO: 1907

SEQ ID NO: 2758 - DNA, 201 bp, Homo sapiens; identical to SEQ ID NO: 1908

SEQ ID NO: 2759 - DNA, 201 bp, Homo sapiens; identical to SEQ ID NO: 1909

SEQ ID NO: 2760 - DNA, 201 bp, Homo sapiens; identical to SEQ ID NO: 1910

SEQ ID NO: 2761 - DNA, 201 bp, Homo sapiens; identical to SEQ ID NO: 1911

SEQ ID NO: 2762 - DNA, 201 bp, Homo sapiens; identical to SEQ ID NO: 1912

SEQ ID NO: 2763 - DNA, 201 bp, Homo sapiens; identical to SEQ ID NO: 1913

SEQ ID NO: 2764 - DNA, 201 bp, Homo sapiens; identical to SEQ ID NO: 1914

SEQ ID NO: 2765 - DNA, 201 bp, Homo sapiens; identical to SEQ ID NO: 1915

SEQ ID NO: 2766 - DNA, 201 bp, Homo sapiens; identical to SEQ ID NO: 1916

SEQ ID NO: 2767 - DNA, 201 bp, Homo sapiens; identical to SEQ ID NO: 1917

SEQ ID NO: 2768 - DNA, 201 bp, Homo sapiens; identical to SEQ ID NO: 1918

SEQ ID NO: 2769 - DNA, 201 bp, Homo sapiens; identical to SEQ ID NO: 1919

SEQ ID NO: 2770 - DNA, 201 bp, Homo sapiens; identical to SEQ ID NO: 1920

SEQ ID NO: 2771 - DNA, 201 bp, Homo sapiens; identical to SEQ ID NO: 1921

SEQ ID NO: 2772 - DNA, 201 bp, Homo sapiens; identical to SEQ ID NO: 1922

SEQ ID NO: 2773 - DNA, 201 bp, Homo sapiens; identical to SEQ ID NO: 1923

SEQ ID NO: 2774 - DNA, 201 bp, Homo sapiens; identical to SEQ ID NO: 1924

SEQ ID NO: 2775 - DNA, 201 bp, Homo sapiens; identical to SEQ ID NO: 2206

SEQ ID NO: 2776 - DNA, 201 bp, Homo sapiens; identical to SEQ ID NO: 1926

SEQ ID NO: 2777 - DNA, 201 bp, Homo sapiens; identical to SEQ ID NO: 1927

SEQ ID NO: 2778 - DNA, 201 bp, Homo sapiens; identical to SEQ ID NO: 2209

SEQ ID NO: 2779 - DNA, 201 bp, Homo sapiens; identical to SEQ ID NO: 1929

SEQ ID NO: 2780 - DNA, 201 bp, Homo sapiens
cggctggatgcgcacaaggtcctgtctgccctgcaggctgtacagggcctgctagtggcccagggcagggctgatagccaggcccagctgctgctgtccayggtggtgggcgtgttcacagccccaggcctgcacctgaagcagccgtttgtgcagggcctggctctctatacccctgtggtcctcccacgctctctggac

SEQ ID NO: 2781 - DNA, 201 bp, Homo sapiens
agcctgtggtctggccaagtgatgtaaccctcctctccagcctgtgcacaggcagcctgggaacagctccatccccacccctcagctataaatagggcatygtgacccggccaggggaagaagctgccgttgttctgggtactacagcagaagggtatgcggaagcgagcaccccagtctgagatggctcctgccggtgtg

SEQ ID NO: 2782 - DNA, 201 bp, Homo sapiens
ggccaagtgatgtaaccctcctctccagcctgtgcacaggcagcctgggaacagctccatccccacccctcagctataaatagggcatcgtgacccggccrggggaagaagctgccgttgttctgggtactacagcagaagggtatgcggaagcgagcaccccagtctgagatggctcctgccggtgtgagcctgagggcc

SEQ ID NO: 2783 - DNA, 201 bp, Homo sapiens
ctcccacgctctctggacttcacagaactggatgttgctgctgagaagattgacaggttcatgcaggctgtgacaggatggaagactggctgctccctgaygggagccagtgtggacagcaccctggctttcaacacctacgtccacttccaagggaagatgaagggcttctccctgctggccgagccccaggagttctgg

SEQ ID NO: 2784 - DNA, 201 bp, Homo sapiens
gatggctcctgccggtgtgagcctgagggccaccatcctctgcctcctggcctgggctggcctggctgcaggtgaccgggtgtacatacaccccttccacytcgtcatccacaatgagagtacctgtgagcagctggcaaaggccaatgccgggaagcccaaagaccccaccttcatacctgctccaattcaggccaagac

SEQ ID NO: 2785 - DNA, 201 bp, Homo sapiens
ccctcctctccagcctgtgcacaggcagcctgggaacagctccatccccacccctcagctataaatagggcatcgtgacccggccaggggaagaagctgcygttgttctgggtactacagcagaagggtatgcggaagcgagcaccccagtctgagatggctcctgccggtgtgagcctgagggccaccatcctctgcctc

SEQ ID NO: 2786 - DNA, 201 bp, Homo sapiens
ccagcctgtggtctggccaagtgatgtaaccctcctctccagcctgtgcacaggcagcctgggaacagctccatccccacccctcagctataaatagggcmtcgtgacccggccaggggaagaagctgccgttgttctgggtactacagcagaagggtatgcggaagcgagcaccccagtctgagatggctcctgccggtg

SEQ ID NO: 2787 - DNA, 201 bp, Homo sapiens
gacctggacaaggtggagggtctcactttccagcaaaactccctcaactggatgaagaaactgtctccccggaccatccacctgaccatgccccaactggygctgcaaggatcttatgacctgcaggacctgctcgcccaggctgagctgcccgccattctgcacaccgagctgaacctgcaaaaattgagcaatgaccgc

SEQ ID NO: 2788 - DNA, 201 bp, Homo sapiens
tgaaaaggccctacaggaccagctggtgctagtcgctgcaaaacttgacaccgaagacaagttgagggccgcaatggtcgggatgctggccaacttcttgkgcttccgtatatatggcatgcacagtgagctatggggcgtggtccatggggccaccgtcctctccccaacggctgtctttggcaccctggcctctctcta

SEQ ID NO: 2789 - DNA, 201 bp, Homo sapiens
gctgagaagattgacaggttcatgcaggctgtgacaggatggaagactggctgctccctgatgggagccagtgtggacagcaccctggctttcaacacctrcgtccacttccaagggaagatgaagggcttctccctgctggccgagccccaggagttctgggtggacaacagcacctcagtgtctgttcccatgctctct

SEQ ID NO: 2790 - DNA, 201 bp, Homo sapiens
gtgttcacagccccaggcctgcacctgaagcagccgtttgtgcagggcctggctctctatacccctgtggtcctcccacgctctctggacttcacagaackggatgttgctgctgagaagattgacaggttcatgcaggctgtgacaggatggaagactggctgctccctgatgggagccagtgtggacagcaccctggct

SEQ ID NO: 2791 - DNA, 201 bp, Homo sapiens
accccaccttcatacctgctccaattcaggccaagacatcccctgtggatgaaaaggccctacaggaccagctggtgctagtcgctgcaaaacttgacacygaagacaagttgagggccgcaatggtcgggatgctggccaacttcttgggcttccgtatatatggcatgcacagtgagctatggggcgtggtccatgggg

SEQ ID NO: 2792 - DNA, 201 bp, Homo sapiens
gagggccaccatcctctgcctcctggcctgggctggcctggctgcaggtgaccgggtgtacatacaccccttccacctcgtcatccacaatgagagtaccygtgagcagctggcaaaggccaatgccgggaagcccaaagaccccaccttcatacctgctccaattcaggccaagacatcccctgtggatgaaaaggccct

SEQ ID NO: 2793 - DNA, 201 bp, Homo sapiens
gaacagctccatccccacccctcagctataaatagggcatcgtgacccggccaggggaagaagctgccgttgttctgggtactacagcagaagggtatgcrgaagcgagcaccccagtctgagatggctcctgccggtgtgagcctgagggccaccatcctctgcctcctggcctgggctggcctggctgcaggtgaccgg

SEQ ID NO: 2794 - DNA, 201 bp, Homo sapiens
gcaatggtcgggatgctggccaacttcttgggcttccgtatatatggcatgcacagtgagctatggggcgtggtccatggggccaccgtcctctccccaayggctgtctttggcaccctggcctctctctatctgggagccttggaccacacagctgacaggctacaggcaatcctgggtgttccttggaaggacaagaac

SEQ ID NO: 2795 - DNA, 201 bp, Homo sapiens
tgtagtgtctgtaataccttagttttttccacagatgcttgtgatttttgaacaatacgtgaaagatgcaagcacctgaatttctgtttgaatgcggaacmatagctggttatttctcccttgtgttagtaataaacgtcttgccacaataagcctccaaaaattttatctttcatttagcagccaaacagatgtatacaa

SEQ ID NO: 2796 - DNA, 201 bp, Homo sapiens
tcaaagcgccactgccctgcacttcctgggccgcgtggccaacccgctgagcacagcatgaggccagggccccagaacacagtgcctggcaaggcctctgyccctggcctttgaggcaaaggccagcagcagataacaaccccggacaaatcagcgatgtgtcacccccagtctcccaccttttcttctaatgagtcgact

SEQ ID NO: 2797 - DNA, 201 bp, Homo sapiens
aaggccagcagcagataacaaccccggacaaatcagcgatgtgtcacccccagtctcccaccttttcttctaatgagtcgactttgagctggaaagcagcsgtttctccttggtctaagtgtgctgcatggagtgagcagtagaagcctgcagcggcacaaatgcacctcccagtttgctgggtttattttagagaatggg

SEQ ID NO: 2798 - DNA, 201 bp, Homo sapiens
caccatcctctgcctcctggcctgggctggcctggctgcaggtgaccgggtgtacatacaccccttccacctcgtcatccacaatgagagtacctgtgagyagctggcaaaggccaatgccgggaagcccaaagaccccaccttcatacctgctccaattcaggccaagacatcccctgtggatgaaaaggccctacagga

SEQ ID NO: 2799 - DNA, 201 bp, Homo sapiens
agcttgtttgtgaaacaaaaaagtgttcccttttcaagttgagaacaaaaattgggttttaaaattaaagtatacatttttgcattgccttcggtttgtakttagtgtcttgaatgtaagaacatgacctccgtgtagtgtctgtaataccttagttttttccacagatgcttgtgatttttgaacaatacgtgaaagatg

SEQ ID NO: 2800 - DNA, 201 bp, Homo sapiens
gtgggcgtgttcacagccccaggcctgcacctgaagcagccgtttgtgcagggcctggctctctatacccctgtggtcctcccacgctctctggacttcayagaactggatgttgctgctgagaagattgacaggttcatgcaggctgtgacaggatggaagactggctgctccctgatgggagccagtgtggacagcacc

SEQ ID NO: 2801 - DNA, 201 bp, Homo sapiens
agcagataacaaccccggacaaatcagcgatgtgtcacccccagtctcccaccttttcttctaatgagtcgactttgagctggaaagcagccgtttctccytggtctaagtgtgctgcatggagtgagcagtagaagcctgcagcggcacaaatgcacctcccagtttgctgggtttattttagagaatgggggtggggag

SEQ ID NO: 2802 - DNA, 201 bp, Homo sapiens
cccctgtggatgaaaaggccctacaggaccagctggtgctagtcgctgcaaaacttgacaccgaagacaagttgagggccgcaatggtcgggatgctggcyaacttcttgggcttccgtatatatggcatgcacagtgagctatggggcgtggtccatggggccaccgtcctctccccaacggctgtctttggcaccctgg

SEQ ID NO: 2803 - DNA, 201 bp, Homo sapiens
gacaaatcagcgatgtgtcacccccagtctcccaccttttcttctaatgagtcgactttgagctggaaagcagccgtttctccttggtctaagtgtgctgyatggagtgagcagtagaagcctgcagcggcacaaatgcacctcccagtttgctgggtttattttagagaatgggggtggggaggcaagaaccagtgttta

SEQ ID NO: 2804 - DNA, 201 bp, Homo sapiens
ctccatccccacccctcagctataaatagggcatcgtgacccggccaggggaagaagctgccgttgttctgggtactacagcagaagggtatgcggaagcsagcaccccagtctgagatggctcctgccggtgtgagcctgagggccaccatcctctgcctcctggcctgggctggcctggctgcaggtgaccgggtgtac

SEQ ID NO: 2805 - DNA, 201 bp, Homo sapiens
acctgaatttctgtttgaatgcggaaccatagctggttatttctcccttgtgttagtaataaacgtcttgccacaataagcctccaaaaattttatctttyatttagcagccaaacagatgtatacaattcagcagatagactgtgcaaacgaaagtgctttcctggactttggatggaatttccatgggaggtctgagcc

SEQ ID NO: 2806 - DNA, 201 bp, Homo sapiens
tctcactttccagcaaaactccctcaactggatgaagaaactgtctccccggaccatccacctgaccatgccccaactggtgctgcaaggatcttatgacmtgcaggacctgctcgcccaggctgagctgcccgccattctgcacaccgagctgaacctgcaaaaattgagcaatgaccgcatcagggtgggggaggtgct

SEQ ID NO: 2807 - DNA, 201 bp, Homo sapiens
aatcagcgatgtgtcacccccagtctcccaccttttcttctaatgagtcgactttgagctggaaagcagccgtttctccttggtctaagtgtgctgcatgkagtgagcagtagaagcctgcagcggcacaaatgcacctcccagtttgctgggtttattttagagaatgggggtggggaggcaagaaccagtgtttagcgc

SEQ ID NO: 2808 - DNA, 201 bp, Homo sapiens
gcgcctgcctgctgctgatccagcctcactatgcctctgacctggacaaggtggagggtctcactttccagcaaaactccctcaactggatgaagaaactrtctccccggaccatccacctgaccatgccccaactggtgctgcaaggatcttatgacctgcaggacctgctcgcccaggctgagctgcccgccattctgc

SEQ ID NO: 2809 - DNA, 201 bp, Homo sapiens
aaatcagcgatgtgtcacccccagtctcccaccttttcttctaatgagtcgactttgagctggaaagcagccgtttctccttggtctaagtgtgctgcatkgagtgagcagtagaagcctgcagcggcacaaatgcacctcccagtttgctgggtttattttagagaatgggggtggggaggcaagaaccagtgtttagcg

SEQ ID NO: 2810 - DNA, 201 bp, Homo sapiens
caaatgcacctcccagtttgctgggtttattttagagaatgggggtggggaggcaagaaccagtgtttagcgcgggactactgttccaaaaagaattccarccgaccagcttgtttgtgaaacaaaaaagtgttcccttttcaagttgagaacaaaaattgggttttaaaattaaagtatacatttttgcattgccttcgg

SEQ ID NO: 2811 - DNA, 201 bp, Homo sapiens
gggtttattttagagaatgggggtggggaggcaagaaccagtgtttagcgcgggactactgttccaaaaagaattccaaccgaccagcttgtttgtgaaamaaaaaagtgttcccttttcaagttgagaacaaaaattgggttttaaaattaaagtatacatttttgcattgccttcggtttgtatttagtgtcttgaatg

SEQ ID NO: 2812 - DNA, 201 bp, Homo sapiens; identical to SEQ ID NO: 2780

SEQ ID NO: 2813 - DNA, 201 bp, Homo sapiens; identical to SEQ ID NO: 2783

SEQ ID NO: 2814 - DNA, 201 bp, Homo sapiens; identical to SEQ ID NO: 2784

SEQ ID NO: 2815 - DNA, 201 bp, Homo sapiens; identical to SEQ ID NO: 2788

SEQ ID NO: 2816 - DNA, 201 bp, Homo sapiens; identical to SEQ ID NO: 2787

SEQ ID NO: 2817 - DNA, 201 bp, Homo sapiens; identical to SEQ ID NO: 2789

SEQ ID NO: 2818 - DNA, 201 bp, Homo sapiens; identical to SEQ ID NO: 2790

SEQ ID NO: 2819 - DNA, 201 bp, Homo sapiens; identical to SEQ ID NO: 2791

SEQ ID NO: 2820 - DNA, 201 bp, Homo sapiens; identical to SEQ ID NO: 2792

SEQ ID NO: 2821 - DNA, 201 bp, Homo sapiens
ctgagcacaatcagctgcaggaggtggctgctcagctgaaagcctgtggggacaaaggaggagacccaggactcgctgtatccgagccccgagggtatgcrgaagcgagcaccccagtctgagatggctcctgccggtgtgagcctgagggccaccatcctctgcctcctggcctgggctggcctggctgcaggtgaccgg

SEQ ID NO: 2822 - DNA, 201 bp, Homo sapiens; identical to SEQ ID NO: 2794

SEQ ID NO: 2823 - DNA, 201 bp, Homo sapiens; identical to SEQ ID NO: 2796

SEQ ID NO: 2824 - DNA, 124 bp, Homo sapiens
aaagaaaggcgatgctaagaaacrtgctgcaggggaggctggcacattctgctccttagctaaccgcacaggcccatgggtccacacacatcagaccatggctctctgtggtctatctttgcca

SEQ ID NO: 2825 - DNA, 201 bp, Homo sapiens; identical to SEQ ID NO: 2797

SEQ ID NO: 2826 - DNA, 201 bp, Homo sapiens; identical to SEQ ID NO: 2800

SEQ ID NO: 2827 - DNA, 201 bp, Homo sapiens; identical to SEQ ID NO: 2798

SEQ ID NO: 2828 - DNA, 201 bp, Homo sapiens; identical to SEQ ID NO: 2801

SEQ ID NO: 2829 - DNA, 201 bp, Homo sapiens; identical to SEQ ID NO: 2802

SEQ ID NO: 2830 - DNA, 201 bp, Homo sapiens
acaatcagctgcaggaggtggctgctcagctgaaagcctgtggggacaaaggaggagacccaggactcgctgtatccgagccccgagggtatgcggaagcsagcaccccagtctgagatggctcctgccggtgtgagcctgagggccaccatcctctgcctcctggcctgggctggcctggctgcaggtgaccgggtgtac

SEQ ID NO: 2831 - DNA, 201 bp, Homo sapiens; identical to SEQ ID NO: 2806

SEQ ID NO: 2832 - DNA, 201 bp, Homo sapiens; identical to SEQ ID NO: 2803

SEQ ID NO: 2833 - DNA, 201 bp, Homo sapiens; identical to SEQ ID NO: 2808

SEQ ID NO: 2834 - DNA, 201 bp, Homo sapiens; identical to SEQ ID NO: 2807

SEQ ID NO: 2835 - DNA, 201 bp, Homo sapiens; identical to SEQ ID NO: 2809

SEQ ID NO: 2836 - DNA, 201 bp, Homo sapiens
caaatgcacctcccagtttgctgggtttattttagagaatgggggtggggaggcaagaaccagtgtttagcgcgggactactgttccaaaaagaattccarccgaccagcttgtttgtgaaacaaaaaagtgttcccttttcaagttgagaacaaaaattgggttttaaaaacatgacctccgtgtagtgtctgtaatacc

SEQ ID NO: 2837 - DNA, 201 bp, Homo sapiens
gggtttattttagagaatgggggtggggaggcaagaaccagtgtttagcgcgggactactgttccaaaaagaattccaaccgaccagcttgtttgtgaaamaaaaaagtgttcccttttcaagttgagaacaaaaattgggttttaaaaacatgacctccgtgtagtgtctgtaataccttagttttttccacagatgctt

SEQ ID NO: 2838 - DNA, 201 bp, Homo sapiens
taaatttcactggcatgccacctgcagatgaagattacagcccctgtatgctagaaactgagacactcaacaagtatgttgtgatcatcgcctatgccctrgtgttcctgctgagcctgctgggaaactccctggtgatgctggtcatcttatacagcagggtcggccgctccgtcactgatgtctacctgctgaacctgg

SEQ ID NO: 2839 - DNA, 125 bp, Homo sapiens
tttccctccttggagacagggccctgtcggtttattcactgtatgtccttggtgcctggagcctactaaatgctcaataaataatgatcacaggaatgaaygcatgctgaaaagaccactctttt

SEQ ID NO: 2840 - DNA, 201 bp, Homo sapiens
gtcatctttgctgtcgtcctcatcttcctgctttgctggctgccctacaacctggtcctgctggcagacaccctcatgaggacccaggtgatccaggagasctgtgagcgccgcaacaacatcggccgggccctggatgccactgagattctgggatttctccatagctgcctcaaccccatcatctacgccttcatcggc

SEQ ID NO: 2841 - DNA, 201 bp, Homo sapiens
atttcactggcatgccacctgcagatgaagattacagcccctgtatgctagaaactgagacactcaacaagtatgttgtgatcatcgcctatgccctagtrttcctgctgagcctgctgggaaactccctggtgatgctggtcatcttatacagcagggtcggccgctccgtcactgatgtctacctgctgaacctggcct

SEQ ID NO: 2842 - DNA, 201 bp, Homo sapiens
tgaccaacatcgcagacacatgtgctggccacctgctgagccccaagtggaacgagacaagcagcccttagcccttcccctctgcagcttccaggctggcrtgcagcatcagcatccctagaaagccatgtgcagccaccagtccattgggcaggcagatgttcctaataaagcttctgttccgtgcttgtccctgtggaa

SEQ ID NO: 2843 - DNA, 201 bp, Homo sapiens
tctgggccgcctccaaggtgaatggctggatttttggcacattcctgtgcaaggtggtctcactcctgaaggaagtcaacttctacagtggcatcctgctrttggcctgcatcagtgtggaccgttacctggccattgtccatgccacacgcacactgacccagaagcgtcacttggtcaagtttgtttgtcttggctgct

SEQ ID NO: 2844 - DNA, 201 bp, Homo sapiens
ggggcagaagcaccgagccatgagggtcatctttgctgtcgtcctcatcttcctgctttgctggctgccctacaacctggtcctgctggcagacaccctcmtgaggacccaggtgatccaggagagctgtgagcgccgcaacaacatcggccgggccctggatgccactgagattctgggatttctccatagctgcctcaa

SEQ ID NO: 2845 - DNA, 201 bp, Homo sapiens
ccctgaccttgcccatctgggccgcctccaaggtgaatggctggatttttggcacattcctgtgcaaggtggtctcactcctgaaggaagtcaacttctayagtggcatcctgctgttggcctgcatcagtgtggaccgttacctggccattgtccatgccacacgcacactgacccagaagcgtcacttggtcaagtttg

SEQ ID NO: 2846 - DNA, 201 bp, Homo sapiens
attacagcccctgtatgctagaaactgagacactcaacaagtatgttgtgatcatcgcctatgccctagtgttcctgctgagcctgctgggaaactccctsgtgatgctggtcatcttatacagcagggtcggccgctccgtcactgatgtctacctgctgaacctggccttggccgacctactctttgccctgaccttgc

SEQ ID NO: 2847 - DNA, 201 bp, Homo sapiens
tcatcttatacagcagggtcggccgctccgtcactgatgtctacctgctgaacctggccttggccgacctactctttgccctgaccttgcccatctgggcygcctccaaggtgaatggctggatttttggcacattcctgtgcaaggtggtctcactcctgaaggaagtcaacttctacagtggcatcctgctgttggcct

SEQ ID NO: 2848 - DNA, 201 bp, Homo sapiens
gaagaggacatgtcaaatattacagatccacagatgtgggattttgatgatctaaatttcactggcatgccacctgcagatgaagattacagcccctgtakgctagaaactgagacactcaacaagtatgttgtgatcatcgcctatgccctagtgttcctgctgagcctgctgggaaactccctggtgatgctggtcatc

SEQ ID NO: 2849 - DNA, 201 bp, Homo sapiens
cttgaggcacagaaactcctgttcatgcccatacccctggccaaggaagatccctttgtccacaagtaaaaggaaatgctcctccagggagtctcagcttmaccctgaggtgagcatcatcttctgggttaggccttgcctaggcatagccctgcctcaagctatgtgagctcaccagtccctccccaaatgctttccatg

SEQ ID NO: 2850 - DNA, 201 bp, Homo sapiens
ctgggccgcctccaaggtgaatggctggatttttggcacattcctgtgcaaggtggtctcactcctgaaggaagtcaacttctacagtggcatcctgctgytggcctgcatcagtgtggaccgttacctggccattgtccatgccacacgcacactgacccagaagcgtcacttggtcaagtttgtttgtcttggctgctg

SEQ ID NO: 2851 - DNA, 201 bp, Homo sapiens
tttaactcctgctagaacagtctcttgaggcacagaaactcctgttcatgcccatacccctggccaaggaagatccctttgtccacaagtaaaaggaaatsctcctccagggagtctcagcttcaccctgaggtgagcatcatcttctgggttaggccttgcctaggcatagccctgcctcaagctatgtgagctcaccag

SEQ ID NO: 2852 - DNA, 192 bp, Homo sapiens
aagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaatgcatgctgaaaagaccactctttt

SEQ ID NO: 2853 - DNA, 201 bp, Homo sapiens
tacccgacaggagtgggacttggctaagagcctacagaaaaccatccaagcagcgaggtctgagaattactctctgaccgacttctgggcctacatggttrtctctaagcaaaccagagaactgccggagtctcatttgtccaatatgaagaagcccgtggaagaagggacactaccctacccgatatttgcagccattga

SEQ ID NO: 2854 - DNA, 201 bp, Homo sapiens
ggacttggctaagagcctacagaaaaccatccaagcagcgaggtctgagaattactctctgaccgacttctgggcctacatggttatctctaagcaaaccrgagaactgccggagtctcatttgtccaatatgaagaagcccgtggaagaagggacactaccctacccgatatttgcagccattgacaatgacctgcaacc

SEQ ID NO: 2855 - DNA, 201 bp, Homo sapiens
tccccaagtagaagaggctgagctggatttgtggtccaaggcccccgccagctgctacatcctgaaaggagaaactggaccagtggtgatgcattttcccytgttcaacatagatgcctgtggaggtgatattgaggcatggagtgacacatacgacacattcaagcttgctgacacctacactctagatgtggtggtgct

SEQ ID NO: 2856 - DNA, 201 bp, Homo sapiens
gttggtctactagggccctgaagtccacctggccttcctgttcttcactcccttcagccacacgcttcatggccttgagttcaccttggctgtcctaacarggccaatcaccagtgaccagctagactgtgattttgatagcgtcattcagaagaaggcgtccaaggagctgaaggtggtgaaatttgtcctgcaggtccc

SEQ ID NO: 2857 - DNA, 201 bp, Homo sapiens
aaggcgtccaaggagctgaaggtggtgaaatttgtcctgcaggtccctcgggagatcctggagctggagcatgagtgtctgacaatcagaagcatcatgtycaatgtccagatggccagaatgaatgtgatagttcagaccaatgccttccactgctcctttatgactgcacttctagccagtagctctgcacaagttagc

SEQ ID NO: 2858 - DNA, 201 bp, Homo sapiens
aatgatggtgacatggaagctctcgaggctgacctgaaacatcgatttacccgacaggagtgggacttggctaagagcctacagaaaaccatccaagcagygaggtctgagaattactctctgaccgacttctgggcctacatggttatctctaagcaaaccagagaactgccggagtctcatttgtccaatatgaagaag

SEQ ID NO: 2859 - DNA, 201 bp, Homo sapiens
ggctctactacccgaaggatagtgcccgaagttgctgcttggcatagatgagcctcagcttccagggcactgtgggcctgttggtctactagggccctgawgtccacctggccttcctgttcttcactcccttcagccacacgcttcatggccttgagttcaccttggctgtcctaacagggccaatcaccagtgaccagc

SEQ ID NO: 2860 - DNA, 201 bp, Homo sapiens
ggccaatcaccagtgaccagctagactgtgattttgatagcgtcattcagaagaaggcgtccaaggagctgaaggtggtgaaatttgtcctgcaggtcccycgggagatcctggagctggagcatgagtgtctgacaatcagaagcatcatgtccaatgtccagatggccagaatgaatgtgatagttcagaccaatgcct

SEQ ID NO: 2861 - DNA, 201 bp, Homo sapiens
tctgggcctacatggttatctctaagcaaaccagagaactgccggagtctcatttgtccaatatgaagaagcccgtggaagaagggacactaccctacccratatttgcagccattgacaatgacctgcaaccttcctggcaggaggcaagagcaccagagacctggttcgagttcacccctcaccacgctggcttctctg

SEQ ID NO: 2862 - DNA, 201 bp, Homo sapiens
aagagcctacagaaaaccatccaagcagcgaggtctgagaattactctctgaccgacttctgggcctacatggttatctctaagcaaaccagagaactgcyggagtctcatttgtccaatatgaagaagcccgtggaagaagggacactaccctacccgatatttgcagccattgacaatgacctgcaaccttcctggcag

SEQ ID NO: 2863 - DNA, 201 bp, Homo sapiens
atttacccgacaggagtgggacttggctaagagcctacagaaaaccatccaagcagcgaggtctgagaattactctctgaccgacttctgggcctacatgkttatctctaagcaaaccagagaactgccggagtctcatttgtccaatatgaagaagcccgtggaagaagggacactaccctacccgatatttgcagccat

SEQ ID NO: 2864 - DNA, 201 bp, Homo sapiens
gattactgaggctgcaagaaagttcacaaggggaacatcctcccccagaagatgaaggcggtgagcctgaacacacctggctgactgagatgctcgagaaytggaccaggacctccctggaaaagcaggagcagccccatgaggaccccgaaaggaaaggctcactcagtaacttgatggattttgtgaagaaaacaggca

SEQ ID NO: 2865 - DNA, 201 bp, Homo sapiens
gccatcaacactcccttcccactcgtgctgcccccgacgcgggaggttcacctcatcctctccttcgacttcagtgccggagatcctttcgagaccatccrggctaccactgactactgccgccgccacaagatcccctttccccaagtagaagaggctgagctggatttgtggtccaaggcccccgccagctgctacatc

SEQ ID NO: 2866 - DNA, 201 bp, Homo sapiens
cccgatatttgcagccattgacaatgacctgcaaccttcctggcaggaggcaagagcaccagagacctggttcgagttcacccctcaccacgctggcttcyctgcactgggggcctttgtttccataacccacttcggaagcaaattcaagaagggaagactggtcagaactcaccctgagagagacctgactttcctgag

SEQ ID NO: 2867 - DNA, 201 bp, Homo sapiens
gttgatgaacgtggccgggctctactacccgaaggatagtgcccgaagttgctgcttggcatagatgagcctcagcttccagggcactgtgggcctgttgrtctactagggccctgaagtccacctggccttcctgttcttcactcccttcagccacacgcttcatggccttgagttcaccttggctgtcctaacagggcc

SEQ ID NO: 2868 - DNA, 201 bp, Homo sapiens
gcagccccatgaggaccccgaaaggaaaggctcactcagtaacttgatggattttgtgaagaaaacaggcatttgcgcttcaaagtgggaatgggggaccmctcacaacttcctgtacaaacacgagtttgactcttttcatcagcaagaggaaccattcccagaggtactgtcttagtctgctcaggctgctgtgacaaa

SEQ ID NO: 2869 - DNA, 201 bp, Homo sapiens
tgaagtttccataattcctgggctccagaaagaagaaaaggcggccgtggagagacgaagacttcatgtgctgaaagctctgaagaagctaaggattgagsctgatgaggccccagttgttgctgtgctgggctcaggcggaggactgcgggctcacattgcctgccttggggtcctgagtgagatgaaagaacagggcct

SEQ ID NO: 2870 - DNA, 201 bp, Homo sapiens
ccttcccactcgtgctgcccccgacgcgggaggttcacctcatcctctccttcgacttcagtgccggagatcctttcgagaccatccgggctaccactgaytactgccgccgccacaagatcccctttccccaagtagaagaggctgagctggatttgtggtccaaggcccccgccagctgctacatcctgaaaggagaaa

SEQ ID NO: 2871 - DNA, 201 bp, Homo sapiens; identical to SEQ ID NO: 2853

SEQ ID NO: 2872 - DNA, 201 bp, Homo sapiens; identical to SEQ ID NO: 2854

SEQ ID NO: 2873 - DNA, 201 bp, Homo sapiens; identical to SEQ ID NO: 2855

SEQ ID NO: 2874 - DNA, 201 bp, Homo sapiens; identical to SEQ ID NO: 2856

SEQ ID NO: 2875 - DNA, 201 bp, Homo sapiens; identical to SEQ ID NO: 2857

SEQ ID NO: 2876 - DNA, 201 bp, Homo sapiens; identical to SEQ ID NO: 2858

SEQ ID NO: 2877 - DNA, 201 bp, Homo sapiens; identical to SEQ ID NO: 2861

SEQ ID NO: 2878 - DNA, 201 bp, Homo sapiens; identical to SEQ ID NO: 2862

SEQ ID NO: 2879 - DNA, 201 bp, Homo sapiens; identical to SEQ ID NO: 2863

SEQ ID NO: 2880 - DNA, 201 bp, Homo sapiens; identical to SEQ ID NO: 2860

SEQ ID NO: 2881 - DNA, 201 bp, Homo sapiens; identical to SEQ ID NO: 2859

SEQ ID NO: 2882 - DNA, 201 bp, Homo sapiens; identical to SEQ ID NO: 2865

SEQ ID NO: 2883 - DNA, 201 bp, Homo sapiens; identical to SEQ ID NO: 2864

SEQ ID NO: 2884 - DNA, 201 bp, Homo sapiens; identical to SEQ ID NO: 2866

SEQ ID NO: 2885 - DNA, 201 bp, Homo sapiens; identical to SEQ ID NO: 2867

SEQ ID NO: 2886 - DNA, 201 bp, Homo sapiens
gcagccccatgaggaccccgaaaggaaaggctcactcagtaacttgatggattttgtgaagaaaacaggcatttgcgcttcaaagtgggaatgggggaccmctcacaacttcctgtacaaacacggtggcatccgggacaagataatgagcagccggaagcacctccacctggtggatgctggtttagccatcaacactcc

SEQ ID NO: 2887 - DNA, 201 bp, Homo sapiens; identical to SEQ ID NO: 2869

SEQ ID NO: 2888 - DNA, 201 bp, Homo sapiens; identical to SEQ ID NO: 2870

SEQ ID NO: 2889 - DNA, 201 bp, Homo sapiens; identical to SEQ ID NO: 2853

SEQ ID NO: 2890 - DNA, 201 bp, Homo sapiens; identical to SEQ ID NO: 2854

SEQ ID NO: 2891 - DNA, 201 bp, Homo sapiens; identical to SEQ ID NO: 2855

SEQ ID NO: 2892 - DNA, 201 bp, Homo sapiens; identical to SEQ ID NO: 2856

SEQ ID NO: 2893 - DNA, 201 bp, Homo sapiens; identical to SEQ ID NO: 2857

SEQ ID NO: 2894 - DNA, 201 bp, Homo sapiens; identical to SEQ ID NO: 2858

SEQ ID NO: 2895 - DNA, 201 bp, Homo sapiens; identical to SEQ ID NO: 2861

SEQ ID NO: 2896 - DNA, 201 bp, Homo sapiens; identical to SEQ ID NO: 2862

SEQ ID NO: 2897 - DNA, 201 bp, Homo sapiens; identical to SEQ ID NO: 2863

SEQ ID NO: 2898 - DNA, 201 bp, Homo sapiens; identical to SEQ ID NO: 2860

SEQ ID NO: 2899 - DNA, 201 bp, Homo sapiens; identical to SEQ ID NO: 2859

SEQ ID NO: 2900 - DNA, 201 bp, Homo sapiens; identical to SEQ ID NO: 2865

SEQ ID NO: 2901 - DNA, 201 bp, Homo sapiens; identical to SEQ ID NO: 2864

SEQ ID NO: 2902 - DNA, 201 bp, Homo sapiens; identical to SEQ ID NO: 2866

SEQ ID NO: 2903 - DNA, 201 bp, Homo sapiens; identical to SEQ ID NO: 2867

SEQ ID NO: 2904 - DNA, 201 bp, Homo sapiens; identical to SEQ ID NO: 2886

SEQ ID NO: 2905 - DNA, 201 bp, Homo sapiens; identical to SEQ ID NO: 2869

SEQ ID NO: 2906 - DNA, 201 bp, Homo sapiens; identical to SEQ ID NO: 2870

SEQ ID NO: 2907 - DNA, 201 bp, Homo sapiens; identical to SEQ ID NO: 2858

SEQ ID NO: 2908 - DNA, 188 bp, Homo sapiens
tctgggcctacatggttatctctaagcaaaccagagaactgccggagtctcatttgtccaatatgaagaagcccgtggaagaagggacactaccctacccratatttgcagccattgacaatgacctgcaaccttcctggcaggaggcaagagcaccaggtaagcaaacatttagagggagggagagg

SEQ ID NO: 2909 - DNA, 201 bp, Homo sapiens; identical to SEQ ID NO: 2862

SEQ ID NO: 2910 - DNA, 201 bp, Homo sapiens; identical to SEQ ID NO: 2863

SEQ ID NO: 2911 - DNA, 201 bp, Homo sapiens; identical to SEQ ID NO: 2869

SEQ ID NO: 2912 - DNA, 201 bp, Homo sapiens; identical to SEQ ID NO: 2853

SEQ ID NO: 2913 - DNA, 201 bp, Homo sapiens; identical to SEQ ID NO: 2854

SEQ ID NO: 2914 - DNA, 201 bp, Homo sapiens
gtaaaattctcattggactgtacttcgtgggcctgtacagtgagacatttttcaattgccttctgactgtgcaaaggtacctagtgtttttgcacaagggmaactttttctcagccaggaggagggtgccctgtggcatcattacaagtgtcctggcatgggtaacagccattctggccactttgcctgaattcgtggttt

SEQ ID NO: 2915 - DNA, 201 bp, Homo sapiens
ctagcatccaccaaatgcaagaagaataaacatggattttcatctttctgcattatttcatgtaaattttctacacatttgtatacaaaatcggatacagsaagaaaagggagaggtgagctaacatttgctaagcactgaatttgtctcaggcaccgtgcaaggctctttacaaacgtgagctccttcgcctcctaccac

SEQ ID NO: 2916 - DNA, 201 bp, Homo sapiens
aatataaaggactcaaacgcgtggaaaatatctatcttctaaacttggcagtttctaacttgtgtttcttgcttaccctgcccttctgggctcatgctggkggcgatcccatgtgtaaaattctcattggactgtacttcgtgggcctgtacagtgagacatttttcaattgccttctgactgtgcaaaggtacctagtgt

SEQ ID NO: 2917 - DNA, 201 bp, Homo sapiens
ctaacatttgctaagcactgaatttgtctcaggcaccgtgcaaggctctttacaaacgtgagctccttcgcctcctaccacttgtccatagtgtggatagkactagtctcatttctctgagaagaaaactaaggcgcggaaatttgtctaagatcacataactaggaagtggcagaactgattctccagccctggtagcat

SEQ ID NO: 2918 - DNA, 201 bp, Homo sapiens
tgtcctccccctatttatttttacatttctctatgtgcaaatgagaaaaacactaaggttcagggagcagaggtatagccttttcaagcttgtttttgccrtaatggtagtcttccttctgatgtgggcgccctacaatattgcatttttcctgtccactttcaaagaacacttctccctgagtgactgcaagagcagcta

SEQ ID NO: 2919 - DNA, 201 bp, Homo sapiens
aaatataaaggactcaaacgcgtggaaaatatctatcttctaaacttggcagtttctaacttgtgtttcttgcttaccctgcccttctgggctcatgctgrgggcgatcccatgtgtaaaattctcattggactgtacttcgtgggcctgtacagtgagacatttttcaattgccttctgactgtgcaaaggtacctagtg

SEQ ID NO: 2920 - DNA, 201 bp, Homo sapiens
cacaagggaaactttttctcagccaggaggagggtgccctgtggcatcattacaagtgtcctggcatgggtaacagccattctggccactttgcctgaatwcgtggtttataaacctcagatggaagaccagaaatacaagtgtgcatttagcagaactcccttcctgccagctgatgagacattctggaagcattttctg

SEQ ID NO: 2921 - DNA, 201 bp, Homo sapiens
gaatccaggtccagtttgttgtttcctccaggataaggcagctgtcggaggggaaaatcatctcccatttctccacagggcagtctgaagatggccaattrcacgctggcaccagaggatgaatatgatgtcctcatagaaggtgaactggagagcgatgaggcagagcaatgtgacaagtatgacgcccaggcactctca

SEQ ID NO: 2922 - DNA, 126 bp, Homo sapiens
tgctgctctggggaagtgggcacacrttaaagaaatgtttatttcagtcttctgaaatagggaattactctggctaaaatgtagctccagaaagggaaagtggggctgtatgaatccaggtccagt

SEQ ID NO: 2923 - DNA, 122 bp, Homo sapiens
tgctgctctggggaagtgggcrcacgttaaagaaatgtttatttcagtcttctgaaatagggaattactctggctaaaatgtagctccagaaagggaaagtggggctgtatgaatccaggtc

SEQ ID NO: 2924 - DNA, 201 bp, Homo sapiens
gtgagctccttcgcctcctaccacttgtccatagtgtggataggactagtctcatttctctgagaagaaaactaaggcgcggaaatttgtctaagatcacwtaactaggaagtggcagaactgattctccagccctggtagcatttgctcagagcctacgcttggtccagaacatcaaactccaaaccctggggacaaacg

SEQ ID NO: 2925 - DNA, 201 bp, Homo sapiens
caagggaaactttttctcagccaggaggagggtgccctgtggcatcattacaagtgtcctggcatgggtaacagccattctggccactttgcctgaattcrtggtttataaacctcagatggaagaccagaaatacaagtgtgcatttagcagaactcccttcctgccagctgatgagacattctggaagcattttctgac

SEQ ID NO: 2926 - DNA, 201 bp, Homo sapiens; identical to SEQ ID NO: 2914

SEQ ID NO: 2927 - DNA, 201 bp, Homo sapiens; identical to SEQ ID NO: 2915

SEQ ID NO: 2928 - DNA, 201 bp, Homo sapiens; identical to SEQ ID NO: 2916

SEQ ID NO: 2929 - DNA, 201 bp, Homo sapiens; identical to SEQ ID NO: 2917

SEQ ID NO: 2930 - DNA, 201 bp, Homo sapiens; identical to SEQ ID NO: 2918

SEQ ID NO: 2931 - DNA, 201 bp, Homo sapiens; identical to SEQ ID NO: 2919

SEQ ID NO: 2932 - DNA, 201 bp, Homo sapiens; identical to SEQ ID NO: 2920

SEQ ID NO: 2933 - DNA, 201 bp, Homo sapiens
tgtccggggccattcccacagctcccggatgctgggtctggaggctgcgcccttcccctgcaggagctcagcccagtgggcagtctgaagatggccaattrcacgctggcaccagaggatgaatatgatgtcctcatagaaggtgaactggagagcgatgaggcagagcaatgtgacaagtatgacgcccaggcactctca

SEQ ID NO: 2934 - DNA, 201 bp, Homo sapiens; identical to SEQ ID NO: 2924

SEQ ID NO: 2935 - DNA, 201 bp, Homo sapiens
gcccctcagggtcaggagcagtctgatcaaaaggagggcatccactgtccggggccattcccacagctcccggatgctgggtctggaggctgcgcccttcscctgcaggagctcagcccagtgggcagtctgaagatggccaattacacgctggcaccagaggatgaatatgatgtcctcatagaaggtgaactggagagc

SEQ ID NO: 2936 - DNA, 201 bp, Homo sapiens; identical to SEQ ID NO: 2925

SEQ ID NO: 2937 - DNA, 201 bp, Homo sapiens
gctagtgccctacttggagaagagaataaaggcttctattacatcatgaaagagcttccacaggaaaggctgttaattgctgatgtggcaatttcagctastgaattcatgtttgaagaaaccaggaactatgttaaacaaagaaaagcttttggcaaaacagttgctcacctacagacagtgcaacataaattagcagaa

SEQ ID NO: 2938 - DNA, 201 bp, Homo sapiens
ttttctgaatcttgcctaggtgtttcatttatctctaaaattctaaaaagcataaatcattcaaatcttcaaaccaaggcagaaataattttatgtcgctmtagtataaaaacattaataagatagcacattgacttttaaagggaaaagtaaatataacttagcatgtaaactcatttcggctaccatttgctccaaatt

SEQ ID NO: 2939 - DNA, 201 bp, Homo sapiens
cttctccgagggtccctacgcgtcctgggcggccaccgtgcgccgcgccagctgcccgccgcgcgatgttctcattccggaggggaagaacgtctagaaaytccttctgctaaaaaattaacagatataggaattcgaagaatcttttctccagagcatgacattttccggaaaagtgtaaggaagtttttccaagaagaa

SEQ ID NO: 2940 - DNA, 201 bp, Homo sapiens
cttttttgggaggacaccacaggtggacgcctcagctgatcgtcctccctcccggggaccctgccccgagtcgccgagtagccgcagagtcgcctccgtcsccccgccgcccctgtgtttcggacatggccgcacgccttctccgagggtccctacgcgtcctgggcggccaccgtgcgccgcgccagctgcccgccgcgc

SEQ ID NO: 2941 - DNA, 201 bp, Homo sapiens
aatttcagctagtgaattcatgtttgaagaaaccaggaactatgttaaacaaagaaaagcttttggcaaaacagttgctcacctacagacagtgcaacatmaattagcagaattaaaaacacatatatgtgtaacccgagcatttgtggacaactgtctccagctgcatgaagcgaaacgtttggactccgccactgcttg

SEQ ID NO: 2942 - DNA, 201 bp, Homo sapiens
cgctctgtggcaggcggtggacgctgctgaagctctggctctgagctcaccgctccgccgtccgtgggaccaagcccagcattttacaaacccagctcctktctccaagggtcctcagagcgcccctccgtcaccccctgcagggcgccgcagacgaggcgctgaccttgcgctcgctcccctcgctggggaaggacacac

SEQ ID NO: 2943 - DNA, 201 bp, Homo sapiens
ctgctggggctcaggctgtggggcaggctgggcagggggctgagctggcagcgattcagagccctggggctgggggctggaatccacctcctcccacacargctcggtggtgactcttcggcccctggggaaaaacaaaaagatattgctgagatgacctcttttaaaagcaaagcccccctccccatacaccccaagcct

SEQ ID NO: 2944 - DNA, 201 bp, Homo sapiens
agggaggctgggagagcagcaagggggaccaggtgcgccatcaggaggagagaagctaaacctaggggggacatggagggcggttgttgcctctcccggcrtttctcctcagtctcctgtccaatttcttgctggtggtcagcaggcatagggaggcaggagggaaggaagctttacctgtaaaatggtgtatatatgtat

SEQ ID NO: 2945 - DNA, 201 bp, Homo sapiens
ccagcattttacaaacccagctcctgtctccaagggtcctcagagcgcccctccgtcaccccctgcagggcgccgcagacgaggcgctgaccttgcgctcrctcccctcgctggggaaggacacactcgctggcgtcagcccggccggcctgggaagtaggactaaggacccgaactgcaaccctccacaccagacagcac

SEQ ID NO: 2946 - DNA, 201 bp, Homo sapiens
cacgaatgagatctttgcaatgagcaaacgaaagtggcgcggatttcggggcgcccagcaggagcgagcgcagccgccagccgcaagtccgcagccgtgtyccgcgccccacgccggcctccccggcggcagccggagacgagcgccagcaccggcgggacagcagcagatgcgggccgagagccggtcaggggcgcagag

SEQ ID NO: 2947 - DNA, 201 bp, Homo sapiens
ccagcattttacaaacccagctcctgtctccaagggtcctcagagcgcccctccgtcaccccctgcagggcgccgcagacgaggcgctgaccttgcgctcrctcccctcgctggggaaggacacactcgctggcgtcaccggccggcctgggaagtaggactaaggacccgaactgcaaccctccacaccagacagcacag

SEQ ID NO: 2948 - DNA, 201 bp, Homo sapiens; identical to SEQ ID NO: 2942

SEQ ID NO: 2949 - DNA, 201 bp, Homo sapiens
agggaggctgggagagcagcaagggggaccaggtgcgccatcaggaggagagaagctaaacctaggggggacatggagggccgttgttgcctctcccggcrtttctcctcagtctcctgtccaatttcttgctggtggtcagcaggcatagggaggcaggagggaaggaagctttacctgtaaaatggtgtatatatgtat

SEQ ID NO: 2950 - DNA, 201 bp, Homo sapiens; identical to SEQ ID NO: 2946

SEQ ID NO: 2951 - DNA, 201 bp, Homo sapiens
ctgctggggctcaggctgtggggcaggctgggcagggggctgagctggcagcgattcagagccctggggctgggggctggaatccacctcctcccacacargctcggtggtgactcttcggcccctggggaaaaacaaaaagatattgctgagatgacctcttttaaaagcaaagcccccctccccatacaccccaggcct

SEQ ID NO: 2952 - DNA, 201 bp, Homo sapiens
gggagccggctggggttgccggcaccatggagtcaccttttagcccgggactctttcacaggctggatgaagattgggattctgctctctttgctgaactyggttatttcacagacactgatgagctgcaattggaagcagcaaatgagacgtatgaaaacaattttgataatcttgattttgatttggatttgatgcctt

SEQ ID NO: 2953 - DNA, 201 bp, Homo sapiens
ttcttcaactcagcatgttcctgaggagttggatttgtcttctagttctcagatgtctcccctttccttatatggtgaaaactctaatagtctctcttcascggagccactgaaggaagataagcctgtcactggtcctaggaacaagactgaaaatggactgactccaaagaaaaaaattcaggtgaattcaaaaccttc

SEQ ID NO: 2954 - DNA, 201 bp, Homo sapiens
tgaactcggttatttcacagacactgatgagctgcaattggaagcagcaaatgagacgtatgaaaacaattttgataatcttgattttgatttggatttgrtgccttgggagtcagacatttgggacatcaacaaccaaatctgtacagttaaagatattaaggcagaacctcagccactttctccagcctcctcaagtta

SEQ ID NO: 2955 - DNA, 201 bp, Homo sapiens
atgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgtta

SEQ ID NO: 2956 - DNA, 201 bp, Homo sapiens
cagatattaatcacggagttccagggagaaggaacttgtgaaatgggggagccggctggggttgccggcaccatggagtcaccttttagcccgggactctytcacaggctggatgaagattgggattctgctctctttgctgaactcggttatttcacagacactgatgagctgcaattggaagcagcaaatgagacgtat

SEQ ID NO: 2957 - DNA, 201 bp, Homo sapiens
tctttgagatgaggggacaggattctcctaagggtagagtttcaggaaatgagtgaaaggcaattgacaaatgcaaagaagtagtcactttttaaattgcyggcaaagctataattaatccctaggcacaattgtagtttttattttaatgtttgtatgcacaaggccctttaggaaatgagaagttgccatgccagatta

SEQ ID NO: 2958 - DNA, 201 bp, Homo sapiens
gacagaatcacaggagaaggacccatctcgtggccttcttgttcttagcgcttcacttttacttcatccctcgattcccagctttttctatcatcattttrccaactcctcagatgcaagactttggttatgtcatactcaccaacgttagtccctctcttccaggtgaaaaggtgggtagcggttgggagggagtctcca

SEQ ID NO: 2959 - DNA, 201 bp, Homo sapiens
ctttattgttgtgttacctgggagtctggagtttgaaaagtgctaattaaccttcctctttttccacattacaaacctttttaagcagcgcagcactcccyttagatttggctatcctgggtgattttcagacaagaaccattttctctggggaccattcttctgctgggtgccaaggaatataaggcaaatgcccagaag

SEQ ID NO: 2960 - DNA, 201 bp, Homo sapiens
gtcttctagttctcagatgtctcccctttccttatatggtgaaaactctaatagtctctcttcagcggagccactgaaggaagataagcctgtcactggtyctaggaacaagactgaaaatggactgactccaaagaaaaaaattcaggtgaattcaaaaccttcaattcagcccaagcctttattgcttccagcagcacc

SEQ ID NO: 2961 - DNA, 201 bp, Homo sapiens
ctgagcgtgggaccctgccagactgaagagcaggtgagcaaaatgctgctttctgccttggtggcaggcagagaactgtctcgtactagaattcaaggagraaagaagaagaaataaaagaagctgctccatttttcatcatctacccatctatttggaaagcactggaattcagatgcaagagaacaatgtttcttcagt

SEQ ID NO: 2962 - DNA, 201 bp, Homo sapiens
aaaactctcaagctctttgccactttcctactattttttgattcttgccattttaccaagcttaggttgtgaaacttgacagaaatgtattacaggaaaarcttataattgtatttgactttctaacacattgcaaagtttcaaagtgactttcactttcaacaacatattagaagtaaccacttttgctttcacagcctg

SEQ ID NO: 2963 - DNA, 201 bp, Homo sapiens
acagatatgatcattctgtttcaaatgacaaagccctgatggtgctaactgaagaaccattgctttacattcctccacctccttgtcagcccctaattaayacaacagagtctctcaggttaaatcatgaacttcgaggatgggttcatagacatgaagtagaaaggaccaagtcaagaagaatgacaaataatcaacaga

SEQ ID NO: 2964 - DNA, 201 bp, Homo sapiens
gacttatgcccagcagtacagggacacagcttcattagagtgttagtgtaaactaactccaaagttaggagttaatgtgaaaggatcatccttgaaacaartctgctgtttgccatgcttgtagtacagaaacttcacatggagttttgggtgggatttgtgttttcacaagtaaaaaatccctcacgattataaaactca

SEQ ID NO: 2965 - DNA, 201 bp, Homo sapiens
gcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagagaaccagaggcttaaagtccctagtccaaagcgaag

SEQ ID NO: 2966 - DNA, 201 bp, Homo sapiens
ttgtgctctttgggctgacaataatacactcttgggaagtgatggtagagactgatgggaatagtctttctgcctggttgcaagtcccaaatttttaaggsttaatggaagtaagtggatgtttcctcatgttaactactgaatcagatgttaggagcttgtccctttggggttgacttatgcccagcagtacagggacac

SEQ ID NO: 2967 - DNA, 121 bp, Homo sapiens
gcaaaagtagtttgtctttamtaggccaccgtctcgtcagcgttacggagtattttgtccgcctgccgccgccgtcccagatattaatcacggagttccagggagaaggaacttgtgaaat

SEQ ID NO: 2968 - DNA, 201 bp, Homo sapiens
acataaatgagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatcc

SEQ ID NO: 2969 - DNA, 201 bp, Homo sapiens
caaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctatgccacacatgcatgttca

SEQ ID NO: 2970 - DNA, 104 bp, Homo sapiens
gcaraagtagtttgtctttactaggccaccgtctcgtcagcgttacggagtattttgtccgcctgccgccgccgtcccagatattaatcacggagttccaggga

SEQ ID NO: 2971 - DNA, 201 bp, Homo sapiens
ttgataatcttgattttgatttggatttgatgccttgggagtcagacatttgggacatcaacaaccaaatctgtacagttaaagatattaaggcagaaccycagccactttctccagcctcctcaagttattcagtctcgtctcctcggtcagtggactcttattcttcaactcagcatgttcctgaggagttggatttgt

SEQ ID NO: 2972 - DNA, 201 bp, Homo sapiens
agtcagacatttgggacatcaacaaccaaatctgtacagttaaagatattaaggcagaacctcagccactttctccagcctcctcaagttattcagtctcrtctcctcggtcagtggactcttattcttcaactcagcatgttcctgaggagttggatttgtcttctagttctcagatgtctcccctttccttatatggtg

SEQ ID NO: 2973 - DNA, 201 bp, Homo sapiens; identical to SEQ ID NO: 2965

SEQ ID NO: 2974 - DNA, 201 bp, Homo sapiens
aagatattaatcacggagttccagggaaaaggaacttgtgaaatgggggagccggctggggttgccggcaccatggagtcaccttttagcccgggactctytcacaggctggatgaagattgggattctgctctctttgctgaacttggttatttcacagacactgatgagctgcaattggaagcagcaaatgagacgtat

SEQ ID NO: 2975 - DNA, 201 bp, Homo sapiens
tgaacttggttatttcacagacactgatgagctgcaattggaagcagcaaatgagacgtatgaaaacaattttgataatcttgattttgatttggatttgrtaccttgggagtcagacatttgggacatcaacaaccaaatctgtacagttaaagatattaaggcagaaccccagccactttctccagcctcctcaagtta

SEQ ID NO: 2976 - DNA, 201 bp, Homo sapiens
gtcttctagttctcagatgtctcccctttccttatatggtgaaaactctaatagtctctcttcaccggagccactgaaggaagataagcctgtcactggtyctaggaacaagactgaaaatggactgactccaaagaaaaaaattcaggtgaattcaaaaccttcaattcagcccaagcctttattgcttccagcagcacc

SEQ ID NO: 2977 - DNA, 201 bp, Homo sapiens
ttgataatcttgattttgatttggatttgttaccttgggagtcagacatttgggacatcaacaaccaaatctgtacagttaaagatattaaggcagaaccycagccactttctccagcctcctcaagttattcagtctcatctcctcggtcagtggactcttattcttcaactcagcatgttcctgaggagttggatttgt

SEQ ID NO: 2978 - DNA, 201 bp, Homo sapiens
agtcagacatttgggacatcaacaaccaaatctgtacagttaaagatattaaggcagaaccccagccactttctccagcctcctcaagttattcagtctcrtctcctcggtcagtggactcttattcttcaactcagcatgttcctgaggagttggatttgtcttctagttctcagatgtctcccctttccttatatggtg

SEQ ID NO: 2979 - DNA, 201 bp, Homo sapiens; identical to SEQ ID NO: 2968

SEQ ID NO: 2980 - DNA, 200 bp, Homo sapiens
caaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctaaaaaaaaaaaaaaaaaaa

SEQ ID NO: 2981 - DNA, 201 bp, Homo sapiens
gggagccggctggggttgccggcaccatggagtcaccttttagcccgggactctttcacaggctggatgaagattgggattctgctctctttgctgaactyggttatttcacagacactgatgagctgcaattggaagcagcaaatgagacgtatgaaaacaattttgataatcttgattttgatttggatttgttacctt

SEQ ID NO: 2982 - DNA, 201 bp, Homo sapiens
ttcttcaactcagcatgttcctgaggagttggatttgtcttctagttctcagatgtctcccctttccttatatggtgaaaactctaatagtctctcttcascggagccactgaaggaagataagcctgtcactggttctaggaacaagactgaaaatggactgactccaaagaaaaaaattcaggtgaattcaaaaccttc

SEQ ID NO: 2983 - DNA, 201 bp, Homo sapiens
ctgagcgtgggacccccagactgaagagcaggtgagcaaaatgctgcttttccttggtggcaggcagagaactgttcgtactagaattcaaggagaaaagragaagaaataaaagaagctgctccatttttcatcatctacccatctatttggaaagcactggaattcagatgcaagagaacaatgtttcttcagtggcaa

SEQ ID NO: 2984 - DNA, 201 bp, Homo sapiens
acagatatgatcattctgtttcaaatgacaaagccctgatggtgctaactgaagaaccattgctttacattcccccacctccttgtcagcccctaattaayacaacagagtctctcaggttaaatcatgaacttcgaggatgggttcatagacatgaagtagaaaggaccaagtctagaagaatgacaaataatcaacaga

SEQ ID NO: 2985 - DNA, 201 bp, Homo sapiens
cgctccacagtcatccggctgaagaagacctgttggactggatcttctcgggttttctttcagatattgttttgtatttacccatgaagacattgtttttyggactctgcaaataggacatttcaaagatgagtgaaaaaaaattggaaacaactgcacagcagcggaaatgtcctgaatggatgaatgtgcagaataaaa

SEQ ID NO: 2986 - DNA, 201 bp, Homo sapiens
gaaaaaaaattggaaacaactgcacagcagcggaaatgtcctgaatggatgaatgtgcagaataaaagatgtgctgtagaagaaagaaaggcatgtgttcrgaagagtgtttttgaagatgacctccccttcttagaattcactggatccattgtgtatagttacgatgctagtgattgctctttcctgtcagaagatatt

SEQ ID NO: 2987 - DNA, 201 bp, Homo sapiens
tcaaagatgagtgaaaaaaaattggaaacaactgcacagcagcggaaatgtcctgaatggatgaatgtgcagaataaaagatgtgctgtagaagaaagaarggcatgtgttcggaagagtgtttttgaagatgacctccccttcttagaattcactggatccattgtgtatagttacgatgctagtgattgctctttcctg

SEQ ID NO: 2988 - DNA, 201 bp, Homo sapiens
taggaattgaaggagatcagtggaaacttctacgtgactttgatatcaaattgaagaattttgtggagttgacagatgttgccaataaaaagctgaaatgyacagagacctggagccttaacagtctggttaaacacctcttaggtaaacagctcctgaaagacaagtctatccgctgtagcaattggagtaaatttcctc

SEQ ID NO: 2989 - DNA, 201 bp, Homo sapiens
tagctaaacatgatggagaagatgtacttggaaataaagtggaacgaaaagaagatggatttgaagatggagtagaagacaacaaattgaaagagaatatrgaaagagcttgtttgatgtcgttagatattacagaacatgaactccaaattttggaacagcagtctcaggaagaatatcttagtgatattgcttataaat

SEQ ID NO: 2990 - DNA, 201 bp, Homo sapiens
ttgtacgttgcttaaatctgagaaatcctcagatcacctgtactggttttgatcgaccaaacctgtatttagaagttaggcgaaaaacagggaatatcctkcaggatctgcagccatttcttgtcaaaacaagttcccactgggaatttgaaggtccaacaatcatctactgtccttctagaaaaatgacacaacaagtta

SEQ ID NO: 2991 - DNA, 201 bp, Homo sapiens
gcgcccttacgaaaaagggtagaaattggcttcataaagctaatacagaatctcagagcctcatccttcaagctaatgaagaattgtgtccaaagaagttkcttctgcctagttcgaaaactgtatcttcgggcaccaaagagcattgttataatcaagtaccagttgaattaagtacagagaagaagtctaacttggaga

SEQ ID NO: 2992 - DNA, 201 bp, Homo sapiens
ttgtcaaaacaagttcccactgggaatttgaaggtccaacaatcatctactgtccttctagaaaaatgacacaacaagttacaggtgaacttaggaaactkaatctatcctgtggaacataccatgcgggcatgagttttagcacaaggaaagacattcatcataggtttgtaagagatgaaattcagtgtgtcatagcta

SEQ ID NO: 2993 - DNA, 201 bp, Homo sapiens
atcaatactgagacttcatctgcagagagaaagagacgattacctgtgtggtttgccaaaggaagtgataccagcaagaaattaatggacaaaacgaaaasgggaggtctttttagttaagctggcaattaccagaacaattatgtttcttgctgtattataagaggatagctatattttatttctgaagagtaaggagta

SEQ ID NO: 2994 - DNA, 201 bp, Homo sapiens
atcatttagctaaacatgatggagaagatgtacttggaaataaagtggaacgaaaagaagatggatttgaagatggagtagaagacaacaaattgaaagaraatatggaaagagcttgtttgatgtcgttagatattacagaacatgaactccaaattttggaacagcagtctcaggaagaatatcttagtgatattgctt

SEQ ID NO: 2995 - DNA, 201 bp, Homo sapiens
atttgacatggagtggccaccattatacaatagagggaaacttggcaaagttgcactaattcagttgtgtgtttctgagagcaaatgttacttgttccacrtttcttccatgtcagtttttccccagggattaaaaatgttgcttgaaaataaagcagttaaaaaggcaggtgtaggaattgaaggagatcagtggaaact

SEQ ID NO: 2996 - DNA, 201 bp, Homo sapiens
cctaatcagaatgttagttcctgaaaacattgacacgtaccttatccacatggcaattgagatccttaaacatggtcctgacagcggacttcaaccttcaygtgatgtcaacaaaaggagatgttttcccggttctgaagagatctgttcaagttctaagagaagcaaggaagaagtaggcatcaatactgagacttcatc

SEQ ID NO: 2997 - DNA, 201 bp, Homo sapiens
tcaacctcttttgtgtatcccaccagacttttttatattcatttgtttttaggtaaaatataaaagtctcgtatattcccatttttctgcattgcattachagaaggtagtggcgcctattaaatatgtgatatgttgttgtccagccatggcttctgcatttgcatgcttttgtgtgtgcatctgcaataccctgtgaat

SEQ ID NO: 2998 - DNA, 201 bp, Homo sapiens
atatgagtaaaattagcctaatcagaatgttagttcctgaaaacattgacacgtaccttatccacatggcaattgagatccttaaacatggtcctgacagyggacttcaaccttcatgtgatgtcaacaaaaggagatgttttcccggttctgaagagatctgttcaagttctaagagaagcaaggaagaagtaggcatca

SEQ ID NO: 2999 - DNA, 201 bp, Homo sapiens
aaaatgaaaataaaaatcattcatagttttactagtagctaatcacagtcaacctcttttgtgtatcccaccagacttttttatattcatttgtttttagktaaaatataaaagtctcgtatattcccatttttctgcattgcattaccagaaggtagtggcgcctattaaatatgtgatatgttgttgtccagccatggc

SEQ ID NO: 3000 - DNA, 201 bp, Homo sapiens
aagggtagaaattggcttcataaagctaatacagaatctcagagcctcatccttcaagctaatgaagaattgtgtccaaagaagttgcttctgcctagttygaaaactgtatcttcgggcaccaaagagcattgttataatcaagtaccagttgaattaagtacagagaagaagtctaacttggagaagttatattcttat

SEQ ID NO: 3001 - DNA, 201 bp, Homo sapiens; identical to SEQ ID NO: 2985

SEQ ID NO: 3002 - DNA, 201 bp, Homo sapiens; identical to SEQ ID NO: 2986

SEQ ID NO: 3003 - DNA, 201 bp, Homo sapiens; identical to SEQ ID NO: 2987

SEQ ID NO: 3004 - DNA, 201 bp, Homo sapiens; identical to SEQ ID NO: 2988

SEQ ID NO: 3005 - DNA, 201 bp, Homo sapiens; identical to SEQ ID NO: 2989

SEQ ID NO: 3006 - DNA, 201 bp, Homo sapiens; identical to SEQ ID NO: 2990

SEQ ID NO: 3007 - DNA, 201 bp, Homo sapiens; identical to SEQ ID NO: 2991

SEQ ID NO: 3008 - DNA, 201 bp, Homo sapiens; identical to SEQ ID NO: 2992

SEQ ID NO: 3009 - DNA, 201 bp, Homo sapiens; identical to SEQ ID NO: 2993

SEQ ID NO: 3010 - DNA, 201 bp, Homo sapiens; identical to SEQ ID NO: 2994

SEQ ID NO: 3011 - DNA, 201 bp, Homo sapiens; identical to SEQ ID NO: 2995

SEQ ID NO: 3012 - DNA, 201 bp, Homo sapiens; identical to SEQ ID NO: 2996

SEQ ID NO: 3013 - DNA, 201 bp, Homo sapiens; identical to SEQ ID NO: 2997

SEQ ID NO: 3014 - DNA, 201 bp, Homo sapiens; identical to SEQ ID NO: 2998

SEQ ID NO: 3015 - DNA, 201 bp, Homo sapiens; identical to SEQ ID NO: 2999

SEQ ID NO: 3016 - DNA, 201 bp, Homo sapiens; identical to SEQ ID NO: 3000

SEQ ID NO: 3017 - DNA, 201 bp, Homo sapiens; identical to SEQ ID NO: 2985

SEQ ID NO: 3018 - DNA, 201 bp, Homo sapiens; identical to SEQ ID NO: 2986

SEQ ID NO: 3019 - DNA, 201 bp, Homo sapiens; identical to SEQ ID NO: 2987

SEQ ID NO: 3020 - DNA, 201 bp, Homo sapiens; identical to SEQ ID NO: 2988

SEQ ID NO: 3021 - DNA, 201 bp, Homo sapiens; identical to SEQ ID NO: 2989

SEQ ID NO: 3022 - DNA, 201 bp, Homo sapiens; identical to SEQ ID NO: 2990

SEQ ID NO: 3023 - DNA, 201 bp, Homo sapiens; identical to SEQ ID NO: 2991

SEQ ID NO: 3024 - DNA, 201 bp, Homo sapiens; identical to SEQ ID NO: 2992

SEQ ID NO: 3025 - DNA, 201 bp, Homo sapiens; identical to SEQ ID NO: 2993

SEQ ID NO: 3026 - DNA, 201 bp, Homo sapiens; identical to SEQ ID NO: 2994

SEQ ID NO: 3027 - DNA, 201 bp, Homo sapiens; identical to SEQ ID NO: 2995

SEQ ID NO: 3028 - DNA, 201 bp, Homo sapiens; identical to SEQ ID NO: 2996

SEQ ID NO: 3029 - DNA, 201 bp, Homo sapiens; identical to SEQ ID NO: 2997

SEQ ID NO: 3030 - DNA, 201 bp, Homo sapiens; identical to SEQ ID NO: 2998

SEQ ID NO: 3031 - DNA, 201 bp, Homo sapiens; identical to SEQ ID NO: 2999

SEQ ID NO: 3032 - DNA, 201 bp, Homo sapiens; identical to SEQ ID NO: 3000

SEQ ID NO: 3033 - DNA, 201 bp, Homo sapiens; identical to SEQ ID NO: 2992

SEQ ID NO: 3034 - DNA, 201 bp, Homo sapiens; identical to SEQ ID NO: 2998

SEQ ID NO: 3035 - DNA, 201 bp, Homo sapiens; identical to SEQ ID NO: 2996

SEQ ID NO: 3036 - DNA, 201 bp, Homo sapiens; identical to SEQ ID NO: 2985

SEQ ID NO: 3037 - DNA, 201 bp, Homo sapiens; identical to SEQ ID NO: 2987

SEQ ID NO: 3038 - DNA, 201 bp, Homo sapiens; identical to SEQ ID NO: 2986

SEQ ID NO: 3039 - DNA, 201 bp, Homo sapiens; identical to SEQ ID NO: 2990

SEQ ID NO: 3040 - DNA, 201 bp, Homo sapiens; identical to SEQ ID NO: 2989

SEQ ID NO: 3041 - DNA, 201 bp, Homo sapiens; identical to SEQ ID NO: 2993

SEQ ID NO: 3042 - DNA, 201 bp, Homo sapiens; identical to SEQ ID NO: 2994

SEQ ID NO: 3043 - DNA, 201 bp, Homo sapiens; identical to SEQ ID NO: 2988

SEQ ID NO: 3044 - DNA, 201 bp, Homo sapiens
aagggtagaaattggcttcataaagctaatacagaatctcagagcctcatccttcaagctaatgaagaattgtgtccaaagaagtttcttctgcctagttygaaaactgtatcttcgggcaccaaagagcattgttataatcaagtaccagttgaattaagtacagagaagaagtctaacttggagaagttatattcttat

SEQ ID NO: 3045 - DNA, 201 bp, Homo sapiens; identical to SEQ ID NO: 2995

SEQ ID NO: 3046 - DNA, 201 bp, Homo sapiens; identical to SEQ ID NO: 2991

SEQ ID NO: 3047 - DNA, 201 bp, Homo sapiens
gcttctgtcctctgggctggggtggccagcctgctcctccccccggccatgacccagcagctcagaggggatgggctgggcttcagaaaccggaacaacarcactggagtcgccgggctctccgaggaggcatcagcagagcttcgccaccacctccacagccctagagaccatccagatgagaacaaggatgtttccaca

SEQ ID NO: 3048 - DNA, 201 bp, Homo sapiens
aagggacaaagaccccaacgtttgtccacattgccgcagaggcagctggagccagtgctgcctgtccgtccccatgggccaccataggccatggctgcacrcttctgtcctctgggctggggtggccagcctgctcctccccccggccatgacccagcagctcagaggggatgggctgggcttcagaaaccggaacaacaa

SEQ ID NO: 3049 - DNA, 201 bp, Homo sapiens
gccaccataggccatggctgcacgcttctgtcctctgggctggggtggccagcctgctcctccccccggccatgacccagcagctcagaggggatgggctrggcttcagaaaccggaacaacaacactggagtcgccgggctctccgaggaggcatcagcagagcttcgccaccacctccacagccctagagaccatccag

SEQ ID NO: 3050 - DNA, 201 bp, Homo sapiens
agctggagccagtgctgcctgtccgtccccatgggccaccataggccatggctgcacgcttctgtcctctgggctggggtggccagcctgctcctcccccyggccatgacccagcagctcagaggggatgggctgggcttcagaaaccggaacaacaacactggagtcgccgggctctccgaggaggcatcagcagagctt

SEQ ID NO: 3051 - DNA, 201 bp, Homo sapiens
ggaagaggaggaggaggaggggctggaggaagatgagccccgcttcaccatcatccccaacccactggacaggagagaggaggctggaggtgcctccagcraggaggaaagcggtgaggacacaggtccacaggatgctcaggagtatgggaactaccagccagggtccctgtgtggctactgctccttctgcaatcgatg

SEQ ID NO: 3052 - DNA, 201 bp, Homo sapiens
cagccctagagaccatccagatgagaacaaggatgtttccacagagaatgggcatcatttctggagccacccagaccgtgaaaaggaggatgaagatgtckccaaggaatatgggcacctactcccaggccacaggtcccaagaccacaaagtcggagatgagggtgtctcaggtgaggaggtctttgcagagcatggtgg

SEQ ID NO: 3053 - DNA, 201 bp, Homo sapiens
atgaggatgtgtccactgaacgttggcaccagggtccccaacatgtccaccatggccttgtagatgaggaagaggaagaagaggagatcacagtccagttyggccactatgttgcaagccaccaacctcgaggccacaagagtgatgaagaggacttccaagatgagtataaaacagaagtccctcaccatcaccaccaca

SEQ ID NO: 3054 - DNA, 201 bp, Homo sapiens
caggccacaggtcccaagaccacaaagtcggagatgagggtgtctcaggtgaggaggtctttgcagagcatggtgggcaggcccgtgggcacagaggccaygggagtgaagacacggaagactcagctgagcacaggcaccacctccccagccacaggagccacagccatcaagacgaggatgaggatgaagttgtgtcca

SEQ ID NO: 3055 - DNA, 201 bp, Homo sapiens; identical to SEQ ID NO: 3054

SEQ ID NO: 3056 - DNA, 201 bp, Homo sapiens
aagggacaaagaccccaacgtttgtccacattgccgcagaggcagctggagccagtgctgcctgtccgtccccatgggccaccataggccatggctgcacrcttctgtcctctgggctggggtggccagcctgctcctccccccggccatgacccagcagctcagaggggatgggctaggcttcagaaaccggaacaacag

SEQ ID NO: 3057 - DNA, 201 bp, Homo sapiens
agctggagccagtgctgcctgtccgtccccatgggccaccataggccatggctgcacgcttctgtcctctgggctggggtggccagcctgctcctcccccyggccatgacccagcagctcagaggggatgggctaggcttcagaaaccggaacaacagcactggagtcgccgggctctccgaggaggcatcagcagagctt

SEQ ID NO: 3058 - DNA, 201 bp, Homo sapiens; identical to SEQ ID NO: 3051

SEQ ID NO: 3059 - DNA, 201 bp, Homo sapiens; identical to SEQ ID NO: 3053

SEQ ID NO: 3060 - DNA, 201 bp, Homo sapiens
gcttctgtcctctgggctggggtggccagcctgctcctccccccggccatgacccagcagctcagaggggatgggctaggcttcagaaaccggaacaacarcactggagtcgccgggctctccgaggaggcatcagcagagcttcgccaccacctccacagccctagagaccatccagatgagaacaaggatgtttccaca

SEQ ID NO: 3061 - DNA, 201 bp, Homo sapiens
gccaccataggccatggctgcacgcttctgtcctctgggctggggtggccagcctgctcctccccccggccatgacccagcagctcagaggggatgggctrggcttcagaaaccggaacaacagcactggagtcgccgggctctccgaggaggcatcagcagagcttcgccaccacctccacagccctagagaccatccag

SEQ ID NO: 3062 - DNA, 201 bp, Homo sapiens; identical to SEQ ID NO: 3052

SEQ ID NO: 3063 - DNA, 201 bp, Homo sapiens
cctctaaaacatccaagcttaccttcaaggagagcatggtggtagtagcaaccaacgggaaggttctgaagaagagacggttgagtttaagccaatccatyactgatgatgacctggaggccatcgccaatgactcagaggaagaaatcatcaagcctaggtcagcaccttttagcttcctgagcaatgtgaaatacaact

SEQ ID NO: 3064 - DNA, 201 bp, Homo sapiens
tctgaagaagagacggttgagtttaagccaatccatcactgatgatgacctggaggccatcgccaatgactcagaggaagaaatcatcaagcctaggtcakcaccttttagcttcctgagcaatgtgaaatacaactttatgaggatcatcaaatacgaattcatcctgaatgacgccctcaatcaaagtataattcgagc

SEQ ID NO: 3065 - DNA, 112 bp, Homo sapiens
accaggcaacaycattgaaggctcatatgtaaaaatccatgccttcctttctcccaatctccattcccaaacttagccactggcttctggctgaggccttacgcatacctcc

SEQ ID NO: 3066 - DNA, 201 bp, Homo sapiens
caggggggccaccctctatcactgactttcagatactggaaaaccaggcgtaggtctggagtctcacttgtctcacttgtgcagtgttgacagttcatatrtaccatgtacatgaagaagctaaatcctttactgttagtcatttgctgagcatgtactgagccttgtaattctaaatgaatgtttacactctttgtaaga

SEQ ID NO: 3067 - DNA, 201 bp, Homo sapiens
agaggaagaaatcatcaagcctaggtcagcaccttttagcttcctgagcaatgtgaaatacaactttatgaggatcatcaaatacgaattcatcctgaatracgccctcaatcaaagtataattcgagccaatgatcagtacctcacggctgctgcattacataatctggatgaagcagtgaaatttgacatgggtgctta

SEQ ID NO: 3068 - DNA, 201 bp, Homo sapiens
aattaaggcataagaaaactaagaaatatgcacaatagcagttgaaacaagaagccacagacctaggatttcatgatttcatttcaactgtttgccttctrcttttaagttgctgatgaactcttaatcaaatagcataagtttctgggacctcagttttatcattttcaaaatggagggaataatacctaagccttcctg

SEQ ID NO: 3069 - DNA, 201 bp, Homo sapiens
cagttttatcattttcaaaatggagggaataatacctaagccttcctgccgcaacagttttttatgctaatcagggaggtcattttggtaaaatacttctygaagccgagcctcaagatgaaggcaaagcacgaaatgttattttttaattattatttatatatgtatttataaatatatttaagataattataatatact

SEQ ID NO: 3070 - DNA, 201 bp, Homo sapiens
acctgtaatcatataataaatgtacattaattaccttgagccagtaattggtccgatctttgactcttttgccattaaacttacctgggcattcttgttthaattccacctgcaatcaagtcctacaagctaaaattagatgaactcaactttgacaaccatgagaccactgttatcaaaactttcttttctggaatgtaa

SEQ ID NO: 3071 - DNA, 201 bp, Homo sapiens
catcactgatgatgacctggaggccatcgccaatgactcagaggaagaaatcatcaagcctaggtcagcaccttttagcttcctgagcaatgtgaaatacractttatgaggatcatcaaatacgaattcatcctgaatgacgccctcaatcaaagtataattcgagccaatgatcagtacctcacggctgctgcattaca

SEQ ID NO: 3072 - DNA, 201 bp, Homo sapiens
gcaatttttacaacctgagttcaagtcaaattctgagcctggggggtcctcatctgcaaagcatggagagtggcatcttctttgcatcctaaggacgaaaracacagtgcactcagagctgctgaggacaatgtctggctgaagcccgctttcagcacgccgtaaccaggggctgacaatgcgaggtcgcaactgagatct

SEQ ID NO: 3073 - DNA, 201 bp, Homo sapiens
tttcttaagattatctatggatggttctccaactaggattgcgtatgggacacaagggagctctggttactctttgagattgtgtaacactggggacaackctgtctgcacaacaaaaacaagcacacgcattgttggaggaacaaactcttcttggggagagtggccctggcaggtgagcctgcaggtgaagctgacagc

SEQ ID NO: 3074 - DNA, 201 bp, Homo sapiens
accgctataaaggtgctgagtaacgtggaatctggattctcactgaagccctgtgccctttcagaaattggttgccacatgaacatcttccagcatcttgmgttctcagatgtggatgttgccagggttctcactccagatgcttttgtgtgtcggaccatctgcacctatcaccccaactgcctcttctttacattctat

SEQ ID NO: 3075 - DNA, 201 bp, Homo sapiens
cgtttggtgggcatcaccagctggggtgaaggctgtgcccgcagggagcaacctggtgtctacaccaaagtcgctgagtacatggactggattttagagamaacacagagcagtgatggaaaagctcagatgcagtcaccagcatgagaagcagtccagagtctaggcaatttttacaacctgagttcaagtcaaattctg

SEQ ID NO: 3076 - DNA, 201 bp, Homo sapiens
tggatatagccttttaacctgcaaaagaactttacctgaaccctgccattctaaaatttacccgggagttgactttggaggagaagaattgaatgtgactkttgttaaaggagtgaatgtttgccaagagacttgcacaaagatgattcgctgtcagtttttcacttattctttactcccagaagactgtaaggaagagaa

SEQ ID NO: 3077 - DNA, 201 bp, Homo sapiens
gagaaaggtgaaatccaaaatattctacaaaaggtaaatattcctttggtaacaaatgaagaatgccagaaaagatatcaagattataaaataacccaacrgatggtctgtgctggctataaagaagggggaaaagatgcttgtaagggagattcaggtggtcccttagtttgcaaacacaacggaatgtggcgtttggtg

SEQ ID NO: 3078 - DNA, 201 bp, Homo sapiens
tttgagattgtgtaacactggggacaactctgtctgcacaacaaaaacaagcacacgcattgttggaggaacaaactcttcttggggagagtggccctggyaggtgagcctgcaggtgaagctgacagctcagaggcacctgtgtggagggtcactcataggacaccagtgggtcctcactgctgcccactgctttgatgg

SEQ ID NO: 3079 - DNA, 201 bp, Homo sapiens
attataaaataacccaacggatggtctgtgctggctataaagaagggggaaaagatgcttgtaagggagattcaggtggtcccttagtttgcaaacacaayggaatgtggcgtttggtgggcatcaccagctggggtgaaggctgtgcccgcagggagcaacctggtgtctacaccaaagtcgctgagtacatggactgga

SEQ ID NO: 3080 - DNA, 201 bp, Homo sapiens
agtacagtcccggaggaacacctaccgctataaaggtgctgagtaacgtggaatctggattctcactgaagccctgtgccctttcagaaattggttgccamatgaacatcttccagcatcttgcgttctcagatgtggatgttgccagggttctcactccagatgcttttgtgtgtcggaccatctgcacctatcacccca

SEQ ID NO: 3081 - DNA, 201 bp, Homo sapiens
gcttgccatcgagacatttataaaggagttgatatgagaggagtcaattttaatgtgtctaaggttagcagtgttgaagaatgccaaaaaaggtgcaccartaacattcgctgccagtttttttcatatgccacgcaaacatttcacaaggcagagtaccggaacaattgcctattaaagtacagtcccggaggaacacct

SEQ ID NO: 3082 - DNA, 201 bp, Homo sapiens; identical to SEQ ID NO: 3072

SEQ ID NO: 3083 - DNA, 201 bp, Homo sapiens; identical to SEQ ID NO: 3073

SEQ ID NO: 3084 - DNA, 201 bp, Homo sapiens; identical to SEQ ID NO: 3074

SEQ ID NO: 3085 - DNA, 201 bp, Homo sapiens; identical to SEQ ID NO: 3075

SEQ ID NO: 3086 - DNA, 201 bp, Homo sapiens; identical to SEQ ID NO: 3076

SEQ ID NO: 3087 - DNA, 201 bp, Homo sapiens; identical to SEQ ID NO: 3077

SEQ ID NO: 3088 - DNA, 201 bp, Homo sapiens; identical to SEQ ID NO: 3078

SEQ ID NO: 3089 - DNA, 201 bp, Homo sapiens; identical to SEQ ID NO: 3079

SEQ ID NO: 3090 - DNA, 201 bp, Homo sapiens; identical to SEQ ID NO: 3080

SEQ ID NO: 3091 - DNA, 201 bp, Homo sapiens; identical to SEQ ID NO: 3081

SEQ ID NO: 3092 - DNA, 201 bp, Homo sapiens
gaggattcccgaggacatcctggggaaagtcagcattgcggttctccggggcttggcgtacctccgagagaagcaccagatcatgcaccgaaatgtgaagycctccaacatcctcgtgaactctagaggggagatcaagctgtgtgacttcggggtgagcggccagctcatcgactccatggccaactccttcgtgggcac

SEQ ID NO: 3093 - DNA, 201 bp, Homo sapiens
tggcggctccctggaccaggggctgaaagaggccaagaggattcccgaggacatcctggggaaagtcagcattgcggttctccggggcttggcgtacctcygagagaagcaccagatcatgcaccgaaatgtgaagccctccaacatcctcgtgaactctagaggggagatcaagctgtgtgacttcggggtgagcggcca

SEQ ID NO: 3094 - DNA, 107 bp, Homo sapiens
ggtccctgccggcgtgcctctagggacgggcgacgctgctgtgtgtggtctcagagcctctgcttccttaggttacaaaacaaaacagggagagaaaaacmaaaaaa

SEQ ID NO: 3095 - DNA, 201 bp, Homo sapiens
tggccagcccgtggtcgacagggaagaaggagagcctcacagcatctcctcttggccagggtcccccggcgccccaacagcggttacgggatggacagcckgcccgccatggccatcttcgaactgctggactatattgtgaaagagccgcctcctaagctgcccaacggtgtgttcacccccgacttccaggagtttgtc

SEQ ID NO: 3096 - DNA, 201 bp, Homo sapiens
agctggaggccatctttggccagcccgtggtcgacagggaagaaggagagcctcacagcatctcctcttggccagggtcccccggcgccccaacagcggtyacgggatggacagcctgcccgccatggccatcttcgaactgctggactatattgtgaaagagccgcctcctaagctgcccaacggtgtgttcacccccga

SEQ ID NO: 3097 - DNA, 201 bp, Homo sapiens
agcaccagatcatgcaccgaaatgtgaagccctccaacatcctcgtgaactctagaggggagatcaagctgtgtgacttcggggtgagcggccagctcatmgactccatggccaactccttcgtgggcacgcgctcctacatggctccggagcggttgcagggcacacattactcggtgcagtcggtcatctggagcatgg

SEQ ID NO: 3098 - DNA, 201 bp, Homo sapiens
tcggtcatctggagcatggacctgtccctggtggagctggccatcgaaaggtaccccatccccccgcccgacgccaaggagctggaggccatctttggccrgcccgtggtcgacagggaagaaggagagcctcacagcatctcctcttggccagggtcccccggcgccccaacagcggttacgggatggacagcctgcccg

SEQ ID NO: 3099 - DNA, 201 bp, Homo sapiens
acacattactcggtgcagtcggtcatctggagcatggacctgtccctggtggagctggccatcgaaaggtaccccatccccccgcccgacgccaaggagcyggaggccatctttggccagcccgtggtcgacagggaagaaggagagcctcacagcatctcctcttggccagggtcccccggcgccccaacagcggttacg

SEQ ID NO: 3100 - DNA, 201 bp, Homo sapiens
tcgtgaactctagaggggagatcaagctgtgtgacttcggggtgagcggccagctcatcgactccatggccaactccttcgtgggcacgcgctcctacatrgctccggagcggttgcagggcacacattactcggtgcagtcggtcatctggagcatggacctgtccctggtggagctggccatcgaaaggtaccccatcc

SEQ ID NO: 3101 - DNA, 201 bp, Homo sapiens
tgtgaagccctccaacatcctcgtgaactctagaggggagatcaagctgtgtgacttcggggtgagcggccagctcatcgactccatggccaactccttcrtgggcacgcgctcctacatggctccggagcggttgcagggcacacattactcggtgcagtcggtcatctggagcatggacctgtccctggtggagctggc

SEQ ID NO: 3102 - DNA, 201 bp, Homo sapiens
cacagaccctcgggcctcatcatggccaggaagctgatccaccttgagatcaagccggccatccggaaccagatcatccgcgagcaccaggtcctgcacgmgtgcaactcaccgtacatcgtgggcttctacggggccttctactgtgacagggagatcagcatctgcatggagcacatggatggcggctccctggaccag

SEQ ID NO: 3103 - DNA, 201 bp, Homo sapiens; identical to SEQ ID NO: 3092

SEQ ID NO: 3104 - DNA, 201 bp, Homo sapiens; identical to SEQ ID NO: 3093

SEQ ID NO: 3105 - DNA, 201 bp, Homo sapiens; identical to SEQ ID NO: 3095

SEQ ID NO: 3106 - DNA, 201 bp, Homo sapiens; identical to SEQ ID NO: 3096

SEQ ID NO: 3107 - DNA, 201 bp, Homo sapiens; identical to SEQ ID NO: 3097

SEQ ID NO: 3108 - DNA, 201 bp, Homo sapiens; identical to SEQ ID NO: 3098

SEQ ID NO: 3109 - DNA, 201 bp, Homo sapiens; identical to SEQ ID NO: 3099

SEQ ID NO: 3110 - DNA, 201 bp, Homo sapiens; identical to SEQ ID NO: 3100

SEQ ID NO: 3111 - DNA, 201 bp, Homo sapiens; identical to SEQ ID NO: 3101

SEQ ID NO: 3112 - DNA, 201 bp, Homo sapiens; identical to SEQ ID NO: 3102

SEQ ID NO: 3113 - DNA, 201 bp, Homo sapiens
agcaccagatcatgcaccgagatgtgaagccctccaacatcctcgtgaactctagaggggagatcaagctgtgtgacttcggggtgagcggccagctcatmgactccatggccaactccttcgtgggcacgcgctcctacatggctccggagcggttgcagggcacacattactcggtgcagtcggacatctggagcatgg

SEQ ID NO: 3114 - DNA, 201 bp, Homo sapiens
tcgtgaactctagaggggagatcaagctgtgtgacttcggggtgagcggccagctcatagactccatggccaactccttcgtgggcacgcgctcctacatrgctccggagcggttgcagggcacacattactcggtgcagtcggacatctggagcatgggcctgtccctggtggagctggccgtcggaaggtaccccatcc

SEQ ID NO: 3115 - DNA, 201 bp, Homo sapiens
tgtgaagccctccaacatcctcgtgaactctagaggggagatcaagctgtgtgacttcggggtgagcggccagctcatagactccatggccaactccttcrtgggcacgcgctcctacatggctccggagcggttgcagggcacacattactcggtgcagtcggacatctggagcatgggcctgtccctggtggagctggc

SEQ ID NO: 3116 - DNA, 201 bp, Homo sapiens
gaggattcccgaggagatcctggggaaagtcagcatcgcggttctccggggcttggcgtacctccgagagaagcaccagatcatgcaccgagatgtgaagycctccaacatcctcgtgaactctagaggggagatcaagctgtgtgacttcggggtgagcggccagctcatagactccatggccaactccttcgtgggcac

SEQ ID NO: 3117 - DNA, 201 bp, Homo sapiens
cggcggctccctggaccaggtgctgaaagaggccaagaggattcccgaggagatcctggggaaagtcagcatcgcggttctccggggcttggcgtacctcygagagaagcaccagatcatgcaccgagatgtgaagccctccaacatcctcgtgaactctagaggggagatcaagctgtgtgacttcggggtgagcggcca

SEQ ID NO: 3118 - DNA, 201 bp, Homo sapiens
gggagcatctcagggggcacctgccgttgaattgttctcacttgtgtttgtaagaatccaagtatgtcacccttacaccaagtgagcacacagtgacacartcccctttcaatgtagataacattgcttcagagctggagaacttcatggggctcatcgaggtggtgacgggctacgtgaagatccgccattctcatgcct

SEQ ID NO: 3119 - DNA, 201 bp, Homo sapiens
cctgtgaaatcattgttcgcgcgaccctcatctgcctcaggatgctgtactctactacgcacaactgctccatcttttaagatattggaagtgagagcacrggaggagcatgggcggttcgttttgttagaaagaaacccggattcacgagatggtttttattgattagtttacaggatttgcactattgatagagttttt

SEQ ID NO: 3120 - DNA, 201 bp, Homo sapiens
ggatgctgtactctactacgcacaactgctccatcttttaagatattggaagtgagagcacgggaggagcatgggcggttcgttttgttagaaagaaaccyggattcacgagatggtttttattgattagtttacaggatttgcactattgatagagtttttgccttggcacaggcctgctttgtgataggggttttaaaa

SEQ ID NO: 3121 - DNA, 201 bp, Homo sapiens
tgtttggaaaacagagatgttatcacccttactggattttgcctcatcagtcaagggttgcgtgtctgactgtgaccagtgagacggcagacgggggtgcrcttagggcttttctgccaagaatgacagcagttggtctggagtgctcacctccctgtgaaatcattgttcgcgcgaccctcatctgcctcaggatgctgt

SEQ ID NO: 3122 - DNA, 201 bp, Homo sapiens
tcacccttactggattttgcctcatcagtcaagggttgcgtgtctgactgtgaccagtgagacggcagacgggggtgcgcttagggcttttctgccaagartgacagcagttggtctggagtgctcacctccctgtgaaatcattgttcgcgcgaccctcatctgcctcaggatgctgtactctactacgcacaactgctc

SEQ ID NO: 3123 - DNA, 201 bp, Homo sapiens
gcttcccctgcctgggaggcctcgttccaggagtcgttgttgagagtcaagccagggaagtgtgtttttgtcagggagcagccagtcctgtgctgggagcrtctcagggggcacctgccgttgaattgttctcacttgtgtttgtaagaatccaagtatgtcacccttacaccaagtgagcacacagtgacacaatcccct

SEQ ID NO: 3124 - DNA, 201 bp, Homo sapiens
ttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtgcgattgctgggtgtggtgtcccaaggccagccaacactgg

SEQ ID NO: 3125 - DNA, 201 bp, Homo sapiens
gcaccaatgcttcagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaagacaaaatccccatcagga

SEQ ID NO: 3126 - DNA, 201 bp, Homo sapiens
ccagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtacc

SEQ ID NO: 3127 - DNA, 201 bp, Homo sapiens
caagaacgagcgggccttgccgctgccccagtcttcgacctgctgatccttggatcctgaatctgtgcaaacagtaacgtgtgcgcacgcgcagcggggtsgggggggagagagagttttaacaatccattcacaagcctcctgtacctcagtggatcttcagaactgcccttgctgcccgcgggagacagcttctctgca

SEQ ID NO: 3128 - DNA, 201 bp, Homo sapiens
gtgcaaacagtaacgtgtgcgcacgcgcagcggggtggggggggagagagagttttaacaatccattcacaagcctcctgtacctcagtggatcttcagawctgcccttgctgcccgcgggagacagcttctctgcagtaaaacacatttgggatgttccttttttcaatatgcaagcagctttttattccctgcccaaac

SEQ ID NO: 3129 - DNA, 201 bp, Homo sapiens
tgtgcgcacgcgcagcggggtggggggggagagagagttttaacaatccattcacaagcctcctgtacctcagtggatcttcagaactgcccttgctgccygcgggagacagcttctctgcagtaaaacacatttgggatgttccttttttcaatatgcaagcagctttttattccctgcccaaacccttaactgacatgg

SEQ ID NO: 3130 - DNA, 201 bp, Homo sapiens
ctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttcca

SEQ ID NO: 3131 - DNA, 201 bp, Homo sapiens
ctaccagggcttgtccaacgagcaagtccttcgcttcgtcatggagggcggccttctggacaagccagacaactgtcctgacatgctgtttgaactgatgygcatgtgctggcagtataaccccaagatgaggccttccttcctggagatcatcagcagcatcaaagaggagatggagcctggcttccgggaggtctcctt

SEQ ID NO: 3132 - DNA, 201 bp, Homo sapiens
aacgagcgggccttgccgctgccccagtcttcgacctgctgatccttggatcctgaatctgtgcaaacagtaacgtgtgcgcacgcgcagcggggtggggkgggagagagagttttaacaatccattcacaagcctcctgtacctcagtggatcttcagaactgcccttgctgcccgcgggagacagcttctctgcagtaa

SEQ ID NO: 3133 - DNA, 201 bp, Homo sapiens
gaacgggggccgcaagaacgagcgggccttgccgctgccccagtcttcgacctgctgatccttggatcctgaatctgtgcaaacagtaacgtgtgcgcacrcgcagcggggtggggggggagagagagttttaacaatccattcacaagcctcctgtacctcagtggatcttcagaactgcccttgctgcccgcgggagac

SEQ ID NO: 3134 - DNA, 201 bp, Homo sapiens
ccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgt

SEQ ID NO: 3135 - DNA, 201 bp, Homo sapiens
ccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataact

SEQ ID NO: 3136 - DNA, 201 bp, Homo sapiens
ctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagagcatgtactgcatcccttgtgaaggtccttgcc

SEQ ID NO: 3137 - DNA, 201 bp, Homo sapiens
tgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttct

SEQ ID NO: 3138 - DNA, 201 bp, Homo sapiens
aatttaccgcatggaggaagtgacggggactaaagggcgccaaagcaaaggggacataaacaccaggaacaacggggagagagcctcctgtgaaagtgacrtcctgcatttcacctccaccaccacgtcgaagaatcgcatcatcataacctggcaccggtaccggccccctgactacagggatctcatcagcttcaccgt

SEQ ID NO: 3139 - DNA, 201 bp, Homo sapiens
aacaccaggaacaacggggagagagcctcctgtgaaagtgacgtcctgcatttcacctccaccaccacgtcgaagaatcgcatcatcataacctggcaccrgtaccggccccctgactacagggatctcatcagcttcaccgtttactacaaggaagcaccctttaagaatgtcacagagtatgatgggcaggatgcctgc

SEQ ID NO: 3140 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaagacaaaatccccatcaggaagtatgccgacggcaccatcgacattgaggaggtc

SEQ ID NO: 3141 - DNA, 201 bp, Homo sapiens
tgtgcaaacagtaacgtgtgcgcacgcgcagcggggtggggggggagagagagttttaacaatccattcacaagcctcctgtacctcagtggatcttcagwactgcccttgctgcccgcgggagacagcttctctgcagtaaaacacatttgggatgttccttttttcaatatgcaagcagctttttattccctgcccaaa

SEQ ID NO: 3142 - DNA, 201 bp, Homo sapiens; identical to SEQ ID NO: 3124

SEQ ID NO: 3143 - DNA, 201 bp, Homo sapiens
gcaccaatgcttcagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaagaagacaaaatccccatca

SEQ ID NO: 3144 - DNA, 201 bp, Homo sapiens; identical to SEQ ID NO: 3126

SEQ ID NO: 3145 - DNA, 201 bp, Homo sapiens; identical to SEQ ID NO: 3127

SEQ ID NO: 3146 - DNA, 201 bp, Homo sapiens; identical to SEQ ID NO: 3128

SEQ ID NO: 3147 - DNA, 201 bp, Homo sapiens; identical to SEQ ID NO: 3129

SEQ ID NO: 3148 - DNA, 201 bp, Homo sapiens; identical to SEQ ID NO: 3130

SEQ ID NO: 3149 - DNA, 201 bp, Homo sapiens; identical to SEQ ID NO: 3131

SEQ ID NO: 3150 - DNA, 201 bp, Homo sapiens; identical to SEQ ID NO: 3132

SEQ ID NO: 3151 - DNA, 201 bp, Homo sapiens; identical to SEQ ID NO: 3133

SEQ ID NO: 3152 - DNA, 201 bp, Homo sapiens; identical to SEQ ID NO: 3134

SEQ ID NO: 3153 - DNA, 201 bp, Homo sapiens; identical to SEQ ID NO: 3135

SEQ ID NO: 3154 - DNA, 201 bp, Homo sapiens; identical to SEQ ID NO: 3136

SEQ ID NO: 3155 - DNA, 201 bp, Homo sapiens; identical to SEQ ID NO: 3137

SEQ ID NO: 3156 - DNA, 201 bp, Homo sapiens; identical to SEQ ID NO: 3138

SEQ ID NO: 3157 - DNA, 201 bp, Homo sapiens; identical to SEQ ID NO: 3139

SEQ ID NO: 3158 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaagaagacaaaatccccatcaggaagtatgccgacggcaccatcgacattgaggag

SEQ ID NO: 3159 - DNA, 201 bp, Homo sapiens; identical to SEQ ID NO: 3141

SEQ ID NO: 3160 - DNA, 201 bp, Homo sapiens
tacagtggaaatttttaaatttgaagaagcagaaaattctctgttgcatctgaaaacagtcaaacatgagcttcttccaagtgtgaatgacatcacagctsttggaccggcacatttctatgccacaaatgaccactacttctctgatcctttcttaaagtatttagaaacatacttgaacttacactgggcaaatgttgt

SEQ ID NO: 3161 - DNA, 201 bp, Homo sapiens
gacatctgggtaggctgtcatcctaatggccagaagctcttcgtgtatgacccgaacaatcctccctcgtcagaggttctccgcatccagaacattctatstgagaagcctacagtgactacagtttatgccaacaatgggtctgttctccaaggaagttctgtagcctcagtgtatgatgggaagctgctcataggcact

SEQ ID NO: 3162 - DNA, 201 bp, Homo sapiens
agaacatggattccactgaaatagagtgaattatatttccttaaaatgtgagtgacctcacttctggcactgtgactactatggctgtttagaactactgwtaacgtattttgatgttttgtacttacatctttgtttaccattaaaaagttggagttatattaaagactaactaaaatcccagttttgtctgtgtttaat

SEQ ID NO: 3163 - DNA, 201 bp, Homo sapiens
ggcatcagcactttcatagacaacgatgacacagtttatctctttgttgtaaaccacccagaattcaagaatacagtggaaatttttaaatttgaagaagsagaaaattctctgttgcatctgaaaacagtcaaacatgagcttcttccaagtgtgaatgacatcacagctgttggaccggcacatttctatgccacaaat

SEQ ID NO: 3164 - DNA, 201 bp, Homo sapiens; identical to SEQ ID NO: 3160

SEQ ID NO: 3165 - DNA, 201 bp, Homo sapiens; identical to SEQ ID NO: 3161

SEQ ID NO: 3166 - DNA, 201 bp, Homo sapiens; identical to SEQ ID NO: 3162

SEQ ID NO: 3167 - DNA, 201 bp, Homo sapiens
agtcgtgggtttgatttggcctcattcaatccacatggcatcagcactttcatagacaacgaattcaagaatacagtggaaatttttaaatttgaagaagsagaaaattctctgttgcatctgaaaacagtcaaacatgagcttcttccaagtgtgaatgacatcacagctgttggaccggcacatttctatgccacaaat

SEQ ID NO: 3168 - DNA, 201 bp, Homo sapiens
gacatctgggtagtctgtcatcctaatggccagaagctcttcgtgtatgacccgaacaatcctccctcgtcagaggttctccgcatccagaacattctatstgagaagcctacagtgactacagtttatgccaacaatgggtctgttctccaaggaagttctgtagcctcagtgtatgatgggaagctgctcataggcact

SEQ ID NO: 3169 - DNA, 201 bp, Homo sapiens; identical to SEQ ID NO: 3163

SEQ ID NO: 3170 - DNA, 201 bp, Homo sapiens
agaacatggattccactgaaatagagtgaattatatttccttaaaatgtgagtgacctcacttctggcactgtgactactatggctgtttagaactactgwtaataacgtattttgatgttttgtacttacatctttgtttaccattaaaaagttggagttatattaaagactaactaaaatcccaaaaaaaaaaaaaaaa

SEQ ID NO: 3171 - DNA, 201 bp, Homo sapiens; identical to SEQ ID NO: 3160

SEQ ID NO: 3172 - DNA, 201 bp, Homo sapiens
ttcctgtatgctgcaactcatgaacttggccattctttgggtatgggacattcctctgatcctaatgcagtgatgtatccaacctatggaaatggagatcyccaaaattttaaactttcccaggatgatattaaaggcattcagaaactatatggaaagagaagtaattcaagaaagaaatagaaacttcaggcagaacat

SEQ ID NO: 3173 - DNA, 170 bp, Homo sapiens
acaccaaatcaaccataggtccaagaacaattgtctctggacggcagctatgcgactcaccgtgctgtgkgctgtgtgcctgctgcctggcagcctggccctgccgctgcctcaggaggcgggaggcatgagtgagctacagtgggaacaggctcaggactatctcaaga

SEQ ID NO: 3174 - DNA, 201 bp, Homo sapiens
taattcaagaaagaaatagaaacttcaggcagaacatccattcattcattcattggattgtatatcattgttgcacaatcagaattgataagcactgttcytccactccatttagcaattatgtcacccttttttattgcagttggtttttgaatgtctttcactccttttaaggataaactcctttatggtgtgactgtg

SEQ ID NO: 3175 - DNA, 201 bp, Homo sapiens
ctctatgactcagaaacaaaaaatgccaacagtttagaagccaaactcaaggagatgcaaaaattctttggcctacctataactggaatgttaaactcccrcgtcatagaaataatgcagaagcccagatgtggagtgccagatgttgcagaatactcactatttccaaatagcccaaaatggacttccaaagtggtcacc

SEQ ID NO: 3176 - DNA, 201 bp, Homo sapiens
tgaccggtccatcttgctgcctctcatcatcggcctgatccttcttggcctcctcgccctggtgcttattgctttctgcatcatccggagacgcccatccrcctaccaggccctctgagcatttgcttcaaaccccagggcactgagggggttggggtgtggtgggggggtacccttatttcctcgacacgcaactggctc

SEQ ID NO: 3177 - DNA, 201 bp, Homo sapiens
gcccatccgcctaccaggccctctgagcatttgcttcaaaccccagggcactgagggggttggggtgtggtgggggggtacccttatttcctcgacacgcmactggctcaaagacaatgttattttccttccctttcttgaagaacaaaaagaaagccgggcatgacggctcatgcctgtaatcccagcactttgggaggc

SEQ ID NO: 3178 - DNA, 201 bp, Homo sapiens
cccatccgcctaccaggccctctgagcatttgcttcaaaccccagggcactgagggggttggggtgtggtgggggggtacccttatttcctcgacacgcarctggctcaaagacaatgttattttccttccctttcttgaagaacaaaaagaaagccgggcatgacggctcatgcctgtaatcccagcactttgggaggct

SEQ ID NO: 3179 - DNA, 201 bp, Homo sapiens
aactggtgcagacagcctagctggactttgggtgaggcggttcagccatgaggctggctgtgcttttctcgggggccctgctggggctactggcagcccargggacagggaatgactgtcctcacaaaaaatcagctactttgctgccatccttcacggtgacacccacggttacagagagcactggaacaaccagccaca

SEQ ID NO: 3180 - DNA, 201 bp, Homo sapiens
tccttcccccacgcagcacagtggacattctcggctcagaatgcatcccttcgagatctccaagcacccctggggcagagcttcagttgcagcaactcgascatcattctttcaccagctgtccacctcgacctgctctccctgaggctccaggctgctcagctgccccacacaggggtctttgggcaaagtttctcctgc

SEQ ID NO: 3181 - DNA, 185 bp, Homo sapiens
gagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtca

SEQ ID NO: 3182 - DNA, 201 bp, Homo sapiens
ggtctttgggcaaagtttctcctgccccagtgaccggtccatcttgctgcctctcatcatcggcctgatccttcttggcctcctcgccctggtgcttattrctttctgcatcatccggagacgcccatccgcctaccaggccctctgagcatttgcttcaaaccccagggcactgagggggttggggtgtggtgggggggt

SEQ ID NO: 3183 - DNA, 201 bp, Homo sapiens
tggacacctcagctttggattcatgcaggacctccagcagaaggttgtctacctgagctacatggcggtggagtacaatgtgtccttcccccacgcagcamagtggacattctcggctcagaatgcatcccttcgagatctccaagcacccctggggcagagcttcagttgcagcaactcgagcatcattctttcaccagc

SEQ ID NO: 3184 - DNA, 201 bp, Homo sapiens
ctagcccaacctccaaggagaccattggagactacacgtggaccaatggttcccagccctgtgtccacctccaagcccagattcagattcgagtcatgtayacaacccagggtggaggagaggcctggggcatctctgtactgaaccccaacaaaaccaaggtccagggaagctgtgagggtgcccatccccacctgcttc

SEQ ID NO: 3185 - DNA, 201 bp, Homo sapiens
gtaatcccagctggcctgtaatcccagctacttgggaggctgaggcagaactgcttgaacccaggaggtggaggttgcagtgagccgtcatcgcgccactragccaagatcgcgccactgcactccagcctgggcgacagagccagactgtctcaaataaataaatatgagataatgcagtcgggagaagggagggagaga

SEQ ID NO: 3186 - DNA, 201 bp, Homo sapiens
ggagtttgagaccagcctggccaacatggtgaaaccctgtctctactaaaaatacaattagccaggtgtggcggcgtaatcccagctggcctgtaatcccrgctacttgggaggctgaggcagaactgcttgaacccaggaggtggaggttgcagtgagccgtcatcgcgccactgagccaagatcgcgccactgcactcc

SEQ ID NO: 3187 - DNA, 201 bp, Homo sapiens
aggctccaggctgctcagctgccccacacaggggtctttgggcaaagtttctcctgccccagtgaccggtccatcttgctgcctctcatcatcggcctgayccttcttggcctcctcgccctggtgcttattgctttctgcatcatccggagacgcccatccgcctaccaggccctctgagcatttgcttcaaaccccagg

SEQ ID NO: 3188 - DNA, 201 bp, Homo sapiens
gggctaggacaagagccctcgaccctggggccaacgccctgcgtccttggttcccccagaggatcagtgcgcgatgacttggggacaaaggagatgatggrggctagcagtctgacggcctggatatctgtccccttctccaggaccctgaaagacagccttgagcaagacctcaacaatatgaacaagttcctggaaaag

SEQ ID NO: 3189 - DNA, 201 bp, Homo sapiens
ggatcaatcgggaggacgcccgctgcagtccccagaatcaaaggatgatgtggcgcatctatgtttctttggagagtgttgtaggtctggatttgtatggscaatgtgtttgtgcttcgtgcgtgagttgttactggccagggctaggacaagagccctcgaccctggggccaacgccctgcgtccttggttcccccagag

SEQ ID NO: 3190 - DNA, 201 bp, Homo sapiens
cagtccttgaaagtggcctgttgggtggagggtggaaggtcctgtgcaggacagggaggccaccaaaggggctgctgtctcctgcatatccagcctcctgygactccccaatctggatgcattacattcaccaggctttgcaaacccagcctcccagtgctcatttgggaatgctcatgagttactccattcaagggtgag

SEQ ID NO: 3191 - DNA, 201 bp, Homo sapiens
ctctggctcttctttcagcgttttcggccacccaggcacggaaaggcttctgggactacttcagccagaccagcggggacaaaggcagggtggagcagatmcatcagcagaagatggctcgcgagcccgcgtgagtgcccaggggaaggggtgtaggcgaagggaggagacagctgggccatgccatgatgacctgcctct

SEQ ID NO: 3192 - DNA, 201 bp, Homo sapiens
cctctagcatggttcagtccttgaaagtggcctgttgggtggagggtggaaggtcctgtgcaggacagggaggccaccaaaggggctgctgtctcctgcayatccagcctcctgcgactccccaatctggatgcattacattcaccaggctttgcaaacccagcctcccagtgctcatttgggaatgctcatgagttactc

SEQ ID NO: 3193 - DNA, 201 bp, Homo sapiens
tggctgccgtgctcacctgggctctggctcttctttcagcgttttcggccacccaggcacggaaaggcttctgggactacttcagccagaccagcggggamaaaggcagggtggagcagatccatcagcagaagatggctcgcgagcccgcgtgagtgcccaggggaaggggtgtaggcgaagggaggagacagctgggcc

SEQ ID NO: 3194 - DNA, 189 bp, Homo sapiens
ggcctccctccacctgtcttctcagagcagataatggcaagcatggctgccgtgctcacctgggctctggctcttctttcagcgttttsggccacccaggcacggaaaggcttctgggactacttcagccagaccagcggggacaaaggcagggtggagcagatccatcagcagaagatggctcgcgag

SEQ ID NO: 3195 - DNA, 201 bp, Homo sapiens
gcgcgtggtgggggaagacaccaaggcccagttgctggggggcgtggacgaggcttgggctttgctgcagggactgcagagccgcgtggtgcaccacacckgccgcttcaaagagctcttccacccatacgccgagagcctggtgagcggcatcgggcgccacgtgcaggagctgcaccgcagtgtggctccgcacgcccc

SEQ ID NO: 3196 - DNA, 201 bp, Homo sapiens
ctggaatttggagggcttgcggcagcaactgaagccctacacgatggatctgatggagcaggtggccctgcgcgtgcaggagctgcaggagcagttgcgcrtggtgggggaagacaccaaggcccagttgctggggggcgtggacgaggcttgggctttgctgcagggactgcagagccgcgtggtgcaccacaccggccg

SEQ ID NO: 3197 - DNA, 201 bp, Homo sapiens
agagcctttgcaggcactgggactgaggaaggggccggcccggacccccagatgctctccgaggaggtgcgccagcgacttcaggctttccgccaggacayctacctgcagatagctgccttcactcgcgccatcgaccaggagactgaggaggtccagcagcagctggcgccacctccaccaggccacagtgccttcgcc

SEQ ID NO: 3198 - DNA, 201 bp, Homo sapiens
catgcatgtgggtgattatctgcaagcctgtttgccgtgatgctggaagcctgtgccactacatcctggagtttggctctagtcacttctggctgcctggyggccactgctacagctggtccacagagaggagcacttgtctccccagggctgccatggcagctatcaggggaatagaagggagaaagagaatatcatggg

SEQ ID NO: 3199 - DNA, 201 bp, Homo sapiens
tcgcgccatcgaccaggagactgaggaggtccagcagcagctggcgccacctccaccaggccacagtgccttcgccccagagtttcaacaaacagacagtrgcaaggttctgagcaagctgcaggcccgtctggatgacctgtgggaagacatcactcacagccttcatgaccagggccacagccatctgggggacccctg

SEQ ID NO: 3200 - DNA, 201 bp, Homo sapiens
agccttcatgaccagggccacagccatctgggggacccctgaggatctacctgcccaggcccattcccagctccttgtctggggagccttggctctgagcmtctagcatggttcagtccttgaaagtggcctgttgggtggagggtggaaggtcctgtgcaggacagggaggccaccaaaggggctgctgtctcctgcata

SEQ ID NO: 3201 - DNA, 201 bp, Homo sapiens
ggatgacctgtgggaagacatcactcacagccttcatgaccagggccacagccatctgggggacccctgaggatctacctgcccaggcccattcccagctycttgtctggggagccttggctctgagcctctagcatggttcagtccttgaaagtggcctgttgggtggagggtggaaggtcctgtgcaggacagggaggc

SEQ ID NO: 3202 - DNA, 131 bp, Homo sapiens
ggcctccctccacctgtcttctcagagcagrtaatggcaagcatggctgccgtgctcacctgggctctggctcttctttcagcgttttcggccacccaggcacggaaaggcttctgggactacttcagcca

SEQ ID NO: 3203 - DNA, 201 bp, Homo sapiens; identical to SEQ ID NO: 3190

SEQ ID NO: 3204 - DNA, 201 bp, Homo sapiens
ctctggctcttctttcagcgttttcggccacccaggcacggaaaggcttctgggactacttcagccagaccagcggggacaaaggcagggtggagcagatmcatcagcagaagatggctcgcgagcccgcgaccctgaaagacagccttgagcaagacctcaacaatatgaacaagttcctggaaaagctgaggcctctga

SEQ ID NO: 3205 - DNA, 201 bp, Homo sapiens; identical to SEQ ID NO: 3192

SEQ ID NO: 3206 - DNA, 201 bp, Homo sapiens
tggctgccgtgctcacctgggctctggctcttctttcagcgttttcggccacccaggcacggaaaggcttctgggactacttcagccagaccagcggggamaaaggcagggtggagcagatccatcagcagaagatggctcgcgagcccgcgaccctgaaagacagccttgagcaagacctcaacaatatgaacaagttcc

SEQ ID NO: 3207 - DNA, 189 bp, Homo sapiens; identical to SEQ ID NO: 3194

SEQ ID NO: 3208 - DNA, 201 bp, Homo sapiens; identical to SEQ ID NO: 3195

SEQ ID NO: 3209 - DNA, 201 bp, Homo sapiens; identical to SEQ ID NO: 3196

SEQ ID NO: 3210 - DNA, 201 bp, Homo sapiens; identical to SEQ ID NO: 3198

SEQ ID NO: 3211 - DNA, 201 bp, Homo sapiens; identical to SEQ ID NO: 3197

SEQ ID NO: 3212 - DNA, 201 bp, Homo sapiens; identical to SEQ ID NO: 3199

SEQ ID NO: 3213 - DNA, 201 bp, Homo sapiens; identical to SEQ ID NO: 3200

SEQ ID NO: 3214 - DNA, 201 bp, Homo sapiens; identical to SEQ ID NO: 3201

SEQ ID NO: 3215 - DNA, 131 bp, Homo sapiens; identical to SEQ ID NO: 3202

SEQ ID NO: 3216 - DNA, 201 bp, Homo sapiens; identical to SEQ ID NO: 3192

SEQ ID NO: 3217 - DNA, 201 bp, Homo sapiens; identical to SEQ ID NO: 3198

SEQ ID NO: 3218 - DNA, 126 bp, Homo sapiens
ataaaaaaaaaaaaaaaaaaaaaaasacggaaaggcttctgggactacttcagccagaccagcggggacaaaggcagggtggagcagatccatcagcagaagatggctcgcgagcccgcgaccctg

SEQ ID NO: 3219 - DNA, 201 bp, Homo sapiens; identical to SEQ ID NO: 3196

SEQ ID NO: 3220 - DNA, 201 bp, Homo sapiens; identical to SEQ ID NO: 3197

SEQ ID NO: 3221 - DNA, 201 bp, Homo sapiens; identical to SEQ ID NO: 3199

SEQ ID NO: 3222 - DNA, 201 bp, Homo sapiens; identical to SEQ ID NO: 3200

SEQ ID NO: 3223 - DNA, 201 bp, Homo sapiens; identical to SEQ ID NO: 3190

SEQ ID NO: 3224 - DNA, 201 bp, Homo sapiens; identical to SEQ ID NO: 3195

SEQ ID NO: 3225 - DNA, 201 bp, Homo sapiens; identical to SEQ ID NO: 3201

SEQ ID NO: 3226 - DNA, 201 bp, Homo sapiens
cacctccaagcccctttcttcagcaaccagagcagcagcgccttctgtgagcaggtcttcatcaagcccgaggttttcctgtctctgggcatcgtcagtckgctggaaaacatcctggttatcctggccgtggtcaggaacggcaacctgcactccccgatgtacttctttctctgcagcctggcggtggccgacatgctg

SEQ ID NO: 3227 - DNA, 201 bp, Homo sapiens
tcagccaacactgcctaatggctcggagcacctccaagcccctttcttcagcaaccagagcagcagcgccttctgtgagcaggtcttcatcaagcccgagrttttcctgtctctgggcatcgtcagtctgctggaaaacatcctggttatcctggccgtggtcaggaacggcaacctgcactccccgatgtacttctttct

SEQ ID NO: 3228 - DNA, 201 bp, Homo sapiens
atccagcacatggacaacatcttcgactccatgatctgcatctccctggtggcctccatctgcaacctcctggccatcgccgtcgacaggtacgtcaccawcttttacgcgctccgctaccacagcatcatgaccgtgaggaaggccctcaccttgatcgtggccatctgggtctgctgcggcgtctgtggcgtggtgttc

SEQ ID NO: 3229 - DNA, 117 bp, Homo sapiens
atgagcatccaaaagamgtatctggagggagattttgtctttcctgtgagcagcagcagcttcctacggaccctgctggagccccagctcggatcagcccttctgacagcaatgaat

SEQ ID NO: 3230 - DNA, 201 bp, Homo sapiens
aatggtcattgtgtgcctcatcaccatgttcttcgccatgatgctcctcatgggcaccctctacgtgcacatgttcctctttgcgcggctgcacgtcaagmgcatagcagcactgccacctgccgacggggtggccccacagcaacactcatgcatgaagggggcagtcaccatcaccattctcctgggcgtgttcatctt

SEQ ID NO: 3231 - DNA, 201 bp, Homo sapiens
gttcatcgtctactcggagagcaaaatggtcattgtgtgcctcatcaccatgttcttcgccatgatgctcctcatgggcaccctctacgtgcacatgttcytctttgcgcggctgcacgtcaagcgcatagcagcactgccacctgccgacggggtggccccacagcaacactcatgcatgaagggggcagtcaccatcac

SEQ ID NO: 3232 - DNA, 201 bp, Homo sapiens
aactcctcccggttgtagatgtatctctccaggaagcgctgtgtcccattaaacgcgtagcattcctgccgtccctggaaaagtcatcaattatagacccyacaacatgcgccctgaagacagaatgttccatatcagagctgtgatcttgagagccctctccttggctttcctgctgagtctccgaggagctggggccat

SEQ ID NO: 3233 - DNA, 201 bp, Homo sapiens
ccaagccttttcctttgaggctcagggcgggctggctaacattgctatattgaacaacaacttgaataccttgatccagcgttccaaccacactcaggccrccaacgatccccctgaggtgaccgtgtttcccaaggagcctgtggagctgggccagcccaacaccctcatctgccacattgacaagttcttcccaccagt

SEQ ID NO: 3234 - DNA, 201 bp, Homo sapiens
agaccaacaggggagtttatgtttgaatttgatgaagatgagatgttctatgtggatctggacaagaaggagaccgtctggcatctggaggagtttggccragccttttcctttgaggctcagggcgggctggctaacattgctatattgaacaacaacttgaataccttgatccagcgttccaaccacactcaggccacc

SEQ ID NO: 3235 - DNA, 201 bp, Homo sapiens
atgtgtcaacttatgccgcgtttgtacagacgcatagaccaacaggggagtttatgtttgaatttgatgaagatgagatgttctatgtggatctggacaaraaggagaccgtctggcatctggaggagtttggccaagccttttcctttgaggctcagggcgggctggctaacattgctatattgaacaacaacttgaata

SEQ ID NO: 3236 - DNA, 201 bp, Homo sapiens
gcctgggtagaaatccgtcacgtggcagacaagcaggttgtggtgctgcaagggcccctctcgtagttgtgtctgcacatcctgtccggcactgcccgctyctcctccaggatgtccttctggctgttccagtactccgcagcaggccgccccagctccgtcaccgcccggaactcccccacgtcgctgtcgaagcgcgcg

SEQ ID NO: 3237 - DNA, 201 bp, Homo sapiens
tacaaactccatctcagcttttcttctcacttcatgtgaaaactactccagtggctgactgaattgctgacccttcaagctctgtccttatccattaccthaaagcagtcattccttagtaaagtttccaacaaatagaaattaatgacactttggtagcactaatatggagattatcctttcattgagccttttatcctc

SEQ ID NO: 3238 - DNA, 201 bp, Homo sapiens
gaaccatcggacttgaatgctgcctgggtagaaatccgtcacgtggcagacaagcaggttgtggtgctgcaagggcccctctcgtagttgtgtctgcacaycctgtccggcactgcccgcttctcctccaggatgtccttctggctgttccagtactccgcagcaggccgccccagctccgtcaccgcccggaactccccc

SEQ ID NO: 3239 - DNA, 201 bp, Homo sapiens
aggaaccatcggacttgaatgctgcctgggtagaaatccgtcacgtggcagacaagcaggttgtggtgctgcaagggcccctctcgtagttgtgtctgcayatcctgtccggcactgcccgcttctcctccaggatgtccttctggctgttccagtactccgcagcaggccgccccagctccgtcaccgcccggaactccc

SEQ ID NO: 3240 - DNA, 201 bp, Homo sapiens
gtagatgtatctctccaggaagcgctgtgtcccattaaacgcgtagcattcctgccgtccctggaaaagtcatcaattatagaccccacaacatgcgcccwgaagacagaatgttccatatcagagctgtgatcttgagagccctctccttggctttcctgctgagtctccgaggagctggggccatcaaggcggaccatg

SEQ ID NO: 3241 - DNA, 201 bp, Homo sapiens
cctcccggttgtagatgtatctctccaggaagcgctgtgtcccattaaacgcgtagcattcctgccgtccctggaaaagtcatcaattatagaccccacarcatgcgccctgaagacagaatgttccatatcagagctgtgatcttgagagccctctccttggctttcctgctgagtctccgaggagctggggccatcaag

SEQ ID NO: 3242 - DNA, 201 bp, Homo sapiens
aaggagcctgtggagctgggccagcccaacaccctcatctgccacattgacaagttcttcccaccagtgctcaacgtcacgtggctgtgcaacggggagcyggtcactgagggtgtcgctgagagcctcttcctgcccagaacagattacagcttccacaagttccattacctgacctttgtgccctcagcagaggacttc

SEQ ID NO: 3243 - DNA, 201 bp, Homo sapiens
aggagcctgtggagctgggccagcccaacaccctcatctgccacattgacaagttcttcccaccagtgctcaacgtcacgtggctgtgcaacggggagctrgtcactgagggtgtcgctgagagcctcttcctgcccagaacagattacagcttccacaagttccattacctgacctttgtgccctcagcagaggacttct

SEQ ID NO: 3244 - DNA, 201 bp, Homo sapiens
ggctgtgcaacggggagctggtcactgagggtgtcgctgagagcctcttcctgcccagaacagattacagcttccacaagttccattacctgacctttgtrccctcagcagaggacttctatgactgcagggtggagcactggggcttggaccagccgctcctcaagcactgggaggcccaagagccaatccagatgcctg

SEQ ID NO: 3245 - DNA, 201 bp, Homo sapiens
tatgtggatctggacaagaaggagaccgtctggcatctggaggagtttggccaagccttttcctttgaggctcagggcgggctggctaacattgctatatygaacaacaacttgaataccttgatccagcgttccaaccacactcaggccaccaacgatccccctgaggtgaccgtgtttcccaaggagcctgtggagctg

SEQ ID NO: 3246 - DNA, 201 bp, Homo sapiens
gagagccctctccttggctttcctgctgagtctccgaggagctggggccatcaaggcggaccatgtgtcaacttatgccgcgtttgtacagacgcatagamcaacaggggagtttatgtttgaatttgatgaagatgagatgttctatgtggatctggacaagaaggagaccgtctggcatctggaggagtttggccaagc

SEQ ID NO: 3247 - DNA, 201 bp, Homo sapiens
agactgtgccttccactccacggtgacaggactatccaggctggtgtgctccacttggcaggtgtagacatctccctgctggggggtcatttccagcatcwccaggatctggaaggtccagtctccattacggatcaggttggtggacacgaccccagctgtttcctcctgtccattcaggaaccatcggacttgaatgct

SEQ ID NO: 3248 - DNA, 201 bp, Homo sapiens
catatcagagctgtgatcttgagagccctctccttggctttcctgctgagtctccgaggagctggggccatcaaggcggaccatgtgtcaacttatgccgygtttgtacagacgcatagaccaacaggggagtttatgtttgaatttgatgaagatgagatgttctatgtggatctggacaagaaggagaccgtctggcat

SEQ ID NO: 3249 - DNA, 201 bp, Homo sapiens
aggatgtccttctggctgttccagtactccgcagcaggccgccccagctccgtcaccgcccggaactcccccacgtcgctgtcgaagcgcgcgaactcctsccggttgtagatgtatctctccaggaagcgctgtgtcccattaaacgcgtagcattcctgccgtccctggaaaagtcatcaattatagaccccacaacat

SEQ ID NO: 3250 - DNA, 201 bp, Homo sapiens
gacaaaatatctgaacagaagaggacttaggagagatctgaactccagctgccctacaaactccatctcagcttttcttctcacttcatgtgaaaactacyccagtggctgactgaattgctgacccttcaagctctgtccttatccattacctcaaagcagtcattccttagtaaagtttccaacaaatagaaattaatg

SEQ ID NO: 3251 - DNA, 201 bp, Homo sapiens
gctgccctacaaactccatctcagcttttcttctcacttcatgtgaaaactactccagtggctgactgaattgctgacccttcaagctctgtccttatccrttacctcaaagcagtcattccttagtaaagtttccaacaaatagaaattaatgacactttggtagcactaatatggagattatcctttcattgagccttt

SEQ ID NO: 3252 - DNA, 201 bp, Homo sapiens
accatgtgtcaacttatgccgcgtttgtacagacgcatagaccaacaggggagtttatgtttgaatttgatgaagatgagatgttctatgtggatctggayaagaaggagaccgtctggcatctggaggagtttggccaagccttttcctttgaggctcagggcgggctggctaacattgctatattgaacaacaacttga

SEQ ID NO: 3253 - DNA, 201 bp, Homo sapiens
tgactgaattgctgacccttcaagctctgtccttatccattacctcaaagcagtcattccttagtaaagtttccaacaaatagaaattaatgacactttgrtagcactaatatggagattatcctttcattgagccttttatcctctgttctcctttgaagaacccctcactgtcaccttcccgagaataccctaagacca

SEQ ID NO: 3254 - DNA, 201 bp, Homo sapiens
gctttcctgctgagtctccgaggagctggggccatcaaggcggaccatgtgtcaacttatgccgcgtttgtacagacgcatagaccaacaggggagtttakgtttgaatttgatgaagatgagatgttctatgtggatctggacaagaaggagaccgtctggcatctggaggagtttggccaagccttttcctttgaggct

SEQ ID NO: 3255 - DNA, 201 bp, Homo sapiens
ttgctgacccttcaagctctgtccttatccattacctcaaagcagtcattccttagtaaagtttccaacaaatagaaattaatgacactttggtagcactratatggagattatcctttcattgagccttttatcctctgttctcctttgaagaacccctcactgtcaccttcccgagaataccctaagaccaataaatac

SEQ ID NO: 3256 - DNA, 201 bp, Homo sapiens
tctccttggctttcctgctgagtctccgaggagctggggccatcaaggcggaccatgtgtcaacttatgccgcgtttgtacagacgcatagaccaacaggrgagtttatgtttgaatttgatgaagatgagatgttctatgtggatctggacaagaaggagaccgtctggcatctggaggagtttggccaagccttttcct

SEQ ID NO: 3257 - DNA, 201 bp, Homo sapiens
tcttggcagcagtatccaatttggaagttgaaggtctgtcctggagccagatgctaacgaaacacagcaaatgcttttcctaaggcacaatagtcttttcrgtgagctcaggaaccctgtttatgcagatcctcgttgaactttcttgctcctcctgtgcatgaagatgcccactccacagatgatgagccccagcacgaa

SEQ ID NO: 3258 - DNA, 201 bp, Homo sapiens
tccagtctccattacggatcaggttggtggacacgaccccagctgtttcctcctgtccattcaggaaccatcggacttgaatgctgcctgggtagaaatcygtcacgtggcagacaagcaggttgtggtgctgcaagggcccctctcgtagttgtgtctgcacatcctgtccggcactgcccgcttctcctccaggatgtc

SEQ ID NO: 3259 - DNA, 201 bp, Homo sapiens
ctcccgtcaatgtcttactccgggcagaatcagactgtgccttccactccacggtgacaggactatccaggctggtgtgctccacttggcaggtgtagacrtctccctgctggggggtcatttccagcatcaccaggatctggaaggtccagtctccattacggatcaggttggtggacacgaccccagctgtttcctcct

SEQ ID NO: 3260 - DNA, 201 bp, Homo sapiens
gcccccagctcccgtcaatgtcttactccgggcagaatcagactgtgccttccactccacggtgacaggactatccaggctggtgtgctccacttggcagrtgtagacatctccctgctggggggtcatttccagcatcaccaggatctggaaggtccagtctccattacggatcaggttggtggacacgaccccagctgt

SEQ ID NO: 3261 - DNA, 201 bp, Homo sapiens
ctccacagatgatgagccccagcacgaagcccccagctcccgtcaatgtcttactccgggcagaatcagactgtgccttccactccacggtgacaggactrtccaggctggtgtgctccacttggcaggtgtagacatctccctgctggggggtcatttccagcatcaccaggatctggaaggtccagtctccattacgga

SEQ ID NO: 3262 - DNA, 201 bp, Homo sapiens
tcctccaggatgtccttctggctgttccagtactccgcagcaggccgccccagctccgtcaccgcccggaactcccccacgtcgctgtcgaagcgcgcgarctcctcccggttgtagatgtatctctccaggaagcgctgtgtcccattaaacgcgtagcattcctgccgtccctggaaaagtcatcaattatagacccca

SEQ ID NO: 3263 - DNA, 201 bp, Homo sapiens
tgctgagtctccgaggagctggggccatcaaggcggaccatgtgtcaacttatgccgcgtttgtacagacgcatagaccaacaggggagtttatgtttgartttgatgaagatgagatgttctatgtggatctggacaagaaggagaccgtctggcatctggaggagtttggccaagccttttcctttgaggctcagggcg

SEQ ID NO: 3264 - DNA, 201 bp, Homo sapiens
tgatcttgagagccctctccttggctttcctgctgagtctccgaggagctggggccatcaaggcggaccatgtgtcaacttatgccgcgtttgtacagacscatagaccaacaggggagtttatgtttgaatttgatgaagatgagatgttctatgtggatctggacaagaaggagaccgtctggcatctggaggagtttg

SEQ ID NO: 3265 - DNA, 201 bp, Homo sapiens
tccgaggagctggggccatcaaggcggaccatgtgtcaacttatgccgcgtttgtacagacgcatagaccaacaggggagtttatgtttgaatttgatgahgatgagatgttctatgtggatctggacaagaaggagaccgtctggcatctggaggagtttggccaagccttttcctttgaggctcagggcgggctggcta

SEQ ID NO: 3266 - DNA, 201 bp, Homo sapiens
accagccgctcctcaagcactgggaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgt

SEQ ID NO: 3267 - DNA, 178 bp, Homo sapiens
agcagtcattccttagtaaagtttccaacaaatagaaattaatgacactttggtagcactaatatggagattatcctttcattgagccttttatcctctgktctcctttgaagaacccctcactgtcaccttcccgagaataccctaagaccaataaatacttcagtatttcagagcg

SEQ ID NO: 3268 - DNA, 176 bp, Homo sapiens
cagtcattccttagtaaagtttccaacaaatagaaattaatgacactttggtagcactaatatggagattatcctttcattgagccttttatcctctgttytcctttgaagaacccctcactgtcaccttcccgagaataccctaagaccaataaatacttcagtatttcagagcg

SEQ ID NO: 3269 - DNA, 174 bp, Homo sapiens
gtcattccttagtaaagtttccaacaaatagaaattaatgacactttggtagcactaatatggagattatcctttcattgagccttttatcctctgttctyctttgaagaacccctcactgtcaccttcccgagaataccctaagaccaataaatacttcagtatttcagagcg

SEQ ID NO: 3270 - DNA, 166 bp, Homo sapiens
ttagtaaagtttccaacaaatagaaattaatgacactttggtagcactaatatggagattatcctttcattgagccttttatcctctgttctcctttgaaraacccctcactgtcaccttcccgagaataccctaagaccaataaatacttcagtatttcagagcg

SEQ ID NO: 3271 - DNA, 201 bp, Homo sapiens
gctggtcactgagggtgtcgctgagagcctcttcctgcccagaacagattacagcttccacaagttccattacctgacctttgtgccctcagcagaggacktctatgactgcagggtggagcactggggcttggaccagccgctcctcaagcactgggaggcccaagagccaatccagatgcctgagacaacggagactgt

SEQ ID NO: 3272 - DNA, 201 bp, Homo sapiens
cagatgatgagccccagcacgaagcccccagctcccgtcaatgtcttactccgggcagaatcagactgtgccttccactccacggtgacaggactatccakgctggtgtgctccacttggcaggtgtagacatctccctgctggggggtcatttccagcatcaccaggatctggaaggtccagtctccattacggatcagg

SEQ ID NO: 3273 - DNA, 201 bp, Homo sapiens
tgacccttcaagctctgtccttatccattacctcaaagcagtcattccttagtaaagtttccaacaaatagaaattaatgacactttggtagcactaatayggagattatcctttcattgagccttttatcctctgttctcctttgaagaacccctcactgtcaccttcccgagaataccctaagaccaataaatacttca

SEQ ID NO: 3274 - DNA, 201 bp, Homo sapiens
accccagctgtttcctcctgtccattcaggaaccatcggacttgaatgctgcctgggtagaaatccgtcacgtggcagacaagcaggttgtggtgctgcargggcccctctcgtagttgtgtctgcacatcctgtccggcactgcccgcttctcctccaggatgtccttctggctgttccagtactccgcagcaggccgcc

SEQ ID NO: 3275 - DNA, 201 bp, Homo sapiens
tcgctgtcgaagcgcgcgaactcctcccggttgtagatgtatctctccaggaagcgctgtgtcccattaaacgcgtagcattcctgccgtccctggaaaastcatcaattatagaccccacaacatgcgccctgaagacagaatgttccatatcagagctgtgatcttgagagccctctccttggctttcctgctgagtct

SEQ ID NO: 3276 - DNA, 201 bp, Homo sapiens
cgtcgctgtcgaagcgcgcgaactcctcccggttgtagatgtatctctccaggaagcgctgtgtcccattaaacgcgtagcattcctgccgtccctggaamagtcatcaattatagaccccacaacatgcgccctgaagacagaatgttccatatcagagctgtgatcttgagagccctctccttggctttcctgctgagt

SEQ ID NO: 3277 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggwaaagtcatcaattatagaccccacaacatgcgccctgaagacagaatgttccatatcagagctgtgatcttgagagccctctccttggctttcctgctga

SEQ ID NO: 3278 - DNA, 201 bp, Homo sapiens
tcccccacgtcgctgtcgaagcgcgcgaactcctcccggttgtagatgtatctctccaggaagcgctgtgtcccattaaacgcgtagcattcctgccgtcmctggaaaagtcatcaattatagaccccacaacatgcgccctgaagacagaatgttccatatcagagctgtgatcttgagagccctctccttggctttcct

SEQ ID NO: 3279 - DNA, 201 bp, Homo sapiens
tcagagcaacttcttggcagcagtatccaatttggaagttgaaggtctgtcctggagccagatgctaacgaaacacagcaaatgcttttcctaaggcacawtagtcttttcagtgagctcaggaaccctgtttatgcagatcctcgttgaactttcttgctcctcctgtgcatgaagatgcccactccacagatgatgagc

SEQ ID NO: 3280 - DNA, 201 bp, Homo sapiens
cagcagtatccaatttggaagttgaaggtctgtcctggagccagatgctaacgaaacacagcaaatgcttttcctaaggcacaatagtcttttcagtgagstcaggaaccctgtttatgcagatcctcgttgaactttcttgctcctcctgtgcatgaagatgcccactccacagatgatgagccccagcacgaagccccc

SEQ ID NO: 3281 - DNA, 201 bp, Homo sapiens
gggtcatttccagcatcaccaggatctggaaggtccagtctccattacggatcaggttggtggacacgaccccagctgtttcctcctgtccattcaggaascatcggacttgaatgctgcctgggtagaaatccgtcacgtggcagacaagcaggttgtggtgctgcaagggcccctctcgtagttgtgtctgcacatcct

SEQ ID NO: 3282 - DNA, 201 bp, Homo sapiens
agctggggccatcaaggcggaccatgtgtcaacttatgccgcgtttgtacagacgcatagaccaacaggggagtttatgtttgaatttgatgaagatgagmtgttctatgtggatctggacaagaaggagaccgtctggcatctggaggagtttggccaagccttttcctttgaggctcagggcgggctggctaacattgc

SEQ ID NO: 3283 - DNA, 201 bp, Homo sapiens
acatcctgtccggcactgcccgcttctcctccaggatgtccttctggctgttccagtactccgcagcaggccgccccagctccgtcaccgcccggaactcycccacgtcgctgtcgaagcgcgcgaactcctcccggttgtagatgtatctctccaggaagcgctgtgtcccattaaacgcgtagcattcctgccgtccct

SEQ ID NO: 3284 - DNA, 201 bp, Homo sapiens
tgcctgggtagaaatccgtcacgtggcagacaagcaggttgtggtgctgcaagggcccctctcgtagttgtgtctgcacatcctgtccggcactgcccgcytctcctccaggatgtccttctggctgttccagtactccgcagcaggccgccccagctccgtcaccgcccggaactcccccacgtcgctgtcgaagcgcgc

SEQ ID NO: 3285 - DNA, 201 bp, Homo sapiens
gggaacatggttggaggcccagtgagagaaacagtgctttgaatcaaagagcagaatgatagaaactgacttcagagcaacttcttggcagcagtatccamtttggaagttgaaggtctgtcctggagccagatgctaacgaaacacagcaaatgcttttcctaaggcacaatagtcttttcagtgagctcaggaaccctg

SEQ ID NO: 3286 - DNA, 201 bp, Homo sapiens
gaatcaaagagcagaatgatagaaactgacttcagagcaacttcttggcagcagtatccaatttggaagttgaaggtctgtcctggagccagatgctaacraaacacagcaaatgcttttcctaaggcacaatagtcttttcagtgagctcaggaaccctgtttatgcagatcctcgttgaactttcttgctcctcctgtg

SEQ ID NO: 3287 - DNA, 201 bp, Homo sapiens
agggaacatggttggaggcccagtgagagaaacagtgctttgaatcaaagagcagaatgatagaaactgacttcagagcaacttcttggcagcagtatccwatttggaagttgaaggtctgtcctggagccagatgctaacgaaacacagcaaatgcttttcctaaggcacaatagtcttttcagtgagctcaggaaccct

SEQ ID NO: 3288 - DNA, 201 bp, Homo sapiens
gctttgaatcaaagagcagaatgatagaaactgacttcagagcaacttcttggcagcagtatccaatttggaagttgaaggtctgtcctggagccagatgytaacgaaacacagcaaatgcttttcctaaggcacaatagtcttttcagtgagctcaggaaccctgtttatgcagatcctcgttgaactttcttgctcctc

SEQ ID NO: 3289 - DNA, 196 bp, Homo sapiens
gtcatgttgggttttgattatttgtggtgctaagaagaagggaacatggttggaggcccagtgagagaaacagtgctttgaatcaaagagcagaaygatagaaactgacttcagagcaacttcttggcagcagtatccaatttggaagttgaaggtctgtcctggagccagatgctaacgaaacacagcaaatgct

SEQ ID NO: 3290 - DNA, 201 bp, Homo sapiens
caacaccctcatctgccacattgacaagttcttcccaccagtgctcaacgtcacgtggctgtgcaacggggagctggtcactgagggtgtcgctgagagcytcttcctgcccagaacagattacagcttccacaagttccattacctgacctttgtgccctcagcagaggacttctatgactgcagggtggagcactgggg

SEQ ID NO: 3291 - DNA, 103 bp, Homo sapiens
gtyatgttgggttttgattatttgtggtgctaagaagaagggaacatggttggaggcccagtgagagaaacagtgctttgaatcaaagagcagaatgatagaa

SEQ ID NO: 3292 - DNA, 201 bp, Homo sapiens
ggtgctgcaagggcccctctcgtagttgtgtctgcacatcctgtccggcactgcccgcttctcctccaggatgtccttctggctgttccagtactccgcakcaggccgccccagctccgtcaccgcccggaactcccccacgtcgctgtcgaagcgcgcgaactcctcccggttgtagatgtatctctccaggaagcgctg

SEQ ID NO: 3293 - DNA, 201 bp, Homo sapiens
tcccaaggagcctgtggagctgggccagcccaacaccctcatctgccacattgacaagttcttcccaccagtgctcaacgtcacgtggctgtgcaacgggragctggtcactgagggtgtcgctgagagcctcttcctgcccagaacagattacagcttccacaagttccattacctgacctttgtgccctcagcagagga

SEQ ID NO: 3294 - DNA, 101 bp, Homo sapiens
stcatgttgggttttgattatttgtggtgctaagaagaagggaacatggttggaggcccagtgagagaaacagtgctttgaatcaaagagcagaatgatag

SEQ ID NO: 3295 - DNA, 201 bp, Homo sapiens
agtgctttgaatcaaagagcagaatgatagaaactgacttcagagcaacttcttggcagcagtatccaatttggaagttgaaggtctgtcctggagccagrtgctaacgaaacacagcaaatgcttttcctaaggcacaatagtcttttcagtgagctcaggaaccctgtttatgcagatcctcgttgaactttcttgctc

SEQ ID NO: 3296 - DNA, 164 bp, Homo sapiens
agtaaagtttccaacaaatagaaattaatgacactttggtagcactaatatggagattatcctttcattgagccttttatcctctgttctcctttgaagarcccctcactgtcaccttcccgagaataccctaagaccaataaatacttcagtatttcagagcg

SEQ ID NO: 3297 - DNA, 201 bp, Homo sapiens
gaatgtaaagaggaggccctaggatttgtagaatgtgacaaaatatctgaacagaagaggacttaggagagatctgaactccagctgccctacaaactccrtctcagcttttcttctcacttcatgtgaaaactactccagtggctgactgaattgctgacccttcaagctctgtccttatccattacctcaaagcagtca

SEQ ID NO: 3298 - DNA, 201 bp, Homo sapiens
gaaacagtgctttgaatcaaagagcagaatgatagaaactgacttcagagcaacttcttggcagcagtatccaatttggaagttgaaggtctgtcctggarccagatgctaacgaaacacagcaaatgcttttcctaaggcacaatagtcttttcagtgagctcaggaaccctgtttatgcagatcctcgttgaactttct

SEQ ID NO: 3299 - DNA, 144 bp, Homo sapiens
gaaattaatgacactttggtagcactaatatggagattatcctttcattgagccttttatcctctgttctcctttgaagaacccctcactgtcaccttccygagaataccctaagaccaataaatacttcagtatttcagagcg

SEQ ID NO: 3300 - DNA, 201 bp, Homo sapiens
gaggcccagtgagagaaacagtgctttgaatcaaagagcagaatgatagaaactgacttcagagcaacttcttggcagcagtatccaatttggaagttgarggtctgtcctggagccagatgctaacgaaacacagcaaatgcttttcctaaggcacaatagtcttttcagtgagctcaggaaccctgtttatgcagatcc

SEQ ID NO: 3301 - DNA, 135 bp, Homo sapiens
gacactttggtagcactaatatggagattatcctttcattgagccttttatcctctgttctcctttgaagaacccctcactgtcaccttcccgagaatacyctaagaccaataaatacttcagtatttcagagcg

SEQ ID NO: 3302 - DNA, 201 bp, Homo sapiens
ctcccccacgtcgctgtcgaagcgcgcgaactcctcccggttgtagatgtatctctccaggaagcgctgtgtcccattaaacgcgtagcattcctgccgtmcctggaaaagtcatcaattatagaccccacaacatgcgccctgaagacagaatgttccatatcagagctgtgatcttgagagccctctccttggctttcc

SEQ ID NO: 3303 - DNA, 201 bp, Homo sapiens
aaccacactcaggccaccaacgatccccctgaggtgaccgtgtttcccaaggagcctgtggagctgggccagcccaacaccctcatctgccacattgacargttcttcccaccagtgctcaacgtcacgtggctgtgcaacggggagctggtcactgagggtgtcgctgagagcctcttcctgcccagaacagattacagc

SEQ ID NO: 3304 - DNA, 201 bp, Homo sapiens
ctcctccaggatgtccttctggctgttccagtactccgcagcaggccgccccagctccgtcaccgcccggaactcccccacgtcgctgtcgaagcgcgcgwactcctcccggttgtagatgtatctctccaggaagcgctgtgtcccattaaacgcgtagcattcctgccgtccctggaaaagtcatcaattatagacccc

SEQ ID NO: 3305 - DNA, 201 bp, Homo sapiens
cttctcctccaggatgtccttctggctgttccagtactccgcagcaggccgccccagctccgtcaccgcccggaactcccccacgtcgctgtcgaagcgcrcgaactcctcccggttgtagatgtatctctccaggaagcgctgtgtcccattaaacgcgtagcattcctgccgtccctggaaaagtcatcaattatagac

SEQ ID NO: 3306 - DNA, 201 bp, Homo sapiens
tgtggtgctgcaagggcccctctcgtagttgtgtctgcacatcctgtccggcactgcccgcttctcctccaggatgtccttctggctgttccagtactcckcagcaggccgccccagctccgtcaccgcccggaactcccccacgtcgctgtcgaagcgcgcgaactcctcccggttgtagatgtatctctccaggaagcg

SEQ ID NO: 3307 - DNA, 201 bp, Homo sapiens
aggttgtggtgctgcaagggcccctctcgtagttgtgtctgcacatcctgtccggcactgcccgcttctcctccaggatgtccttctggctgttccagtastccgcagcaggccgccccagctccgtcaccgcccggaactcccccacgtcgctgtcgaagcgcgcgaactcctcccggttgtagatgtatctctccagga

SEQ ID NO: 3308 - DNA, 201 bp, Homo sapiens
atccgtcacgtggcagacaagcaggttgtggtgctgcaagggcccctctcgtagttgtgtctgcacatcctgtccggcactgcccgcttctcctccaggakgtccttctggctgttccagtactccgcagcaggccgccccagctccgtcaccgcccggaactcccccacgtcgctgtcgaagcgcgcgaactcctcccgg

SEQ ID NO: 3309 - DNA, 201 bp, Homo sapiens
atccccctgaggtgaccgtgtttcccaaggagcctgtggagctgggccagcccaacaccctcatctgccacattgacaagttcttcccaccagtgctcaaygtcacgtggctgtgcaacggggagctggtcactgagggtgtcgctgagagcctcttcctgcccagaacagattacagcttccacaagttccattacctga

SEQ ID NO: 3310 - DNA, 201 bp, Homo sapiens
ctgaggtgaccgtgtttcccaaggagcctgtggagctgggccagcccaacaccctcatctgccacattgacaagttcttcccaccagtgctcaacgtcacrtggctgtgcaacggggagctggtcactgagggtgtcgctgagagcctcttcctgcccagaacagattacagcttccacaagttccattacctgacctttg

SEQ ID NO: 3311 - DNA, 201 bp, Homo sapiens
tgtttcccaaggagcctgtggagctgggccagcccaacaccctcatctgccacattgacaagttcttcccaccagtgctcaacgtcacgtggctgtgcaayggggagctggtcactgagggtgtcgctgagagcctcttcctgcccagaacagattacagcttccacaagttccattacctgacctttgtgccctcagcag

SEQ ID NO: 3312 - DNA, 101 bp, Homo sapiens
ttcattgagccttttatcctctgttctcctttgaagaacccctcactgtcaccttcccgagaataccctaagaccaataaatacttcagtatttcagagcr

SEQ ID NO: 3313 - DNA, 201 bp, Homo sapiens
caggatctggaaggtccagtctccattacggatcaggttggtggacacgaccccagctgtttcctcctgtccattcaggaaccatcggacttgaatgctgyctgggtagaaatccgtcacgtggcagacaagcaggttgtggtgctgcaagggcccctctcgtagttgtgtctgcacatcctgtccggcactgcccgcttc

SEQ ID NO: 3314 - DNA, 201 bp, Homo sapiens
gctggggccatcaaggcggaccatgtgtcaacttatgccgcgtttgtacagacgcatagaccaacaggggagtttatgtttgaatttgatgaagatgagawgttctatgtggatctggacaagaaggagaccgtctggcatctggaggagtttggccaagccttttcctttgaggctcagggcgggctggctaacattgct

SEQ ID NO: 3315 - DNA, 201 bp, Homo sapiens
attacggatcaggttggtggacacgaccccagctgtttcctcctgtccattcaggaaccatcggacttgaatgctgcctgggtagaaatccgtcacgtggyagacaagcaggttgtggtgctgcaagggcccctctcgtagttgtgtctgcacatcctgtccggcactgcccgcttctcctccaggatgtccttctggctg

SEQ ID NO: 3316 - DNA, 201 bp, Homo sapiens
accaacaggggagtttatgtttgaatttgatgaagatgagatgttctatgtggatctggacaagaaggagaccgtctggcatctggaggagtttggccaarccttttcctttgaggctcagggcgggctggctaacattgctatattgaacaacaacttgaataccttgatccagcgttccaaccacactcaggccaccaa

SEQ ID NO: 3317 - DNA, 201 bp, Homo sapiens
agctgtttcctcctgtccattcaggaaccatcggacttgaatgctgcctgggtagaaatccgtcacgtggcagacaagcaggttgtggtgctgcaagggcycctctcgtagttgtgtctgcacatcctgtccggcactgcccgcttctcctccaggatgtccttctggctgttccagtactccgcagcaggccgccccagc

SEQ ID NO: 3318 - DNA, 201 bp, Homo sapiens
ccatatcagagctgtgatcttgagagccctctccttggctttcctgctgagtctccgaggagctggggccatcaaggcggaccatgtgtcaacttatgccrcgtttgtacagacgcatagaccaacaggggagtttatgtttgaatttgatgaagatgagatgttctatgtggatctggacaagaaggagaccgtctggca

SEQ ID NO: 3319 - DNA, 201 bp, Homo sapiens
gttggaggcccagtgagagaaacagtgctttgaatcaaagagcagaatgatagaaactgacttcagagcaacttcttggcagcagtatccaatttggaagytgaaggtctgtcctggagccagatgctaacgaaacacagcaaatgcttttcctaaggcacaatagtcttttcagtgagctcaggaaccctgtttatgcag

SEQ ID NO: 3320 - DNA, 201 bp, Homo sapiens
aacatggttggaggcccagtgagagaaacagtgctttgaatcaaagagcagaatgatagaaactgacttcagagcaacttcttggcagcagtatccaattkggaagttgaaggtctgtcctggagccagatgctaacgaaacacagcaaatgcttttcctaaggcacaatagtcttttcagtgagctcaggaaccctgttt

SEQ ID NO: 3321 - DNA, 201 bp, Homo sapiens
ccttttcctttgaggctcagggcgggctggctaacattgctatattgaacaacaacttgaataccttgatccagcgttccaaccacactcaggccaccaaygatccccctgaggtgaccgtgtttcccaaggagcctgtggagctgggccagcccaacaccctcatctgccacattgacaagttcttcccaccagtgctca

SEQ ID NO: 3322 - DNA, 201 bp, Homo sapiens
ggaccctgtgaaatactgtaaaggtgggaatgtaaagaggaggccctaggatttgtagaatgtgacaaaatatctgaacagaagaggacttaggagagatytgaactccagctgccctacaaactccatctcagcttttcttctcacttcatgtgaaaactactccagtggctgactgaattgctgacccttcaagctctg

SEQ ID NO: 3323 - DNA, 201 bp, Homo sapiens
tgtaaagaggaggccctaggatttgtagaatgtgacaaaatatctgaacagaagaggacttaggagagatctgaactccagctgccctacaaactccatcwcagcttttcttctcacttcatgtgaaaactactccagtggctgactgaattgctgacccttcaagctctgtccttatccattacctcaaagcagtcattc

SEQ ID NO: 3324 - DNA, 201 bp, Homo sapiens; identical to SEQ ID NO: 3271

SEQ ID NO: 3325 - DNA, 201 bp, Homo sapiens
tttccagtgctagaggcccacagtttcagtctcatctgcctccactcggcctcagttcctcatcactgttcctgtgctcacagtcatcaattatagacccyacaacatgcgccctgaagacagaatgttccatatcagagctgtgatcttgagagccctctccttggctttcctgctgagtctccgaggagctggggccat

SEQ ID NO: 3326 - DNA, 201 bp, Homo sapiens; identical to SEQ ID NO: 3233

SEQ ID NO: 3327 - DNA, 201 bp, Homo sapiens; identical to SEQ ID NO: 3234

SEQ ID NO: 3328 - DNA, 201 bp, Homo sapiens; identical to SEQ ID NO: 3235

SEQ ID NO: 3329 - DNA, 201 bp, Homo sapiens; identical to SEQ ID NO: 3237

SEQ ID NO: 3330 - DNA, 201 bp, Homo sapiens; identical to SEQ ID NO: 3273

SEQ ID NO: 3331 - DNA, 201 bp, Homo sapiens
gaatcccagccatgctgattcctctccacccatttccagtgctagaggcccacagtttcagtctcatctgcctccactcggcctcagttcctcatcactgytcctgtgctcacagtcatcaattatagaccccacaacatgcgccctgaagacagaatgttccatatcagagctgtgatcttgagagccctctccttggct

SEQ ID NO: 3332 - DNA, 201 bp, Homo sapiens
ggcccacagtttcagtctcatctgcctccactcggcctcagttcctcatcactgttcctgtgctcacagtcatcaattatagaccccacaacatgcgcccwgaagacagaatgttccatatcagagctgtgatcttgagagccctctccttggctttcctgctgagtctccgaggagctggggccatcaaggcggaccatg

SEQ ID NO: 3333 - DNA, 201 bp, Homo sapiens
cagtgctagaggcccacagtttcagtctcatctgcctccactcggcctcagttcctcatcactgttcctgtgctcacagtcatcaattatagaccccacarcatgcgccctgaagacagaatgttccatatcagagctgtgatcttgagagccctctccttggctttcctgctgagtctccgaggagctggggccatcaag

SEQ ID NO: 3334 - DNA, 201 bp, Homo sapiens; identical to SEQ ID NO: 3242

SEQ ID NO: 3335 - DNA, 201 bp, Homo sapiens; identical to SEQ ID NO: 3282

SEQ ID NO: 3336 - DNA, 201 bp, Homo sapiens; identical to SEQ ID NO: 3243

SEQ ID NO: 3337 - DNA, 201 bp, Homo sapiens; identical to SEQ ID NO: 3244

SEQ ID NO: 3338 - DNA, 201 bp, Homo sapiens; identical to SEQ ID NO: 3245

SEQ ID NO: 3339 - DNA, 201 bp, Homo sapiens; identical to SEQ ID NO: 3246

SEQ ID NO: 3340 - DNA, 201 bp, Homo sapiens; identical to SEQ ID NO: 3290

SEQ ID NO: 3341 - DNA, 201 bp, Homo sapiens; identical to SEQ ID NO: 3248

SEQ ID NO: 3342 - DNA, 201 bp, Homo sapiens; identical to SEQ ID NO: 3250

SEQ ID NO: 3343 - DNA, 201 bp, Homo sapiens; identical to SEQ ID NO: 3293

SEQ ID NO: 3344 - DNA, 201 bp, Homo sapiens; identical to SEQ ID NO: 3251

SEQ ID NO: 3345 - DNA, 164 bp, Homo sapiens; identical to SEQ ID NO: 3296

SEQ ID NO: 3346 - DNA, 201 bp, Homo sapiens
ccgggcccaggggaccctgtgaaatactgtaaaggtgacaaaatatctgaacagaagaggacttaggagagatctgaactccagctgccctacaaactccrtctcagcttttcttctcacttcatgtgaaaactactccagtggctgactgaattgctgacccttcaagctctgtccttatccattacctcaaagcagtca

SEQ ID NO: 3347 - DNA, 144 bp, Homo sapiens; identical to SEQ ID NO: 3299

SEQ ID NO: 3348 - DNA, 135 bp, Homo sapiens; identical to SEQ ID NO: 3301

SEQ ID NO: 3349 - DNA, 201 bp, Homo sapiens; identical to SEQ ID NO: 3252

SEQ ID NO: 3350 - DNA, 201 bp, Homo sapiens; identical to SEQ ID NO: 3253

SEQ ID NO: 3351 - DNA, 201 bp, Homo sapiens; identical to SEQ ID NO: 3254

SEQ ID NO: 3352 - DNA, 201 bp, Homo sapiens; identical to SEQ ID NO: 3255

SEQ ID NO: 3353 - DNA, 201 bp, Homo sapiens; identical to SEQ ID NO: 3256

SEQ ID NO: 3354 - DNA, 201 bp, Homo sapiens; identical to SEQ ID NO: 3303

SEQ ID NO: 3355 - DNA, 138 bp, Homo sapiens
gtgaatcccagccatgctgattcctctccacccatttscagtgctagaggcccacagtttcagtctcatctgcctccactcggcctcagttcctcatcactgttcctgtgctcacagtcatcaattatagaccccaca

SEQ ID NO: 3356 - DNA, 199 bp, Homo sapiens
gtgaatcccagccatgctgattcctctccacccatttccagtgctagaggcccacagtttcagtctcatctgcctccactcggcctcagttcctcatcrctgttcctgtgctcacagtcatcaattatagaccccacaacatgcgccctgaagacagaatgttccatatcagagctgtgatcttgagagccctctcctt

SEQ ID NO: 3357 - DNA, 201 bp, Homo sapiens; identical to SEQ ID NO: 3309

SEQ ID NO: 3358 - DNA, 201 bp, Homo sapiens; identical to SEQ ID NO: 3310

SEQ ID NO: 3359 - DNA, 201 bp, Homo sapiens; identical to SEQ ID NO: 3311

SEQ ID NO: 3360 - DNA, 101 bp, Homo sapiens; identical to SEQ ID NO: 3312

SEQ ID NO: 3361 - DNA, 201 bp, Homo sapiens; identical to SEQ ID NO: 3314

SEQ ID NO: 3362 - DNA, 201 bp, Homo sapiens; identical to SEQ ID NO: 3316

SEQ ID NO: 3363 - DNA, 201 bp, Homo sapiens; identical to SEQ ID NO: 3263

SEQ ID NO: 3364 - DNA, 201 bp, Homo sapiens; identical to SEQ ID NO: 3264

SEQ ID NO: 3365 - DNA, 201 bp, Homo sapiens; identical to SEQ ID NO: 3318

SEQ ID NO: 3366 - DNA, 201 bp, Homo sapiens; identical to SEQ ID NO: 3265

SEQ ID NO: 3367 - DNA, 201 bp, Homo sapiens
accagccgctcctcaagcactgggaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgacaaaat

SEQ ID NO: 3368 - DNA, 201 bp, Homo sapiens; identical to SEQ ID NO: 3321

SEQ ID NO: 3369 - DNA, 195 bp, Homo sapiens
gtgaatcccagccatgctgattcctctccacccatttccagtgctagaggcccacagtttcagtctcatctgcctccactcggcctcagttcctyatcactgttcctgtgctcacagtcatcaattatagaccccacaacatgcgccctgaagacagaatgttccatatcagagctgtgatcttgagagccctct

SEQ ID NO: 3370 - DNA, 178 bp, Homo sapiens; identical to SEQ ID NO: 3267

SEQ ID NO: 3371 - DNA, 176 bp, Homo sapiens; identical to SEQ ID NO: 3268

SEQ ID NO: 3372 - DNA, 174 bp, Homo sapiens; identical to SEQ ID NO: 3269

SEQ ID NO: 3373 - DNA, 166 bp, Homo sapiens; identical to SEQ ID NO: 3270

SEQ ID NO: 3374 - DNA, 201 bp, Homo sapiens
aaagtctctgcgttctggccatgacccccgggcccaggggaccctgtgaaatactgtaaaggtgacaaaatatctgaacagaagaggacttaggagagatytgaactccagctgccctacaaactccatctcagcttttcttctcacttcatgtgaaaactactccagtggctgactgaattgctgacccttcaagctctg

SEQ ID NO: 3375 - DNA, 201 bp, Homo sapiens
ggcccaggggaccctgtgaaatactgtaaaggtgacaaaatatctgaacagaagaggacttaggagagatctgaactccagctgccctacaaactccatcwcagcttttcttctcacttcatgtgaaaactactccagtggctgactgaattgctgacccttcaagctctgtccttatccattacctcaaagcagtcattc

SEQ ID NO: 3376 - DNA, 201 bp, Homo sapiens; identical to SEQ ID NO: 3325

SEQ ID NO: 3377 - DNA, 201 bp, Homo sapiens; identical to SEQ ID NO: 3233

SEQ ID NO: 3378 - DNA, 201 bp, Homo sapiens; identical to SEQ ID NO: 3234

SEQ ID NO: 3379 - DNA, 201 bp, Homo sapiens; identical to SEQ ID NO: 3235

SEQ ID NO: 3380 - DNA, 201 bp, Homo sapiens; identical to SEQ ID NO: 3236

SEQ ID NO: 3381 - DNA, 201 bp, Homo sapiens; identical to SEQ ID NO: 3237

SEQ ID NO: 3382 - DNA, 201 bp, Homo sapiens; identical to SEQ ID NO: 3238

SEQ ID NO: 3383 - DNA, 201 bp, Homo sapiens; identical to SEQ ID NO: 3239

SEQ ID NO: 3384 - DNA, 201 bp, Homo sapiens; identical to SEQ ID NO: 3331

SEQ ID NO: 3385 - DNA, 201 bp, Homo sapiens; identical to SEQ ID NO: 3332

SEQ ID NO: 3386 - DNA, 201 bp, Homo sapiens; identical to SEQ ID NO: 3333

SEQ ID NO: 3387 - DNA, 201 bp, Homo sapiens; identical to SEQ ID NO: 3242

SEQ ID NO: 3388 - DNA, 201 bp, Homo sapiens; identical to SEQ ID NO: 3243

SEQ ID NO: 3389 - DNA, 201 bp, Homo sapiens; identical to SEQ ID NO: 3244

SEQ ID NO: 3390 - DNA, 201 bp, Homo sapiens; identical to SEQ ID NO: 3245

SEQ ID NO: 3391 - DNA, 201 bp, Homo sapiens; identical to SEQ ID NO: 3246

SEQ ID NO: 3392 - DNA, 201 bp, Homo sapiens; identical to SEQ ID NO: 3247

SEQ ID NO: 3393 - DNA, 201 bp, Homo sapiens; identical to SEQ ID NO: 3248

SEQ ID NO: 3394 - DNA, 201 bp, Homo sapiens
aggatgtccttctggctgttccagtactccgcagcaggccgccccagctccgtcaccgcccggaactcccccacgtcgctgtcgaagcgcgcgaactcctsccggttgtagatgtatctctccaggaagcgctgtgtcccattaaacgcgtagcattcctgccgtccctggaaaaggtgaatcccagccatgctgattcct

SEQ ID NO: 3395 - DNA, 201 bp, Homo sapiens; identical to SEQ ID NO: 3250

SEQ ID NO: 3396 - DNA, 201 bp, Homo sapiens; identical to SEQ ID NO: 3251

SEQ ID NO: 3397 - DNA, 201 bp, Homo sapiens; identical to SEQ ID NO: 3252

SEQ ID NO: 3398 - DNA, 201 bp, Homo sapiens; identical to SEQ ID NO: 3253

SEQ ID NO: 3399 - DNA, 201 bp, Homo sapiens; identical to SEQ ID NO: 3254

SEQ ID NO: 3400 - DNA, 201 bp, Homo sapiens; identical to SEQ ID NO: 3255

SEQ ID NO: 3401 - DNA, 201 bp, Homo sapiens; identical to SEQ ID NO: 3256

SEQ ID NO: 3402 - DNA, 201 bp, Homo sapiens; identical to SEQ ID NO: 3257

SEQ ID NO: 3403 - DNA, 201 bp, Homo sapiens; identical to SEQ ID NO: 3258

SEQ ID NO: 3404 - DNA, 201 bp, Homo sapiens; identical to SEQ ID NO: 3259

SEQ ID NO: 3405 - DNA, 201 bp, Homo sapiens; identical to SEQ ID NO: 3260

SEQ ID NO: 3406 - DNA, 201 bp, Homo sapiens; identical to SEQ ID NO: 3261

SEQ ID NO: 3407 - DNA, 201 bp, Homo sapiens
tcctccaggatgtccttctggctgttccagtactccgcagcaggccgccccagctccgtcaccgcccggaactcccccacgtcgctgtcgaagcgcgcgarctcctcccggttgtagatgtatctctccaggaagcgctgtgtcccattaaacgcgtagcattcctgccgtccctggaaaaggtgaatcccagccatgctg

SEQ ID NO: 3408 - DNA, 201 bp, Homo sapiens; identical to SEQ ID NO: 3263

SEQ ID NO: 3409 - DNA, 201 bp, Homo sapiens; identical to SEQ ID NO: 3264

SEQ ID NO: 3410 - DNA, 201 bp, Homo sapiens; identical to SEQ ID NO: 3265

SEQ ID NO: 3411 - DNA, 201 bp, Homo sapiens; identical to SEQ ID NO: 3367

SEQ ID NO: 3412 - DNA, 178 bp, Homo sapiens; identical to SEQ ID NO: 3267

SEQ ID NO: 3413 - DNA, 176 bp, Homo sapiens; identical to SEQ ID NO: 3268

SEQ ID NO: 3414 - DNA, 174 bp, Homo sapiens; identical to SEQ ID NO: 3269

SEQ ID NO: 3415 - DNA, 166 bp, Homo sapiens; identical to SEQ ID NO: 3270

SEQ ID NO: 3416 - DNA, 201 bp, Homo sapiens; identical to SEQ ID NO: 3271

SEQ ID NO: 3417 - DNA, 201 bp, Homo sapiens; identical to SEQ ID NO: 3272

SEQ ID NO: 3418 - DNA, 201 bp, Homo sapiens; identical to SEQ ID NO: 3273

SEQ ID NO: 3419 - DNA, 201 bp, Homo sapiens
tcgctgtcgaagcgcgcgaactcctcccggttgtagatgtatctctccaggaagcgctgtgtcccattaaacgcgtagcattcctgccgtccctggaaaasgtgaatcccagccatgctgattcctctccacccatttccagtgctagaggcccacagtttcagtctcatctgcctccactcggcctcagttcctcatcac

SEQ ID NO: 3420 - DNA, 201 bp, Homo sapiens; identical to SEQ ID NO: 3274

SEQ ID NO: 3421 - DNA, 201 bp, Homo sapiens
cgtcgctgtcgaagcgcgcgaactcctcccggttgtagatgtatctctccaggaagcgctgtgtcccattaaacgcgtagcattcctgccgtccctggaamaggtgaatcccagccatgctgattcctctccacccatttccagtgctagaggcccacagtttcagtctcatctgcctccactcggcctcagttcctcatc

SEQ ID NO: 3422 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggwaaaggtgaatcccagccatgctgattcctctccacccatttccagtgctagaggcccacagtttcagtctcatctgcctccactcggcctcagttcctca

SEQ ID NO: 3423 - DNA, 201 bp, Homo sapiens
tcccccacgtcgctgtcgaagcgcgcgaactcctcccggttgtagatgtatctctccaggaagcgctgtgtcccattaaacgcgtagcattcctgccgtcmctggaaaaggtgaatcccagccatgctgattcctctccacccatttccagtgctagaggcccacagtttcagtctcatctgcctccactcggcctcagtt

SEQ ID NO: 3424 - DNA, 201 bp, Homo sapiens; identical to SEQ ID NO: 3279

SEQ ID NO: 3425 - DNA, 201 bp, Homo sapiens; identical to SEQ ID NO: 3280

SEQ ID NO: 3426 - DNA, 201 bp, Homo sapiens; identical to SEQ ID NO: 3281

SEQ ID NO: 3427 - DNA, 201 bp, Homo sapiens; identical to SEQ ID NO: 3282

SEQ ID NO: 3428 - DNA, 201 bp, Homo sapiens; identical to SEQ ID NO: 3283

SEQ ID NO: 3429 - DNA, 201 bp, Homo sapiens; identical to SEQ ID NO: 3284

SEQ ID NO: 3430 - DNA, 201 bp, Homo sapiens; identical to SEQ ID NO: 3285

SEQ ID NO: 3431 - DNA, 201 bp, Homo sapiens; identical to SEQ ID NO: 3286

SEQ ID NO: 3432 - DNA, 201 bp, Homo sapiens; identical to SEQ ID NO: 3287

SEQ ID NO: 3433 - DNA, 201 bp, Homo sapiens; identical to SEQ ID NO: 3288

SEQ ID NO: 3434 - DNA, 196 bp, Homo sapiens; identical to SEQ ID NO: 3289

SEQ ID NO: 3435 - DNA, 201 bp, Homo sapiens; identical to SEQ ID NO: 3290

SEQ ID NO: 3436 - DNA, 103 bp, Homo sapiens; identical to SEQ ID NO: 3291

SEQ ID NO: 3437 - DNA, 201 bp, Homo sapiens; identical to SEQ ID NO: 3292

SEQ ID NO: 3438 - DNA, 201 bp, Homo sapiens; identical to SEQ ID NO: 3293

SEQ ID NO: 3439 - DNA, 101 bp, Homo sapiens; identical to SEQ ID NO: 3294

SEQ ID NO: 3440 - DNA, 201 bp, Homo sapiens; identical to SEQ ID NO: 3295

SEQ ID NO: 3441 - DNA, 164 bp, Homo sapiens; identical to SEQ ID NO: 3296

SEQ ID NO: 3442 - DNA, 201 bp, Homo sapiens; identical to SEQ ID NO: 3346

SEQ ID NO: 3443 - DNA, 201 bp, Homo sapiens; identical to SEQ ID NO: 3298

SEQ ID NO: 3444 - DNA, 144 bp, Homo sapiens; identical to SEQ ID NO: 3299

SEQ ID NO: 3445 - DNA, 201 bp, Homo sapiens; identical to SEQ ID NO: 3300

SEQ ID NO: 3446 - DNA, 135 bp, Homo sapiens; identical to SEQ ID NO: 3301

SEQ ID NO: 3447 - DNA, 201 bp, Homo sapiens; identical to SEQ ID NO: 3303

SEQ ID NO: 3448 - DNA, 201 bp, Homo sapiens
ctcccccacgtcgctgtcgaagcgcgcgaactcctcccggttgtagatgtatctctccaggaagcgctgtgtcccattaaacgcgtagcattcctgccgtmcctggaaaaggtgaatcccagccatgctgattcctctccacccatttccagtgctagaggcccacagtttcagtctcatctgcctccactcggcctcagt

SEQ ID NO: 3449 - DNA, 201 bp, Homo sapiens
gtatctctccaggaagcgctgtgtcccattaaacgcgtagcattcctgccgtccctggaaaaggtgaatcccagccatgctgattcctctccacccatttscagtgctagaggcccacagtttcagtctcatctgcctccactcggcctcagttcctcatcactgttcctgtgctcacagtcatcaattatagaccccaca

SEQ ID NO: 3450 - DNA, 201 bp, Homo sapiens
ctcctccaggatgtccttctggctgttccagtactccgcagcaggccgccccagctccgtcaccgcccggaactcccccacgtcgctgtcgaagcgcgcgwactcctcccggttgtagatgtatctctccaggaagcgctgtgtcccattaaacgcgtagcattcctgccgtccctggaaaaggtgaatcccagccatgct

SEQ ID NO: 3451 - DNA, 201 bp, Homo sapiens
cttctcctccaggatgtccttctggctgttccagtactccgcagcaggccgccccagctccgtcaccgcccggaactcccccacgtcgctgtcgaagcgcrcgaactcctcccggttgtagatgtatctctccaggaagcgctgtgtcccattaaacgcgtagcattcctgccgtccctggaaaaggtgaatcccagccat

SEQ ID NO: 3452 - DNA, 201 bp, Homo sapiens; identical to SEQ ID NO: 3306

SEQ ID NO: 3453 - DNA, 201 bp, Homo sapiens
aggtgaatcccagccatgctgattcctctccacccatttccagtgctagaggcccacagtttcagtctcatctgcctccactcggcctcagttcctcatcrctgttcctgtgctcacagtcatcaattatagaccccacaacatgcgccctgaagacagaatgttccatatcagagctgtgatcttgagagccctctcctt

SEQ ID NO: 3454 - DNA, 201 bp, Homo sapiens; identical to SEQ ID NO: 3307

SEQ ID NO: 3455 - DNA, 201 bp, Homo sapiens; identical to SEQ ID NO: 3308

SEQ ID NO: 3456 - DNA, 201 bp, Homo sapiens; identical to SEQ ID NO: 3309

SEQ ID NO: 3457 - DNA, 201 bp, Homo sapiens; identical to SEQ ID NO: 3310

SEQ ID NO: 3458 - DNA, 201 bp, Homo sapiens; identical to SEQ ID NO: 3311

SEQ ID NO: 3459 - DNA, 101 bp, Homo sapiens; identical to SEQ ID NO: 3312

SEQ ID NO: 3460 - DNA, 201 bp, Homo sapiens; identical to SEQ ID NO: 3313

SEQ ID NO: 3461 - DNA, 201 bp, Homo sapiens; identical to SEQ ID NO: 3314

SEQ ID NO: 3462 - DNA, 201 bp, Homo sapiens; identical to SEQ ID NO: 3315

SEQ ID NO: 3463 - DNA, 201 bp, Homo sapiens; identical to SEQ ID NO: 3316

SEQ ID NO: 3464 - DNA, 201 bp, Homo sapiens; identical to SEQ ID NO: 3317

SEQ ID NO: 3465 - DNA, 201 bp, Homo sapiens; identical to SEQ ID NO: 3318

SEQ ID NO: 3466 - DNA, 201 bp, Homo sapiens; identical to SEQ ID NO: 3319

SEQ ID NO: 3467 - DNA, 201 bp, Homo sapiens; identical to SEQ ID NO: 3320

SEQ ID NO: 3468 - DNA, 201 bp, Homo sapiens; identical to SEQ ID NO: 3321

SEQ ID NO: 3469 - DNA, 201 bp, Homo sapiens
gaaaaggtgaatcccagccatgctgattcctctccacccatttccagtgctagaggcccacagtttcagtctcatctgcctccactcggcctcagttcctyatcactgttcctgtgctcacagtcatcaattatagaccccacaacatgcgccctgaagacagaatgttccatatcagagctgtgatcttgagagccctct

SEQ ID NO: 3470 - DNA, 201 bp, Homo sapiens; identical to SEQ ID NO: 3374

SEQ ID NO: 3471 - DNA, 201 bp, Homo sapiens; identical to SEQ ID NO: 3375

SEQ ID NO: 3472 - DNA, 201 bp, Homo sapiens
gtctctcctcttcccatacacaccttacggattcttcacagggtgtgatgatgggaagcctagacacgcttatcagaagtttgtcctcttatcgggatacrtcagaaattagagagaccctggcaatcacagcttccacctcctcattttacaaatgagcaactaggctcagagtacagaagtggctttcccagggtcaca

SEQ ID NO: 3473 - DNA, 201 bp, Homo sapiens
ccagtggtagaagaacctgcctcccctggctccatcaaaggccacaggcccatgagaatcacccggcctgctctgagcagcacactcggaggccacagccrcgcacaggaaagtgagaggaagtggaaacgtgcgagcagagggctcaaagcgacgggctcaccaccggaaaaaaaaaataaaaataaacacgctcagaaa

SEQ ID NO: 3474 - DNA, 201 bp, Homo sapiens
attcaagtaccatctcctgacttctccattgcaccagacgtcgatagaacacagagaacctaaaagaagaaagaaaaaaaaatagagcttttgggaatatrttgggcttctggttttcaaggacaattttatgataagtagcaatgatgcctcaaaagctctggtagctagcttgaatgaacttatgtaataaacatttat

SEQ ID NO: 3475 - DNA, 130 bp, Homo sapiens
ccagtggtagaagaacctgcctcccctggctccatcaaaggccacaggcccatgagaatcacccggcctgctctgagcagcacactcggaggccacagccrcgcacaggaaagtgagaggaagtggaaac

SEQ ID NO: 3476 - DNA, 201 bp, Homo sapiens
agtacttactatttaaatgatgcccagagcctctgaatcccctagaagtacagaggagggggagatcattaatggtgtggagaagttggaggaggtgagaygatgccagatgtcaggagcaagggagcaccagtggtagaagaacctgcctcccctggctccatcaaaggccacaggcccatgagaatcacccggcctgct

SEQ ID NO: 3477 - DNA, 201 bp, Homo sapiens
acaaagctaatggacagcatgagatatccttcagtgttgcagatactgaagtgacttctagcatatcaataaattcttcagaagtaccagaggtcaccccrtcagagaatgttggatcaagctcccaagcatcctcatcagataaagccaacatgttgcaggaatactccaagtttctgcagcaggctttggacagaacta

SEQ ID NO: 3478 - DNA, 201 bp, Homo sapiens
ccttaccagtgtgaatactgtttacagtatttttccagaacagatcgtgtattgaaacataaacgtatgtgccatgaaaatcatgacaaaaaactaaatasatgtgccatcaaaggtggccttctgacatctgaggaagattctggcttttctacatcaccaaaagacaactcactgccaaaaaagaaaaggcagaaaacg

SEQ ID NO: 3479 - DNA, 201 bp, Homo sapiens
aaaaaaaattagatttttaggtttgatatggttgtgtcataatcatctcgtaattgacaattttaacttttggcaataaaaggaaattgggatatctttgraactgtaaaacctggtttaatctttttctttctagactcttgatagattggataattaaacagtatccagagaaactaaagaaatgggcattttaattgc

SEQ ID NO: 3480 - DNA, 201 bp, Homo sapiens
aagactggggggaaaagggagaaggcctgctttctagtcgagaaaagcggagaccgtctgaaactctacttgctccaacagaaagcagtgccccagcaaaygaacaacaacagcgctcacctgaaacagtttcaccttcatttttagaggagaggaacacaataggagggcgtattactccacgggttttaaccctagccc

SEQ ID NO: 3481 - DNA, 177 bp, Homo sapiens
atgagagtggtcattcgggtttgctttggaggtccagagaaaatgcaagtccaacttccaggcacagaccagttgcycgcagcaggcttcctcccattggtctcagaccaaggaagaccttgtgcgatccagggagcagagcaagagagcagctccttctcgcaccatcctgcatca

SEQ ID NO: 3482 - DNA, 201 bp, Homo sapiens
ttcaagaccaccaaccaccaaacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcagaagaataaaacccccacctcctccggcc

SEQ ID NO: 3483 - DNA, 201 bp, Homo sapiens
gccttctcctgttctggcagccatgggccgctccagctggggatgctcatccttgcaagcagccatccacgcacaaagggcacagaggggaatggtgtcakgaaacaagactggggggaaaagggagaaggcctgctttctagtcgagaaaagcggagaccgtctgaaactctacttgctccaacagaaagcagtgcccca

SEQ ID NO: 3484 - DNA, 201 bp, Homo sapiens
tgtgccttagtagtatttatgaagacttgaagatgtaccaggtggagttcaagaccatgaatgcaaagcttctgatggatcctaagaggcagatctttctrgatcaaaacatgctggcagttattgatgagctgatgcaggccctgaatttcaacagtgagactgtgccacaaaaatcctcccttgaagaaccggattttt

SEQ ID NO: 3485 - DNA, 201 bp, Homo sapiens
gagaagctgatgtagagagagacacagaaggagacagaaagcaagagaccagagtcccgggaaagtcctgccgcgcctcgggacaattataaaaatgtggycccctgggtcagcctcccagccaccgccctcacctgccgcggccacaggtctgcatccagcggctcgccctgtgtccctgcagtgccggctcagcatgtg

SEQ ID NO: 3486 - DNA, 201 bp, Homo sapiens
cgttgtcatttttataaaactttgaaatgaggaaactttgataggatgtggattaagaactagggagggggaaagaaggatgggactattacatccacatratacctctgatcaagtatttttgacatttactgtggataaattgtttttaagttttcatgaatgaattgctaagaagggaaaatatccatcctgaaggtg

SEQ ID NO: 3487 - DNA, 201 bp, Homo sapiens
aaatcctcccttgaagaaccggatttttataaaactaaaatcaagctctgcatacttcttcatgctttcagaattcgggcagtgactattgatagagtgaygagctatctgaatgcttcctaaaaagcgaggtccctccaaaccgttgtcatttttataaaactttgaaatgaggaaactttgataggatgtggattaaga

SEQ ID NO: 3488 - DNA, 201 bp, Homo sapiens
tgccacaaaaatcctcccttgaagaaccggatttttataaaactaaaatcaagctctgcatacttcttcatgctttcagaattcgggcagtgactattgayagagtgatgagctatctgaatgcttcctaaaaagcgaggtccctccaaaccgttgtcatttttataaaactttgaaatgaggaaactttgataggatgtg

SEQ ID NO: 3489 - DNA, 201 bp, Homo sapiens
aggtccctccaaaccgttgtcatttttataaaactttgaaatgaggaaactttgataggatgtggattaagaactagggagggggaaagaaggatgggacyattacatccacatgatacctctgatcaagtatttttgacatttactgtggataaattgtttttaagttttcatgaatgaattgctaagaagggaaaatat

SEQ ID NO: 3490 - DNA, 201 bp, Homo sapiens
tgcttcctaaaaagcgaggtccctccaaaccgttgtcatttttataaaactttgaaatgaggaaactttgataggatgtggattaagaactagggaggggraaagaaggatgggactattacatccacatgatacctctgatcaagtatttttgacatttactgtggataaattgtttttaagttttcatgaatgaattgc

SEQ ID NO: 3491 - DNA, 201 bp, Homo sapiens
cgcctgtggaccccgcgcagtaactgcgaacatttcgctttcattttgggccgagctggaggcggcggggccgtcccggaacggctgcggccgggcacccsgggagttaatccgaaagcgccgcaagccccgcgggccggccgcaccgcacgtgtcaccgagaagctgatgtagagagagacacagaaggagacagaaagc

SEQ ID NO: 3492 - DNA, 201 bp, Homo sapiens
aaagcttctgatggatcctaagaggcagatctttctagatcaaaacatgctggcagttattgatgagctgatgcaggccctgaatttcaacagtgagactrtgccacaaaaatcctcccttgaagaaccggatttttataaaactaaaatcaagctctgcatacttcttcatgctttcagaattcgggcagtgactattga

SEQ ID NO: 3493 - DNA, 201 bp, Homo sapiens; identical to SEQ ID NO: 3484

SEQ ID NO: 3494 - DNA, 201 bp, Homo sapiens; identical to SEQ ID NO: 3485

SEQ ID NO: 3495 - DNA, 201 bp, Homo sapiens; identical to SEQ ID NO: 3486

SEQ ID NO: 3496 - DNA, 201 bp, Homo sapiens; identical to SEQ ID NO: 3487

SEQ ID NO: 3497 - DNA, 201 bp, Homo sapiens; identical to SEQ ID NO: 3489

SEQ ID NO: 3498 - DNA, 201 bp, Homo sapiens; identical to SEQ ID NO: 3488

SEQ ID NO: 3499 - DNA, 201 bp, Homo sapiens; identical to SEQ ID NO: 3490

SEQ ID NO: 3500 - DNA, 201 bp, Homo sapiens; identical to SEQ ID NO: 3491

SEQ ID NO: 3501 - DNA, 201 bp, Homo sapiens; identical to SEQ ID NO: 3492

SEQ ID NO: 3502 - DNA, 201 bp, Homo sapiens
gatctcttccagaaggctgctaagaagcaccagaatatgtaccgcctggccatgaccggggcagggatcgacaggcacctcttctgcctttacttggtctmcaagtacctaggagtcagctctcctttccttgctgaggtgctctcggaaccctggcgtctctccaccagccagatcccccaatcccagatccgcatgttc

SEQ ID NO: 3503 - DNA, 201 bp, Homo sapiens
cattgctgatcttttccaagttcccaaggcctacagctgaagcccttaggtacctgtgttttgtttgggaactcggaggccctccccctcccccagctcaraccacagaggtggcaagagaagggctgaagctggaagactgttcatgagggacttgtgtgacctgctttgaaatgtgtgactctgctgagtgacgtaggc

SEQ ID NO: 3504 - DNA, 201 bp, Homo sapiens
  misc_feature (1)...(201): n = A,T,C or G, or insertion/deletion polymorphism (see Tables 1-2)
ctacacggagaccgggcactgcctgggcaaaccgaaccctgcgctcgcacctcctacacggctgcagtgggacattccaaaacagtgccaggcggtcatcnagagttcctaccaggtggccaaggcgttggcagacgacgtggagttgtactgcttccagttcctgccctttggcaaaggcctcatcaagaagtgccggac

SEQ ID NO: 3505 - DNA, 201 bp, Homo sapiens
gcgctttggaaaccacatccgcaaagccctgctggacattgctgatcttttccaagttcccaaggcctacagctgaagcccttaggtacctgtgttttgtytgggaactcggaggccctccccctcccccagctcagaccacagaggtggcaagagaagggctgaagctggaagactgttcatgagggacttgtgtgacct

SEQ ID NO: 3506 - DNA, 201 bp, Homo sapiens
gagatgtacagcctgaaggatgagatgggcaacctcaggaagttactagagtctaccccatcgccagtcgtcttctgccacaatgacatccaggaagggamcatcttgctgctctcagagccagaaaatgctgacagcctcatgctggtggacttcgagtacagcagttataactataggggctttgacattgggaaccat

SEQ ID NO: 3507 - DNA, 201 bp, Homo sapiens
gctcttccgctgctcgctcccggaccacctgcccagcgttggcgaggagccccgggaggtgcttctgcggctgtacggagccatcttgcaggtgagggggktgtgagcgccgcagcaccagtggctttagggcctgtcgcttacgcgatgcgggtagtattgttcccgttgcgcagttgaggacaccgaggttcacggtct

SEQ ID NO: 3508 - DNA, 201 bp, Homo sapiens
caggcacgccaggccttctttagctctggaaagaataaggctgccttggaggccatcgagcgtgccgctttcttcgtggccctggatgaggaatcctactsctatgaccccgaagatgaggccagcctcagcctctatggcaaggccctgctacatggcaactgctacaacaggtggtttgacaaatccttcactctcatt

SEQ ID NO: 3509 - DNA, 201 bp, Homo sapiens
ctggacattgctgatcttttccaagttcccaaggcctacagctgaagcccttaggtacctgtgttttgtttgggaactcggaggccctccccctcccccakctcagaccacagaggtggcaagagaagggctgaagctggaagactgttcatgagggacttgtgtgacctgctttgaaatgtgtgactctgctgagtgacg

SEQ ID NO: 3510 - DNA, 201 bp, Homo sapiens
gaaagaataaggctgccttggaggccatcgagcgtgccgctttcttcgtggccctggatgaggaatcctactcctatgaccccgaagatgaggccagcctyagcctctatggcaaggccctgctacatggcaactgctacaacaggtggtttgacaaatccttcactctcatttccttcaagaatggccagttgggtctca

SEQ ID NO: 3511 - DNA, 201 bp, Homo sapiens
tggagggaggaacaacgagcagaaggccctggcgactgggctgagcccccaagtgaaactgaggttcaggagaccggcctgttcctgagtttgactctaawgccaccatcctcacgagactctggggccccccaggctcccagacctttgagcaaccttcaccgcacagaaacccagccgcgccctgcaattcccaccgcg

SEQ ID NO: 3512 - DNA, 201 bp, Homo sapiens
  misc_feature (1)...(201): n = A,T,C or G, or insertion/deletion polymorphism (see Tables 1-2)
cctgtctgggatcaactcctggaagaaacgcctgatccgcatcaagaatggcatcctcaggggcgtgtaccctggcagccccaccagctggctggtcgtcntcatggcaacagtgggttcctccttctgcaacgtggacatctccttggggctggtcagttgcatccagagatgcctccctcaggggtgtggcccctacca

SEQ ID NO: 3513 - DNA, 127 bp, Homo sapiens
caccagtatgaggagctgagagtaacytggtggtctttgcagattcaggctcagcagaggtatccttcctgcaaccagcaggagtgccctcgtggaagcgttcctacctgggaaacaggctctaatc

SEQ ID NO: 3514 - DNA, 201 bp, Homo sapiens
gcctccagggcaggaccttggagggaggaacaacgagcagaaggccctggcgactgggctgagcccccaagtgaaactgaggttcaggagaccggcctgtycctgagtttgactctaaagccaccatcctcacgagactctggggccccccaggctcccagacctttgagcaaccttcaccgcacagaaacccagccgcgc

SEQ ID NO: 3515 - DNA, 201 bp, Homo sapiens
  misc_feature (1)...(201): n = A,T,C or G, or insertion/deletion polymorphism (see Tables 1-2)
aaactggaccgtgaagaaatcaagcctgtgatggcactgggcatagtgcctatgtgctcctaccagatggagaggatgttcaacaccactcggatcccggncaaggacacagatgtgctacagcacctctcagacagccggcacgtggctgtctaccacaagggacgcttcttcaagctgtggctctatgagggcgcccgt

SEQ ID NO: 3516 - DNA, 201 bp, Homo sapiens; identical to SEQ ID NO: 3502

SEQ ID NO: 3517 - DNA, 201 bp, Homo sapiens; identical to SEQ ID NO: 3503

SEQ ID NO: 3518 - DNA, 201 bp, Homo sapiens; identical to SEQ ID NO: 3504
  misc_feature (1)...(201): n = A,T,C or G, or insertion/deletion polymorphism (see Tables 1-2)

SEQ ID NO: 3519 - DNA, 201 bp, Homo sapiens; identical to SEQ ID NO: 3505

SEQ ID NO: 3520 - DNA, 201 bp, Homo sapiens; identical to SEQ ID NO: 3508

SEQ ID NO: 3521 - DNA, 201 bp, Homo sapiens; identical to SEQ ID NO: 3509

SEQ ID NO: 3522 - DNA, 201 bp, Homo sapiens; identical to SEQ ID NO: 3510

SEQ ID NO: 3523 - DNA, 201 bp, Homo sapiens; identical to SEQ ID NO: 3512
  misc_feature (1)...(201): n = A,T,C or G, or insertion/deletion polymorphism (see Tables 1-2)

SEQ ID NO: 3524 - DNA, 201 bp, Homo sapiens; identical to SEQ ID NO: 3515
  misc_feature (1)...(201): n = A,T,C or G, or insertion/deletion polymorphism (see Tables 1-2)

SEQ ID NO: 3525 - DNA, 201 bp, Homo sapiens; identical to SEQ ID NO: 3502

SEQ ID NO: 3526 - DNA, 201 bp, Homo sapiens
ccagtcctaccctctcctccccaaggcacctccaccccctaaccctaccccagtgcccaatgtctgcctccacatccctcaccccaagtagggaatttccsccaaaaccctgacttcccctcattgccccagcccttcccactcctgccccagccccatcaccaccctgatagcttcctgggtgcagagtcggccattgaa

SEQ ID NO: 3527 - DNA, 201 bp, Homo sapiens
cgtgcacaggtgcccaggctccaaggacagctccggcagcagcccttaggtacctgtgttttgtttgggaactcggaggccctccccctcccccagctcaraccacagaggtggcaagagaagggctgaagctggaagactgttcatgagggacttgtgtgacctgctttgaaatgtgtgactctgctgagtgacgtaggc

SEQ ID NO: 3528 - DNA, 201 bp, Homo sapiens; identical to SEQ ID NO: 3504
  misc_feature (1)...(201): n = A,T,C or G, or insertion/deletion polymorphism (see Tables 1-2)

SEQ ID NO: 3529 - DNA, 201 bp, Homo sapiens
agggacctgtggcagctcacaggcatgaggggtggccgtgcacaggtgcccaggctccaaggacagctccggcagcagcccttaggtacctgtgttttgtytgggaactcggaggccctccccctcccccagctcagaccacagaggtggcaagagaagggctgaagctggaagactgttcatgagggacttgtgtgacct

SEQ ID NO: 3530 - DNA, 201 bp, Homo sapiens
tttccaagttcccaaggcctacagctgaaggttggagaaatgccagctgccctttcgtccccacactgtggaggaagggacctgtggcagctcacaggcakgaggggtggccgtgcacaggtgcccaggctccaaggacagctccggcagcagcccttaggtacctgtgttttgtttgggaactcggaggccctccccctc

SEQ ID NO: 3531 - DNA, 201 bp, Homo sapiens; identical to SEQ ID NO: 3506

SEQ ID NO: 3532 - DNA, 201 bp, Homo sapiens; identical to SEQ ID NO: 3507

SEQ ID NO: 3533 - DNA, 201 bp, Homo sapiens; identical to SEQ ID NO: 3508

SEQ ID NO: 3534 - DNA, 201 bp, Homo sapiens; identical to SEQ ID NO: 3510

SEQ ID NO: 3535 - DNA, 201 bp, Homo sapiens
gtggccgtgcacaggtgcccaggctccaaggacagctccggcagcagcccttaggtacctgtgttttgtttgggaactcggaggccctccccctcccccakctcagaccacagaggtggcaagagaagggctgaagctggaagactgttcatgagggacttgtgtgacctgctttgaaatgtgtgactctgctgagtgacg

SEQ ID NO: 3536 - DNA, 201 bp, Homo sapiens; identical to SEQ ID NO: 3512
  misc_feature (1)...(201): n = A,T,C or G, or insertion/deletion polymorphism (see Tables 1-2)

SEQ ID NO: 3537 - DNA, 127 bp, Homo sapiens; identical to SEQ ID NO: 3513

SEQ ID NO: 3538 - DNA, 201 bp, Homo sapiens
gcctccagggcaggaccttggagggaggaacaacgagcagaaggccctggcgactgggctgagcccccaagtgaaactgaggttcaggagaccggcctgtycctgagtttgagtgccgaccaacccccaggatggcggaagctcaccaggccgtggccttccagttcacggtgaccccagacggggtcgacttccggctca

SEQ ID NO: 3539 - DNA, 201 bp, Homo sapiens; identical to SEQ ID NO: 3515
  misc_feature (1)...(201): n = A,T,C or G, or insertion/deletion polymorphism (see Tables 1-2)

SEQ ID NO: 3540 - DNA, 201 bp, Homo sapiens; identical to SEQ ID NO: 3502

SEQ ID NO: 3541 - DNA, 201 bp, Homo sapiens
gatagatactaataaaaataaggctgtgtaattttctctcagcccttaggtacctgtgttttgtttgggaactcggaggccctccccctcccccagctcaraccacagaggtggcaagagaagggctgaagctggaagactgttcatgagggacttgtgtgacctgctttgaaatgtgtgactctgctgagtgacgtaggc

SEQ ID NO: 3542 - DNA, 201 bp, Homo sapiens; identical to SEQ ID NO: 3504
  misc_feature (1)...(201): n = A,T,C or G, or insertion/deletion polymorphism (see Tables 1-2)

SEQ ID NO: 3543 - DNA, 201 bp, Homo sapiens
tggagcaggaagggaattttgatttttttttttcttgatagatactaataaaaataaggctgtgtaattttctctcagcccttaggtacctgtgttttgtytgggaactcggaggccctccccctcccccagctcagaccacagaggtggcaagagaagggctgaagctggaagactgttcatgagggacttgtgtgacct

SEQ ID NO: 3544 - DNA, 201 bp, Homo sapiens
tttccaagttcccaaggcctacagctgaaggttggagaaatgccagctgccctttcgtccccacactgtggaggaagggacctgtggcagctcacaggcakgaggggtggccgtgcacaggtgcccaggctccaaggacagctccggcagcaggtcctcgctgggcagatgctgctccctgagggcccaggtggtggaggt

SEQ ID NO: 3545 - DNA, 201 bp, Homo sapiens; identical to SEQ ID NO: 3508

SEQ ID NO: 3546 - DNA, 201 bp, Homo sapiens
ttcttgatagatactaataaaaataaggctgtgtaattttctctcagcccttaggtacctgtgttttgtttgggaactcggaggccctccccctcccccakctcagaccacagaggtggcaagagaagggctgaagctggaagactgttcatgagggacttgtgtgacctgctttgaaatgtgtgactctgctgagtgacg

SEQ ID NO: 3547 - DNA, 118 bp, Homo sapiens
gctatttttagctctaawgccaccatcctcacgagactctggggccccccaggctcccagacctttgagcaaccttcaccgcacagaaacccagccgcgccctgcaattcccaccgcg

SEQ ID NO: 3548 - DNA, 201 bp, Homo sapiens; identical to SEQ ID NO: 3510

SEQ ID NO: 3549 - DNA, 201 bp, Homo sapiens; identical to SEQ ID NO: 3512
  misc_feature (1)...(201): n = A,T,C or G, or insertion/deletion polymorphism (see Tables 1-2)

SEQ ID NO: 3550 - DNA, 201 bp, Homo sapiens; identical to SEQ ID NO: 3515
  misc_feature (1)...(201): n = A,T,C or G, or insertion/deletion polymorphism (see Tables 1-2)

SEQ ID NO: 3551 - DNA, 130 bp, Homo sapiens
gagcccccaagtgaaactgaggttcaggagaccggcctgttcctgagtttgagtaggtccccatggctggcaggccagagccccgtgctgtgtatgtaacmcaataaacaagcttcttcttcccaccctg

SEQ ID NO: 3552 - DNA, 108 bp, Homo sapiens
ttcaggagaccggcctgttcctgagtttgagtaggtccccatggctggcaggccagagccccgtgctgtgtatgtaacacaataaacaagcttcttcttcscaccctg

SEQ ID NO: 3553 - DNA, 107 bp, Homo sapiens
tcaggagaccggcctgttcctgagtttgagtaggtccccatggctggcaggccagagccccgtgctgtgtatgtaacacaataaacaagcttcttcttccmaccctg

SEQ ID NO: 3554 - DNA, 201 bp, Homo sapiens; identical to SEQ ID NO: 3506

SEQ ID NO: 3555 - DNA, 153 bp, Homo sapiens
cagaaggccctggcgactgggctgagcccccaagtgaaactgaggttcaggagaccggcctgttcctgagtttgagtaggtccccatggctggcaggccaragccccgtgctgtgtatgtaacacaataaacaagcttcttcttcccaccctg

SEQ ID NO: 3556 - DNA, 190 bp, Homo sapiens
gcctccagggcaggaccttggagggaggaacaacgagcagaaggccctggcgactgggctgagcccccaagtgaaactgaggttcaggagaccggcctgtycctgagtttgagtaggtccccatggctggcaggccagagccccgtgctgtgtatgtaacacaataaacaagcttcttcttcccaccctg

SEQ ID NO: 3557 - DNA, 201 bp, Homo sapiens; identical to SEQ ID NO: 3502

SEQ ID NO: 3558 - DNA, 201 bp, Homo sapiens; identical to SEQ ID NO: 3527

SEQ ID NO: 3559 - DNA, 201 bp, Homo sapiens; identical to SEQ ID NO: 3504
  misc_feature (1)...(201): n = A,T,C or G, or insertion/deletion polymorphism (see Tables 1-2)

SEQ ID NO: 3560 - DNA, 201 bp, Homo sapiens; identical to SEQ ID NO: 3529

SEQ ID NO: 3561 - DNA, 201 bp, Homo sapiens; identical to SEQ ID NO: 3530

SEQ ID NO: 3562 - DNA, 201 bp, Homo sapiens; identical to SEQ ID NO: 3506

SEQ ID NO: 3563 - DNA, 201 bp, Homo sapiens; identical to SEQ ID NO: 3508

SEQ ID NO: 3564 - DNA, 201 bp, Homo sapiens; identical to SEQ ID NO: 3535

SEQ ID NO: 3565 - DNA, 201 bp, Homo sapiens; identical to SEQ ID NO: 3510

SEQ ID NO: 3566 - DNA, 201 bp, Homo sapiens; identical to SEQ ID NO: 3511

SEQ ID NO: 3567 - DNA, 201 bp, Homo sapiens; identical to SEQ ID NO: 3512
  misc_feature (1)...(201): n = A,T,C or G, or insertion/deletion polymorphism (see Tables 1-2)

SEQ ID NO: 3568 - DNA, 201 bp, Homo sapiens; identical to SEQ ID NO: 3514

SEQ ID NO: 3569 - DNA, 201 bp, Homo sapiens; identical to SEQ ID NO: 3515
  misc_feature (1)...(201): n = A,T,C or G, or insertion/deletion polymorphism (see Tables 1-2)

SEQ ID NO: 3570 - DNA, 201 bp, Homo sapiens; identical to SEQ ID NO: 3502

SEQ ID NO: 3571 - DNA, 201 bp, Homo sapiens; identical to SEQ ID NO: 3541

SEQ ID NO: 3572 - DNA, 201 bp, Homo sapiens; identical to SEQ ID NO: 3504
  misc_feature (1)...(201): n = A,T,C or G, or insertion/deletion polymorphism (see Tables 1-2)

SEQ ID NO: 3573 - DNA, 201 bp, Homo sapiens; identical to SEQ ID NO: 3543

SEQ ID NO: 3574 - DNA, 201 bp, Homo sapiens; identical to SEQ ID NO: 3544

SEQ ID NO: 3575 - DNA, 201 bp, Homo sapiens; identical to SEQ ID NO: 3508

SEQ ID NO: 3576 - DNA, 201 bp, Homo sapiens; identical to SEQ ID NO: 3546

SEQ ID NO: 3577 - DNA, 201 bp, Homo sapiens; identical to SEQ ID NO: 3510

SEQ ID NO: 3578 - DNA, 201 bp, Homo sapiens; identical to SEQ ID NO: 3512
  misc_feature (1)...(201): n = A,T,C or G, or insertion/deletion polymorphism (see Tables 1-2)

SEQ ID NO: 3579 - DNA, 201 bp, Homo sapiens; identical to SEQ ID NO: 3515
  misc_feature (1)...(201): n = A,T,C or G, or insertion/deletion polymorphism (see Tables 1-2)

SEQ ID NO: 3580 - DNA, 201 bp, Homo sapiens; identical to SEQ ID NO: 3526

SEQ ID NO: 3581 - DNA, 201 bp, Homo sapiens; identical to SEQ ID NO: 3502

SEQ ID NO: 3582 - DNA, 201 bp, Homo sapiens; identical to SEQ ID NO: 3527

SEQ ID NO: 3583 - DNA, 201 bp, Homo sapiens; identical to SEQ ID NO: 3504
  misc_feature (1)...(201): n = A,T,C or G, or insertion/deletion polymorphism (see Tables 1-2)

SEQ ID NO: 3584 - DNA, 201 bp, Homo sapiens; identical to SEQ ID NO: 3529

SEQ ID NO: 3585 - DNA, 201 bp, Homo sapiens; identical to SEQ ID NO: 3530

SEQ ID NO: 3586 - DNA, 201 bp, Homo sapiens; identical to SEQ ID NO: 3506

SEQ ID NO: 3587 - DNA, 201 bp, Homo sapiens; identical to SEQ ID NO: 3507

SEQ ID NO: 3588 - DNA, 201 bp, Homo sapiens; identical to SEQ ID NO: 3508

SEQ ID NO: 3589 - DNA, 201 bp, Homo sapiens; identical to SEQ ID NO: 3535

SEQ ID NO: 3590 - DNA, 201 bp, Homo sapiens; identical to SEQ ID NO: 3510

SEQ ID NO: 3591 - DNA, 201 bp, Homo sapiens; identical to SEQ ID NO: 3511

SEQ ID NO: 3592 - DNA, 201 bp, Homo sapiens; identical to SEQ ID NO: 3512
  misc_feature (1)...(201): n = A,T,C or G, or insertion/deletion polymorphism (see Tables 1-2)

SEQ ID NO: 3593 - DNA, 127 bp, Homo sapiens; identical to SEQ ID NO: 3513

SEQ ID NO: 3594 - DNA, 201 bp, Homo sapiens; identical to SEQ ID NO: 3514

SEQ ID NO: 3595 - DNA, 201 bp, Homo sapiens; identical to SEQ ID NO: 3515
  misc_feature (1)...(201): n = A,T,C or G, or insertion/deletion polymorphism (see Tables 1-2)

SEQ ID NO: 3596 - DNA, 201 bp, Homo sapiens
tccgcgacctcaccaagaactgggaggtggacgtggcggcccagctggctggatcagatctgcatttcttttgacgaaggcaagaccacaatgaacttcaytgaggcagcgttgttgatccagggctctgcctgcgtctacagtaagaaggtggaatacctctactcactcgtctaccaggcccttgatttcatctctgga

SEQ ID NO: 3597 - DNA, 201 bp, Homo sapiens
agccagagggcatgtcccccatggaaccagcgggcgtttcccccatgccagggacccagaaggacaccgggaggactgaggagcagccaatggaagtttcygtgtgcaggagccctgtcccagcactcggcttctcccaggagccaggcccctctccagaaggcccgatgcccctgggtgggggcgaggacgaggatgcag

SEQ ID NO: 3598 - DNA, 201 bp, Homo sapiens
aggagcccgcagcagagtgctgccctgcccaggaggtacatgctgcgggagcgggagggggccccagagcctgcatcctgcgtgaaggagactccagaccyctggcagagcctggacccctttgactccttggagtctaagcccttcaagaaaggtaggccttactctgtgcccccctgtgtggaggaggctctgggacag

SEQ ID NO: 3599 - DNA, 201 bp, Homo sapiens
tcctcatcatccccctcctgcccatggccctggtggcccctgatgaaatggagaagaacaacaatcccctgtacagaggggccttcatgttggagccagarggcatgtcccccatggaaccagcgggcgtttcccccatgccagggacccagaaggacaccgggaggactgaggagcagccaatggaagtttccgtgtgca

SEQ ID NO: 3600 - DNA, 126 bp, Homo sapiens
agcaaaatggcgccagaactagtggygggctgaggacgccgtacccctcggaaggcagccctgcggtccctttgccgcccgttccctcccggacatggaggacgtggaggcgcgcttcgcccacct

SEQ ID NO: 3601 - DNA, 201 bp, Homo sapiens
agaacaacaatcccctgtacagaggggccttcatgttggagccagagggcatgtcccccatggaaccagcgggcgtttcccccatgccagggacccagaakgacaccgggaggactgaggagcagccaatggaagtttccgtgtgcaggagccctgtcccagcactcggcttctcccaggagccaggcccctctccagaag

SEQ ID NO: 3602 - DNA, 201 bp, Homo sapiens
ggacaccgggaggactgaggagcagccaatggaagtttccgtgtgcaggagccctgtcccagcactcggcttctcccaggagccaggcccctctccagaasgcccgatgcccctgggtgggggcgaggacgaggatgcagaggaggcagtagagcttcctgaggcctcggcccccaaggccgctctggagcccaaggagtc

SEQ ID NO: 3603 - DNA, 201 bp, Homo sapiens
ctgtgactagcctgggcaacctgtttggtggagccggtcagacccaacagtcttgggtggaagtcctggacgtagcgggccatggcttcaacgtcgtcccrctcggggtccacagtgatgaagacaggctgcactggaggcaaaccaggctctgcttccagctgccgcaccacctgcaccagcttctccagctcgtctggg

SEQ ID NO: 3604 - DNA, 201 bp, Homo sapiens
tgctccggccgtagtaatccgtgaagaggccgtcagggttgagcaggtagatggcaatggagtggtccacgatgtagtcctggtcctcatccttggggcckgcattgtagtacacgcggtaactgtgactagcctgggcaacctgtttggtggagccggtcagacccaacagtcttgggtggaagtcctggacgtagcggg

SEQ ID NO: 3605 - DNA, 201 bp, Homo sapiens
acccagaaggacaccgggaggactgaggagcagccaatggaagtttccgtgtgcaggagccctgtcccagcactcggcttctcccaggagccaggcccctstccagaaggcccgatgcccctgggtgggggcgaggacgaggatgcagaggaggcagtagagcttcctgaggcctcggcccccaaggccgctctggagccc

SEQ ID NO: 3606 - DNA, 201 bp, Homo sapiens
gcgcacaagcgcttccagacctacgctgccccctccatggcccagccctgagtggggagcaccgaggcaggggtgggggaatgtgtactgaggagccgtgygtctgctcctggctggcccggcctaataaagcagtgttgccatctcatcttccccctaaaaacccttttatgtacacctgcgcagagaagagggctgcct

SEQ ID NO: 3607 - DNA, 201 bp, Homo sapiens
cttcggcgaaagggtccgtcctttgcagacatggaggtcctgtactggacacacgtgaaggagcagttggaaactctccggaagctgcagaggagggaggyaaatgctttctctggacaggtggctgagcagtggctgcggcctgcagaggaggaccacctggaggattccctggaagacctgggggcagcagatgacttt

SEQ ID NO: 3608 - DNA, 201 bp, Homo sapiens
tggcaatggagtggtccacgatgtagtcctggtcctcatccttggggcctgcattgtagtacacgcggtaactgtgactagcctgggcaacctgtttggtrgagccggtcagacccaacagtcttgggtggaagtcctggacgtagcgggccatggcttcaacgtcgtcccgctcggggtccacagtgatgaagacaggct

SEQ ID NO: 3609 - DNA, 128 bp, Homo sapiens
tcgtcccgctcggggtccacagtgatgaagacaggctgcactggaggcaaaccaggctctgcttccagctgccgcaccacctgcaccagcttctccagctygtctgggcagatgtcagggcagtgagt

SEQ ID NO: 3610 - DNA, 201 bp, Homo sapiens
ggcccgatgcccctgggtgggggcgaggacgaggatgcagaggaggcagtagagcttcctgaggcctcggcccccaaggccgctctggagcccaaggagtycaggagcccgcagcagagtgctgccctgcccaggaggtacatgctgcgggagcgggagggggccccagagcctgcatcctgcgtgaaggagactccagac

SEQ ID NO: 3611 - DNA, 201 bp, Homo sapiens
catgtgccgccgcacactgtctgagatctgctcagccgatctgctccggccgtagtaatccgtgaagaggccgtcagggttgagcaggtagatggcaatgragtggtccacgatgtagtcctggtcctcatccttggggcctgcattgtagtacacgcggtaactgtgactagcctgggcaacctgtttggtggagccggt

SEQ ID NO: 3612 - DNA, 201 bp, Homo sapiens
aactgggaggtggacgtggcggcccagctgggcgagtatctggaggagctggatcagatctgcatttcttttgacgaaggcaagaccacaatgaacttcaytgaggcagcgttgttgatccagggctctgcctgcgtctacagtaagaaggtggaatacctctactcactcgtctaccaggcccttgatttcatctctgga

SEQ ID NO: 3613 - DNA, 201 bp, Homo sapiens; identical to SEQ ID NO: 3597

SEQ ID NO: 3614 - DNA, 201 bp, Homo sapiens; identical to SEQ ID NO: 3598

SEQ ID NO: 3615 - DNA, 201 bp, Homo sapiens
ccctgtacagccgtcagggtgaggtcctggccagccggaaggatttcaggatgaacacgtgcgttccccaccccagaggggccttcatgttggagccagarggcatgtcccccatggaaccagcgggcgtttcccccatgccagggacccagaaggacaccgggaggactgaggagcagccaatggaagtttccgtgtgca

SEQ ID NO: 3616 - DNA, 201 bp, Homo sapiens
ctctctggcttttgcccacgttacgtcatagacatgcgcgcgacgccgcgcctacgcattttcctgggcgggaacagcaaaatggcgccagaactagtggygggctgaggacgccgtacccctcggaaggcagccctgcggtccctttgccgcccgttccctcccggacatggaggacgtggaggcgcgcttcgcccacct

SEQ ID NO: 3617 - DNA, 201 bp, Homo sapiens
acacgtgcgttccccaccccagaggggccttcatgttggagccagagggcatgtcccccatggaaccagcgggcgtttcccccatgccagggacccagaakgacaccgggaggactgaggagcagccaatggaagtttccgtgtgcaggagccctgtcccagcactcggcttctcccaggagccaggcccctctccagaag

SEQ ID NO: 3618 - DNA, 201 bp, Homo sapiens; identical to SEQ ID NO: 3602

SEQ ID NO: 3619 - DNA, 201 bp, Homo sapiens; identical to SEQ ID NO: 3603

SEQ ID NO: 3620 - DNA, 201 bp, Homo sapiens; identical to SEQ ID NO: 3604

SEQ ID NO: 3621 - DNA, 201 bp, Homo sapiens; identical to SEQ ID NO: 3605

SEQ ID NO: 3622 - DNA, 201 bp, Homo sapiens; identical to SEQ ID NO: 3606

SEQ ID NO: 3623 - DNA, 201 bp, Homo sapiens
cttcggcgaaagggtccgtcctttgcagacatggaggtcctgtactggacacacgtgaaggagcagttggaaactctccggaagctgcagaggagggaggyaagtggctgagcagtggctgcggcctgcagaggaggaccacctggaggattccctggaagacctgggggcagcagatgactttctagagcctgaggagta

SEQ ID NO: 3624 - DNA, 201 bp, Homo sapiens; identical to SEQ ID NO: 3608

SEQ ID NO: 3625 - DNA, 128 bp, Homo sapiens; identical to SEQ ID NO: 3609

SEQ ID NO: 3626 - DNA, 201 bp, Homo sapiens; identical to SEQ ID NO: 3610

SEQ ID NO: 3627 - DNA, 201 bp, Homo sapiens; identical to SEQ ID NO: 3611

SEQ ID NO: 3628 - DNA, 201 bp, Homo sapiens; identical to SEQ ID NO: 3612

SEQ ID NO: 3629 - DNA, 201 bp, Homo sapiens; identical to SEQ ID NO: 3597

SEQ ID NO: 3630 - DNA, 201 bp, Homo sapiens; identical to SEQ ID NO: 3598

SEQ ID NO: 3631 - DNA, 201 bp, Homo sapiens; identical to SEQ ID NO: 3615

SEQ ID NO: 3632 - DNA, 201 bp, Homo sapiens; identical to SEQ ID NO: 3616

SEQ ID NO: 3633 - DNA, 201 bp, Homo sapiens; identical to SEQ ID NO: 3617

SEQ ID NO: 3634 - DNA, 201 bp, Homo sapiens; identical to SEQ ID NO: 3602

SEQ ID NO: 3635 - DNA, 201 bp, Homo sapiens; identical to SEQ ID NO: 3603

SEQ ID NO: 3636 - DNA, 201 bp, Homo sapiens; identical to SEQ ID NO: 3604

SEQ ID NO: 3637 - DNA, 201 bp, Homo sapiens; identical to SEQ ID NO: 3605

SEQ ID NO: 3638 - DNA, 201 bp, Homo sapiens; identical to SEQ ID NO: 3606

SEQ ID NO: 3639 - DNA, 201 bp, Homo sapiens
ggcttcggcgaaagggtccgtcctttgcagacatggaggtcctgtactggacacacgtgaaggagcagttggaaactctccggaagctgcagaggagggaygtggctgagcagtggctgcggcctgcagaggaggaccacctggaggattccctggaagacctgggggcagcagatgactttctagagcctgaggagtaca

SEQ ID NO: 3640 - DNA, 201 bp, Homo sapiens; identical to SEQ ID NO: 3608

SEQ ID NO: 3641 - DNA, 128 bp, Homo sapiens; identical to SEQ ID NO: 3609

SEQ ID NO: 3642 - DNA, 201 bp, Homo sapiens; identical to SEQ ID NO: 3610

SEQ ID NO: 3643 - DNA, 201 bp, Homo sapiens; identical to SEQ ID NO: 3611

SEQ ID NO: 3644 - DNA, 201 bp, Homo sapiens; identical to SEQ ID NO: 3596

SEQ ID NO: 3645 - DNA, 201 bp, Homo sapiens; identical to SEQ ID NO: 3597

SEQ ID NO: 3646 - DNA, 201 bp, Homo sapiens; identical to SEQ ID NO: 3598

SEQ ID NO: 3647 - DNA, 201 bp, Homo sapiens; identical to SEQ ID NO: 3615

SEQ ID NO: 3648 - DNA, 126 bp, Homo sapiens; identical to SEQ ID NO: 3600

SEQ ID NO: 3649 - DNA, 201 bp, Homo sapiens; identical to SEQ ID NO: 3617

SEQ ID NO: 3650 - DNA, 201 bp, Homo sapiens; identical to SEQ ID NO: 3602

SEQ ID NO: 3651 - DNA, 201 bp, Homo sapiens; identical to SEQ ID NO: 3603

SEQ ID NO: 3652 - DNA, 201 bp, Homo sapiens; identical to SEQ ID NO: 3604

SEQ ID NO: 3653 - DNA, 201 bp, Homo sapiens; identical to SEQ ID NO: 3605

SEQ ID NO: 3654 - DNA, 201 bp, Homo sapiens; identical to SEQ ID NO: 3606

SEQ ID NO: 3655 - DNA, 201 bp, Homo sapiens; identical to SEQ ID NO: 3607

SEQ ID NO: 3656 - DNA, 201 bp, Homo sapiens; identical to SEQ ID NO: 3608

SEQ ID NO: 3657 - DNA, 128 bp, Homo sapiens; identical to SEQ ID NO: 3609

SEQ ID NO: 3658 - DNA, 201 bp, Homo sapiens; identical to SEQ ID NO: 3610

SEQ ID NO: 3659 - DNA, 201 bp, Homo sapiens; identical to SEQ ID NO: 3611

SEQ ID NO: 3660 - DNA, 201 bp, Homo sapiens; identical to SEQ ID NO: 3596

SEQ ID NO: 3661 - DNA, 201 bp, Homo sapiens; identical to SEQ ID NO: 3597

SEQ ID NO: 3662 - DNA, 201 bp, Homo sapiens; identical to SEQ ID NO: 3598

SEQ ID NO: 3663 - DNA, 201 bp, Homo sapiens; identical to SEQ ID NO: 3615

SEQ ID NO: 3664 - DNA, 126 bp, Homo sapiens; identical to SEQ ID NO: 3600

SEQ ID NO: 3665 - DNA, 201 bp, Homo sapiens; identical to SEQ ID NO: 3617

SEQ ID NO: 3666 - DNA, 201 bp, Homo sapiens; identical to SEQ ID NO: 3602

SEQ ID NO: 3667 - DNA, 201 bp, Homo sapiens; identical to SEQ ID NO: 3603

SEQ ID NO: 3668 - DNA, 201 bp, Homo sapiens; identical to SEQ ID NO: 3604

SEQ ID NO: 3669 - DNA, 201 bp, Homo sapiens; identical to SEQ ID NO: 3605

SEQ ID NO: 3670 - DNA, 201 bp, Homo sapiens; identical to SEQ ID NO: 3606

SEQ ID NO: 3671 - DNA, 201 bp, Homo sapiens; identical to SEQ ID NO: 3607

SEQ ID NO: 3672 - DNA, 201 bp, Homo sapiens; identical to SEQ ID NO: 3608

SEQ ID NO: 3673 - DNA, 128 bp, Homo sapiens; identical to SEQ ID NO: 3609

SEQ ID NO: 3674 - DNA, 201 bp, Homo sapiens; identical to SEQ ID NO: 3610

SEQ ID NO: 3675 - DNA, 201 bp, Homo sapiens; identical to SEQ ID NO: 3611

SEQ ID NO: 3676 - DNA, 201 bp, Homo sapiens; identical to SEQ ID NO: 3612

SEQ ID NO: 3677 - DNA, 201 bp, Homo sapiens; identical to SEQ ID NO: 3605

SEQ ID NO: 3678 - DNA, 201 bp, Homo sapiens; identical to SEQ ID NO: 3597

SEQ ID NO: 3679 - DNA, 201 bp, Homo sapiens; identical to SEQ ID NO: 3615

SEQ ID NO: 3680 - DNA, 201 bp, Homo sapiens; identical to SEQ ID NO: 3617

SEQ ID NO: 3681 - DNA, 201 bp, Homo sapiens; identical to SEQ ID NO: 3602

SEQ ID NO: 3682 - DNA, 201 bp, Homo sapiens
tgaaaggttttgctctacttcctgaagacctgaacaccgctcccataaagccatggcttgccttggatttcagcggcacaaggctcagctgaacctggctrccaggacctggccctgcactctcctgttttttcttctcttcatccctgtcttctgcaaagcaatgcacgtggcccagcctgctgtggtactggccagcag

SEQ ID NO: 3683 - DNA, 201 bp, Homo sapiens
ggccctgcactctcctgttttttcttctcttcatccctgtcttctgcaaagcaatgcacgtggcccagcctgctgtggtactggccagcagccgaggcatsgccagctttgtgtgtgagtatgcatctccaggcaaagccactgaggtccgggtgacagtgcttcggcaggctgacagccaggtgactgaagtctgtgcgg

SEQ ID NO: 3684 - DNA, 201 bp, Homo sapiens
tgtgagtatgcatctccaggcaaagccactgaggtccgggtgacagtgcttcggcaggctgacagccaggtgactgaagtctgtgcggcaacctacatgayggggaatgagttgaccttcctagatgattccatctgcacgggcacctccagtggaaatcaagtgaacctcactatccaaggactgagggccatggacacg

SEQ ID NO: 3685 - DNA, 201 bp, Homo sapiens
ccattgcagttcagaaactggagagcttggaggacgatgatgttctgcattaccttctacaattggtccaggctgtgaaatttgaaccataccatgatagygcccttgccagatttctgctgaagcgtggtttaagaaacaaaagaattggtcactttttgttttggttcttgagaagtgagatagcccagtccagacact

SEQ ID NO: 3686 - DNA, 201 bp, Homo sapiens
tctcaattttggttatctttgtgttcctcaagctctttaaagaaaaagatgtaatcgttgtaacctttgtctcattccttaaatgatgcttccaaacatckccttagtgtctgcaggtgttagtggtgtgctaaaagcaaggaaagcgagttagtcttttcagtgtcttttgcaattcaattcttttgtcatgtataactg

SEQ ID NO: 3687 - DNA, 201 bp, Homo sapiens
agctttctccagcatggcagcaggaagtaactacagggcctcttttatgcctgacatttcttcccttcctttttccctgcctccctttttcatcaattgcratgctcccacaactctttacagacttgtgaaatcttcaagaacacctttactctataactcaaaaattagttgaaaaataattacttctcaaggattatt

SEQ ID NO: 3688 - DNA, 201 bp, Homo sapiens
ttccttaaatgatgcttccaaacatctccttagtgtctgcaggtgttagtggtgtgctaaaagcaaggaaagcgagttagtcttttcagtgtcttttgcarttcaattcttttgtcatgtataactgagacacacaaacacagcaggagaaatctaaaccgttgtgccttgaccttcctctgctggtcttgttccagggtt

SEQ ID NO: 3689 - DNA, 201 bp, Homo sapiens
cttaaaaatattccaagttaggaagaacactacttgccttatccatttcccatttaaaggacttttaaactttgacacatccttcagatttcctgaaaatmattgaaatatcttactttaaaaatattttcatctctgaaatatctcgttatttattggaggtattgtttaaccttagagagaccattaaattatttataa

SEQ ID NO: 3690 - DNA, 201 bp, Homo sapiens
cttatcagcctgggcaacacagtgagactccatctcttaaaaaaaaaattagctgggtatagtggtatgtgcctgtagtcccaggtactcaggaggctgasgcaggaggattgcctgagcccaggaggtggaaactgcagagagtcatgatcatgtccttacactccagcctggataacagagcgagaccctgtctcaaaa

SEQ ID NO: 3691 - DNA, 201 bp, Homo sapiens
agtgggtgaggcactgcctcaagaacggagaagagattcacgtggtactggacacgcctccagacccggccctagacgaggtgaggaaggaagagtggccrctggtggacgactgcacgggagtcaccggctaccatgagcagcttaccatccacggcaaggaccacgagagtgtgttcaccgtgtccctgtgggactgcg

SEQ ID NO: 3692 - DNA, 201 bp, Homo sapiens
ttaaaaatattccaagttaggaagaacactacttgccttatccatttcccatttaaaggacttttaaactttgacacatccttcagatttcctgaaaatamttgaaatatcttactttaaaaatattttcatctctgaaatatctcgttatttattggaggtattgtttaaccttagagagaccattaaattatttataaa

SEQ ID NO: 3693 - DNA, 201 bp, Homo sapiens
ggcactgcctcaagaacggagaagagattcacgtggtactggacacgcctccagacccggccctagacgaggtgaggaaggaagagtggccgctggtggaygactgcacgggagtcaccggctaccatgagcagcttaccatccacggcaaggaccacgagagtgtgttcaccgtgtccctgtgggactgcgaccgcaagt

SEQ ID NO: 3694 - DNA, 201 bp, Homo sapiens
tccttcagatttcctgaaaataattgaaatatcttactttaaaaatattttcatctctgaaatatctcgttatttattggaggtattgtttaaccttagakagaccattaaattatttataaaatattttgtaattacctgtagctaatacattacatagaaaaaaactatgttaacagtgtctctgtttaagtataatca

SEQ ID NO: 3695 - DNA, 201 bp, Homo sapiens
tatgttaacagtgtctctgtttaagtataatcagatataaatatatacttaattttttaattttaaaaatagatacctgtttgactttgaggtagtccagrccttttctttttttttttttttttaatgtgtgcaaaagcccaaaggttcctaagcctggctgcaaagaagaatcaacagggacactttttaaaaacactc

SEQ ID NO: 3696 - DNA, 201 bp, Homo sapiens
agtgtctctgtttaagtataatcagatataaatatatacttaattttttaattttaaaaatagatacctgtttgactttgaggtagtccagaccttttctytttttttttttttttaatgtgtgcaaaagcccaaaggttcctaagcctggctgcaaagaagaatcaacagggacactttttaaaaacactcttatcagcc

SEQ ID NO: 3697 - DNA, 201 bp, Homo sapiens
ctgtggaatgtgtggcttgagttcagtatcaaaatcaaagacttgcccaaaggggctctactgaacctccagatctactgcggtaaagctccagcactgtmcagcaaggcctctgcagagtcccccagttctgagtccaagggcaaagttcagcttctctattatgtgaacctgctgctgatagaccaccgtttcctcctg

SEQ ID NO: 3698 - DNA, 201 bp, Homo sapiens
ctcaagaacggagaagagattcacgtggtactggacacgcctccagacccggccctagacgaggtgaggaaggaagagtggccgctggtggacgactgcaygggagtcaccggctaccatgagcagcttaccatccacggcaaggaccacgagagtgtgttcaccgtgtccctgtgggactgcgaccgcaagttcagggtc

SEQ ID NO: 3699 - DNA, 201 bp, Homo sapiens
atcagatataaatatatacttaattttttaattttaaaaatagatacctgtttgactttgaggtagtccagaccttttctttttttttttttttttaatgkgtgcaaaagcccaaaggttcctaagcctggctgcaaagaagaatcaacagggacactttttaaaaacactcttatcagcctgggcaacacagtgagactc

SEQ ID NO: 3700 - DNA, 201 bp, Homo sapiens
attgttggccagaagggaagtctgggatcaaagtgctttggatgttgggttaacaatgcagctcctggactgcaacttctcagatgaaaatgtaagagccrttgcagttcagaaactggagagcttggaggacgatgatgttctgcattaccttctacaattggtccaggctgtgaaatttgaaccataccatgatagcgc

SEQ ID NO: 3701 - DNA, 201 bp, Homo sapiens
gggaagggagaagaccaaggaagcttcaatgctgacaaactcacgtctgcaactaacccagacaaggagaactcaatgtccatctccattcttctggacarttactgccacccgatagccctgcctaagcatcagcccacccctgacccggaaggggaccgggttcgagcagaaatgcccaaccagcttcgcaagcaattg

SEQ ID NO: 3702 - DNA, 201 bp, Homo sapiens
atgatccttcagcatcatcgcctccgctgctttatcaggtcgcatagggcatggagctggagaactataaacagcccgtggtgctgagagaggacaactgycgaaggcgccggaggatgaagccgcgcagtgctgcggccagcctgtcctccatggagctcatccccatcgagttcgtgctgcccaccagccagcgcaaat

SEQ ID NO: 3703 - DNA, 201 bp, Homo sapiens
gctggtggacgactgcacgggagtcaccggctaccatgagcagcttaccatccacggcaaggaccacgagagtgtgttcaccgtgtccctgtgggactgckaccgcaagttcagggtcaagatcagaggcattgatatccccgtcctgcctcggaacaccgacctcacagtttttgtagaggcaaacatccagcatgggca

SEQ ID NO: 3704 - DNA, 201 bp, Homo sapiens
gcagtttaattggtttctacatcttgttcttggcatcaaacaaggagagaaacattcagcctaatactttaggctagaatcaaaaacaagttagtgttctrtggtttaaattagcatagcaatcatcgaacttggatttcaaatgcaatagacattgtgaaagctggcatttcagaagtatagctcttttcctacctgaac

SEQ ID NO: 3705 - DNA, 201 bp, Homo sapiens
atgttggcattgctgattgtttggttaagcaatgtccagtgctaggattatttgcaggtttggttttttctcatttgtctgtggcattggagaatattctyggtttaaacagactaatgacttccttattgtccctgatattttgactatcttactattgagtgcttctggaaattctttggaataattgatgacatctat

SEQ ID NO: 3706 - DNA, 201 bp, Homo sapiens
cagtgtctctgtttaagtataatcagatataaatatatacttaattttttaattttaaaaatagatacctgtttgactttgaggtagtccagaccttttctttttttttttttttttaatgtgtgcaaaagcccaaaggttcctaagcctggctgcaaagaagaatcaacagggacactttttaaaaacactcttatcagc

SEQ ID NO: 3707 - DNA, 201 bp, Homo sapiens
gacaaaggatggactgtgcagtttaattggtttctacatcttgttcttggcatcaaacaaggagagaaacattcagcctaatactttaggctagaatcaaraacaagttagtgttctatggtttaaattagcatagcaatcatcgaacttggatttcaaatgcaatagacattgtgaaagctggcatttcagaagtatagc

SEQ ID NO: 3708 - DNA, 201 bp, Homo sapiens; identical to SEQ ID NO: 3685

SEQ ID NO: 3709 - DNA, 201 bp, Homo sapiens; identical to SEQ ID NO: 3686

SEQ ID NO: 3710 - DNA, 201 bp, Homo sapiens; identical to SEQ ID NO: 3687

SEQ ID NO: 3711 - DNA, 201 bp, Homo sapiens; identical to SEQ ID NO: 3688

SEQ ID NO: 3712 - DNA, 201 bp, Homo sapiens; identical to SEQ ID NO: 3689

SEQ ID NO: 3713 - DNA, 201 bp, Homo sapiens; identical to SEQ ID NO: 3690

SEQ ID NO: 3714 - DNA, 201 bp, Homo sapiens; identical to SEQ ID NO: 3691

SEQ ID NO: 3715 - DNA, 201 bp, Homo sapiens; identical to SEQ ID NO: 3692

SEQ ID NO: 3716 - DNA, 201 bp, Homo sapiens; identical to SEQ ID NO: 3693

SEQ ID NO: 3717 - DNA, 201 bp, Homo sapiens; identical to SEQ ID NO: 3694

SEQ ID NO: 3718 - DNA, 201 bp, Homo sapiens; identical to SEQ ID NO: 3695

SEQ ID NO: 3719 - DNA, 201 bp, Homo sapiens; identical to SEQ ID NO: 3696

SEQ ID NO: 3720 - DNA, 201 bp, Homo sapiens; identical to SEQ ID NO: 3697

SEQ ID NO: 3721 - DNA, 201 bp, Homo sapiens; identical to SEQ ID NO: 3698

SEQ ID NO: 3722 - DNA, 201 bp, Homo sapiens; identical to SEQ ID NO: 3699

SEQ ID NO: 3723 - DNA, 201 bp, Homo sapiens; identical to SEQ ID NO: 3700

SEQ ID NO: 3724 - DNA, 201 bp, Homo sapiens; identical to SEQ ID NO: 3701

SEQ ID NO: 3725 - DNA, 201 bp, Homo sapiens
aggggaaagcttcatagcctcaaccatgaaggaaaccagtcgcatagggcatggagctggagaactataaacagcccgtggtgctgagagaggacaactgycgaaggcgccggaggatgaagccgcgcagtgctgcggccagcctgtcctccatggagctcatccccatcgagttcgtgctgcccaccagccagcgcaaat

SEQ ID NO: 3726 - DNA, 201 bp, Homo sapiens; identical to SEQ ID NO: 3703

SEQ ID NO: 3727 - DNA, 201 bp, Homo sapiens; identical to SEQ ID NO: 3704

SEQ ID NO: 3728 - DNA, 201 bp, Homo sapiens; identical to SEQ ID NO: 3705

SEQ ID NO: 3729 - DNA, 201 bp, Homo sapiens; identical to SEQ ID NO: 3706

SEQ ID NO: 3730 - DNA, 201 bp, Homo sapiens; identical to SEQ ID NO: 3707

SEQ ID NO: 3731 - DNA, 201 bp, Homo sapiens
aagattgctcacaaagtacatgctcaagtcatcagataacatgctccaatggtcagtgtatcccaagtgaatacaggtgcgaccacgtcagagactgcccmgatggagctgatgagaatgactgccagtacccaacatgtgagcagcttacttgtgacaatggggcctgctataacaccagtcagaagtgtgattggaaag

SEQ ID NO: 3732 - DNA, 201 bp, Homo sapiens
caagtgtactaccaggcttccctgaggccctatggagtgactgtttaccattccctcagacagccctatgctaccaatccgtgtaaagataacaatggggrctgtgagcaggtctgtgttctcagccacagaacagataatgatggtttgggtttccgttgcaagtgcacattcggcttccaactggatacagatgagcgc

SEQ ID NO: 3733 - DNA, 201 bp, Homo sapiens
atttgcctgcctgtaccaggaggattgttttcctgcgcctgtgccactggatttaaactcaatcctgataatcggtcctgctctccatataactctttcaytgttgtttcaatgctgtctgcaatcagaggctttagcttggaattgtcagatcattcagaaaccatggtgccggtggcaggccaaggacgaaacgcactg

SEQ ID NO: 3734 - DNA, 121 bp, Homo sapiens
tgcacaacaggaaccatggcaggaatatacactttcccatagcaaatagcatacctgactctctgtgctaatattgcacatttgttaaacaatgaatgaadggatggatggatggatggat

SEQ ID NO: 3735 - DNA, 201 bp, Homo sapiens
ggtcctgctctccatataactctttcattgttgtttcaatgctgtctgcaatcagaggctttagcttggaattgtcagatcattcagaaaccatggtgccrgtggcaggccaaggacgaaacgcactgcatgtggatgtggatgtgtcctctggctttatttattggtgtgattttagcagctcagtggcatctgataatg

SEQ ID NO: 3736 - DNA, 201 bp, Homo sapiens
cggtgccaaatttccagcgagtgtgtgggtgcccttatggaatgaggctggcttccaatcacttgacatgcgagggggacccaaccaatgaaccacccacrgagcagtgtggcttattttccttcccctgtaaaaatggcagatgtgtgcccaattactatctctgtgatggagtcgatgattgtcatgataacagtgatg

SEQ ID NO: 3737 - DNA, 201 bp, Homo sapiens
gccacttctgcttcccggtgccaaatttccagcgagtgtgtgggtgcccttatggaatgaggctggcttccaatcacttgacatgcgagggggacccaacmaatgaaccacccacagagcagtgtggcttattttccttcccctgtaaaaatggcagatgtgtgcccaattactatctctgtgatggagtcgatgattgtc

SEQ ID NO: 3738 - DNA, 201 bp, Homo sapiens
agatgaacgtcaagattgctcacaaagtacatgctcaagtcatcagataacatgctccaatggtcagtgtatcccaagtgaatacaggtgcgaccacgtcrgagactgccccgatggagctgatgagaatgactgccagtacccaacatgtgagcagcttacttgtgacaatggggcctgctataacaccagtcagaagtg

SEQ ID NO: 3739 - DNA, 201 bp, Homo sapiens
ccagttcacttgccccagtggccgatgcatttatcaaaactgggtttgtgatggagaagatgactgtaaagataatggagatgaagatggatgtgaaagcsgtcctcatgatgttcataaatgttccccaagagaatggtcttgcccagagtcgggacgatgcatctccatttataaagtttgtgatgggattttagattg

SEQ ID NO: 3740 - DNA, 201 bp, Homo sapiens
gccatcgattgggctgcttcacgattgtactgggtagatgcctattttgataaaattgagcacagcacctttgatggtttagacagaagaagactgggccrtatagagcagatgacacatccgtttggacttgccatctttggagagcatttattttttactgactggagactgggtgccattattcgagtcaggaaagca

SEQ ID NO: 3741 - DNA, 201 bp, Homo sapiens
aaagtttggcttttgattggatttcaaagaatctctattggacagactctcattacaagagtatcagtgtcatgaggctagctgataaaacgagacgcacrgtagttcagtatttaaataacccacggtcggtggtagttcatccttttgccgggtatctattcttcactgattggttccgtcctgctaaaattatgagag

SEQ ID NO: 3742 - DNA, 201 bp, Homo sapiens
atatgtcaaaacacatgatttttaagcaaaagattgatggcacaggaagagaaattctcgcagctaacagggtggaaaatgttgaaagtttggcttttgaytggatttcaaagaatctctattggacagactctcattacaagagtatcagtgtcatgaggctagctgataaaacgagacgcacagtagttcagtatttaa

SEQ ID NO: 3743 - DNA, 201 bp, Homo sapiens
ccggggaaggaacggcgaggccggggaccgtcgcggagatggatcgcgggccggcagcagtggcgtgcacgctgctcctggctctcgtcgcctgcctagcsccggccagtggccaagaatgtgacagtgcgcattttcgctgtggaagtgggcattgcatccctgcagactggaggtgtgatgggaccaaagactgttcag

SEQ ID NO: 3744 - DNA, 201 bp, Homo sapiens
cttggagttggctttccaattggcataactgttgatcctgctcgtgggaagctgtactggtcagaccaaggaactgacagtggggttcctgccaagatcgscagtgctaacatggatggcacatctgtgaaaactctctttactgggaacctcgaacacctggagtgtgtcactcttgacatcgaagagcagaaactctac

SEQ ID NO: 3745 - DNA, 201 bp, Homo sapiens
gcagccacctctgccttctgagacctggaggatacagctgtgcctgtccccaaggctccagctttatagaggggagcaccactgagtgtgatgcagccatygaactgcctatcaacctgccccccccatgcaggtgcatgcacggaggaaattgctattttgatgagactgacctccccaaatgcaagtgtcctagcggct

SEQ ID NO: 3746 - DNA, 201 bp, Homo sapiens
tgccagcagggctatttcaagtgccagagtgagggacaatgcatccccaactcctgggtgtgtgaccaagatcaagactgtgatgatggctcagatgaacrtcaagattgctcacaaagtacatgctcaagtcatcagataacatgctccaatggtcagtgtatcccaagtgaatacaggtgcgaccacgtcagagactgc

SEQ ID NO: 3747 - DNA, 201 bp, Homo sapiens
ggatgagcccattgaagaatgcatgagctctgcccatctctgtgacaacttcacagaattcagctgcaaaacaaattaccgctgcatcccaaagtgggccrtgtgcaatggtgtagatgactgcagggacaacagtgatgagcaaggctgtgaggagaggacatgccatcctgtgggggatttccgctgtaaaaatcacca

SEQ ID NO: 3748 - DNA, 201 bp, Homo sapiens
tcattgaaagagttgataaggccactggggccaacaaaatagtcttgagagataatgttccaaatctgaggggtcttcaagtttatcacagacgcaatgcygccgaatcctcaaatggctgtagcaacaacatgaatgcctgtcagcagatttgcctgcctgtaccaggaggattgttttcctgcgcctgtgccactggat

SEQ ID NO: 3749 - DNA, 201 bp, Homo sapiens
attgtcatgataacagtgatgagcaactatgtggcacacttaataatacctgttcatcttcggcgttcacctgtggccatggggagtgcattcctgcacamtggcgctgtgacaaacgcaacgactgtgtggatggcagtgatgagcacaactgccccacccacgcacctgcttcctgccttgacacccaatacacctgtg

SEQ ID NO: 3750 - DNA, 201 bp, Homo sapiens
aaatctgaggggtcttcaagtttatcacagacgcaatgccgccgaatcctcaaatggctgtagcaacaacatgaatgcctgtcagcagatttgcctgcctrtaccaggaggattgttttcctgcgcctgtgccactggatttaaactcaatcctgataatcggtcctgctctccatataactctttcattgttgtttcaat

SEQ ID NO: 3751 - DNA, 201 bp, Homo sapiens
cctgtccccaaggctccagctttatagaggggagcaccactgagtgtgatgcagccatcgaactgcctatcaacctgccccccccatgcaggtgcatgcayggaggaaattgctattttgatgagactgacctccccaaatgcaagtgtcctagcggctacaccggaaaatattgtgaaatggcgttttcaaaaggcatct

SEQ ID NO: 3752 - DNA, 201 bp, Homo sapiens
caatgtccgaattcgaaaatataatctctcatctgagaggttctcagagtatcttcaagatgaggaatatatccaagctgttgattatgattgggatcccraggacataggcctcagtgttgtgtattacactgtgcgaggggagggctctaggtttggtgctatcaaacgtgcctacatccccaactttgaatccggccg

SEQ ID NO: 3753 - DNA, 201 bp, Homo sapiens
cgtagaattaaaccagatggatcttctctgatgaacattgtgacacatggaataggagaaaatggagtccggggtattgcagtggattgggtagcaggaamtctttatttcaccaatgcctttgtttctgaaacactgatagaagttctgcggatcaatactacttaccgccgtgttcttcttaaagtcacagtggacatg

SEQ ID NO: 3754 - DNA, 201 bp, Homo sapiens
ctgagatatgcttgcacaatgagttttcatgtggcaatggagagtgtatccctcgtgcttatgtctgtgaccatgacaatgattgccaagacggcagtgaygaacatgcttgcaactatccgacctgcggtggttaccagttcacttgccccagtggccgatgcatttatcaaaactgggtttgtgatggagaagatgact

SEQ ID NO: 3755 - DNA, 201 bp, Homo sapiens
gactctctatggccagtatatttactggactgacttgtacacacaaagaatttaccgagctaacaaatatgacgggtcaggtcagattgcaatgaccacaratttgctctcccagcccaggggaatcaacactgttgtgaagaaccagaaacaacagtgtaacaatccttgtgaacagtttaatgggggctgcagccatat

SEQ ID NO: 3756 - DNA, 201 bp, Homo sapiens
ctggactgacttgtacacacaaagaatttaccgagctaacaaatatgacgggtcaggtcagattgcaatgaccacaaatttgctctcccagcccaggggartcaacactgttgtgaagaaccagaaacaacagtgtaacaatccttgtgaacagtttaatgggggctgcagccatatctgtgcaccaggtccaaatggtgc

SEQ ID NO: 3757 - DNA, 201 bp, Homo sapiens
ccctgaggccctatggagtgactgtttaccattccctcagacagccctatgctaccaatccgtgtaaagataacaatgggggctgtgagcaggtctgtgtyctcagccacagaacagataatgatggtttgggtttccgttgcaagtgcacattcggcttccaactggatacagatgagcgccactgcattgctgttcaga

SEQ ID NO: 3758 - DNA, 201 bp, Homo sapiens
gagccaacaagtggcatggagggaaccagtcagttgtaatgtataatattcaatggccccttgggattgttgcggttcatccttcgaaacaaccaaattcygtgaatccatgtgccttttcccgctgcagccatctctgcctgctttcctcacaggggcctcatttttactcctgtgtttgtccttcaggatggagtctgt

SEQ ID NO: 3759 - DNA, 201 bp, Homo sapiens
  misc_feature (1)...(201): n = A,T,C or G, or insertion/deletion polymorphism (see Tables 1-2)
cgtttatttgtgtgacggagacaatgactgtggagataacagtgatgaaaaccctacttattgcaccactcacacgtgcagcagcagtgagttccaatgcncatctgggcgctgtattcctcaacattggtattgtgatcaagaaacagattgttttgatgcctctgatgaacctgcctcttgtggtcactctgagcgaac

SEQ ID NO: 3760 - DNA, 201 bp, Homo sapiens
cacgctttcctgatggtgcatactgccaggctactatgttcgaatgcaaaaaccatgtttgtatcccgccatattggaaatgtgatggcgatgatgactgyggcgatggttcagatgaagaacttcacctgtgcttggatgttccctgtaattcaccaaaccgtttccggtgtgacaacaatcgctgcatttatagtcatg

SEQ ID NO: 3761 - DNA, 201 bp, Homo sapiens
cctgtggtaccaacaatggtggctgttctcatctctgcctcatcaagccaggaggaaaagggttcacttgcgagtgtccagatgacttccgcacccttcarctgagtggcagcacctactgcatgcccatgtgctccagcacccagttcctgtgcgctaacaatgaaaagtgcattcctatctggtggaaatgtgatggac

SEQ ID NO: 3762 - DNA, 201 bp, Homo sapiens
cttcaccagctgctgatggaactcaggtgacaaaatggaatctcttcaaacgaaaatctaaacaaactaccaactttgaaaatccaatctatgcacagatrgagaacgagcaaaaggaaagtgttgctgcgacaccacctccatcaccttcgctccctgctaagcctaagcctccttcgagaagagacccaactccaacct

SEQ ID NO: 3763 - DNA, 201 bp, Homo sapiens
ttgtccaggacaagatcttctggccctgcggcttaactattgactaccccaacagactgctctacttcatggactcctatcttgattacatggacttttgygattataatggacaccatcggagacaggtgatagccagtgatttgattatacggcacccctatgccctaactctctttgaagactctgtgtactggactg

SEQ ID NO: 3764 - DNA, 201 bp, Homo sapiens
acctggagtgtgtcactcttgacatcgaagagcagaaactctactgggcagtcactggaagaggagtgattgaaagaggaaacgtggatggaacagatcgratgatcctggtacaccagctttcccacccctggggaattgcagtccatgattctttcctttattatactgatgaacagtatgaggtcattgaaagagttg

SEQ ID NO: 3765 - DNA, 201 bp, Homo sapiens
ggggcttggcagtggaccgaagtgatggctacgtttattgggttgatgattctttagatataattgcaaggattcgtatcaatggagagaactctgaagtrattcgttatggcagtcgttacccaactccttatggcatcactgtttttgaaaattctatcatatgggtagataggaatttgaaaaagatcttccaagcca

SEQ ID NO: 3766 - DNA, 201 bp, Homo sapiens
aaagtggctgatttccactgacctggaccaaccagctgctattgctgtgaatcccaaactagggcttatgttctggactgactggggaaaggaacctaaamtcgagtctgcctggatgaatggagaggaccgcaacatcctggttttcgaggaccttggttggccaactggcctttctatcgattatttgaacaatgaccg

SEQ ID NO: 3767 - DNA, 201 bp, Homo sapiens
aggctcctacatctgtaagtgtgccccaggctacctccgagaaccagatggaaagacctgccggcaaaacagtaacatcgaaccctatctcatttttagcraccgttactatttgagaaatttaactatagatggctatttttactccctcatcttggaaggactggacaatgttgtggcattagattttgaccgagtaga

SEQ ID NO: 3768 - DNA, 201 bp, Homo sapiens
aatcactatttatttcctaagttgaacctgaatagaaagggaaaccattcttattaagctttttattaggccctgtggctaaatgtgtacatttatattaraatgtactgtacagtccagatcttttctttaattcttattggttttttttttttttttttttttagagatggagtcttgctatattgccaaggctgatct

SEQ ID NO: 3769 - DNA, 201 bp, Homo sapiens
gtactgcttctcaattcaagtgtgccagtggggataaatgtattggcgtcacaaatcgttgtgatggtgtttttgattgcagtgacaactcggatgaagcrggctgtccaaccaggcctcctggtatgtgccactcagatgaatttcagtgccaagaagatggtatctgcatcccgaacttctgggaatgtgatgggcatc

SEQ ID NO: 3770 - DNA, 201 bp, Homo sapiens
gatgagaaaggctgtggcattaatgaatgccatgacccttcaatcagtggctgcgatcacaactgcacagacaccttaaccagtttctattgttcctgtcrtcctggttacaagctcatgtctgacaagcggacttgtgttgatattgatgaatgcacagagatgccttttgtctgtagccagaagtgtgagaatgtaata

SEQ ID NO: 3771 - DNA, 201 bp, Homo sapiens
aacttctgggaatgtgatgggcatccagactgcctctatggatctgatgagcacaatgcctgtgtccccaagacttgcccttcatcatatttccactgtgmcaacggaaactgcatccacagggcatggctctgtgatcgggacaatgactgcggggatatgagtgatgagaaggactgccctactcagccctttcgctgt

SEQ ID NO: 3772 - DNA, 201 bp, Homo sapiens
tcttacttgccaatgattctaagacctgtgaagacatagatgaatgtgatattctaggctcttgtagccagcactgttacaatatgagaggttctttccgstgctcgtgtgatacaggctacatgttagaaagtgatgggaggacttgcaaagttacagcatctgagagtctgctgttacttgtggcaagtcagaacaaaa

SEQ ID NO: 3773 - DNA, 201 bp, Homo sapiens
ggtgactggtccgatgaactgggttgcaataaaggaaaagaaagaacatgtgctgaaaatatatgcgagcaaaattgtacccaattaaatgaaggaggatytatctgctcctgtacagctgggttcgaaaccaatgtttttgacagaacctcctgtctagatatcaatgaatgtgaacaatttgggacttgtccccagcac

SEQ ID NO: 3774 - DNA, 201 bp, Homo sapiens
gggagggctctaggtttggtgctatcaaacgtgcctacatccccaactttgaatccggccgcaataatcttgtgcaggaagttgacctgaaactgaaataygtaatgcagccagatggaatagcagtggactgggttggaaggcatatttactggtcagatgtcaagaataaacgcattgaggtggctaaacttgatggaa

SEQ ID NO: 3775 - DNA, 201 bp, Homo sapiens
gtgatacaggctacatgttagaaagtgatgggaggacttgcaaagttacagcatctgagagtctgctgttacttgtggcaagtcagaacaaaattattgcsgacagtgtcacctcccaggtccacaatatctattcattggtcgagaatggttcttacattgtagctgttgattttgattcaattagtggtcgtatctttt

SEQ ID NO: 3776 - DNA, 201 bp, Homo sapiens
ttgactgtaccaatcgaacagtgcttgtgtcagagggcattgtcacaccacggggcttggcagtggaccgaagtgatggctacgtttattgggttgatgaytctttagatataattgcaaggattcgtatcaatggagagaactctgaagtgattcgttatggcagtcgttacccaactccttatggcatcactgtttttg

SEQ ID NO: 3777 - DNA, 201 bp, Homo sapiens
ggttgatgattctttagatataattgcaaggattcgtatcaatggagagaactctgaagtgattcgttatggcagtcgttacccaactccttatggcatcrctgtttttgaaaattctatcatatgggtagataggaatttgaaaaagatcttccaagccagcaaggaaccagagaacacagagccacccacagtgataag

SEQ ID NO: 3778 - DNA, 201 bp, Homo sapiens
gcagaaagtctggctgtagactgggtttccagaaagctctactggttggatgcccgcctggatggcctctttgtctctgacctcaatggtggacaccgccrcatgctggcccagcactgtgtggatgccaacaacaccttctgctttgataatcccagaggacttgcccttcaccctcaatatgggtacctctactgggca

SEQ ID NO: 3779 - DNA, 201 bp, Homo sapiens
tttttgaaaattctatcatatgggtagataggaatttgaaaaagatcttccaagccagcaaggaaccagagaacacagagccacccacagtgataagagayaatatcaactggctaagagatgtgaccatctttgacaagcaagtccagccccggtcaccagcagaggtcaacaacaacccttgcttggaaaacaatggtg

SEQ ID NO: 3780 - DNA, 201 bp, Homo sapiens
aaactcgagtctgcctggatgaatggagaggaccgcaacatcctggttttcgaggaccttggttggccaactggcctttctatcgattatttgaacaatgrccgaatctactggagtgacttcaaggaggacgttattgaaaccataaaatatgatgggactgataggagagtcattgcaaaggaagcaatgaacccttac

SEQ ID NO: 3781 - DNA, 201 bp, Homo sapiens
tcaacagaaaatttcctcatctttgccttgtctaattccttgagaagcttacacttggaccctgaaaaccatagcccacctttccaaacaataaatgtggraagaactgtcatgtctctagactatgacagtgtaagtgatagaatctacttcacacaaaatttagcctctggagttggacagatttcctatgccaccctg

SEQ ID NO: 3782 - DNA, 201 bp, Homo sapiens
gggcagatcttaacatggatattggagtgtctggttttggacctgagactgctattgacaggtcaatggcaatgagtgaagactttgtcatggaaatgggraagcagcccataatatttgaaaacccaatgtactcagccagagacagtgctgtcaaagtggttcagccaatccaggtgactgtatctgaaaatgtggata

SEQ ID NO: 3783 - DNA, 201 bp, Homo sapiens
accaaagactgttcagatgacgcggatgaaattggctgcgctgttgtgacctgccagcagggctatttcaagtgccagagtgagggacaatgcatccccarctcctgggtgtgtgaccaagatcaagactgtgatgatggctcagatgaacgtcaagattgctcacaaagtacatgctcaagtcatcagataacatgctcc

SEQ ID NO: 3784 - DNA, 201 bp, Homo sapiens
cagtatgaggtcattgaaagagttgataaggccactggggccaacaaaatagtcttgagagataatgttccaaatctgaggggtcttcaagtttatcacaracgcaatgccgccgaatcctcaaatggctgtagcaacaacatgaatgcctgtcagcagatttgcctgcctgtaccaggaggattgttttcctgcgcctgt

SEQ ID NO: 3785 - DNA, 201 bp, Homo sapiens
ctgatgagctgatgcacctgtgccacaccccagaacccacgtgtccacctcacgagttcaagtgtgacaatgggcgctgcatcgagatgatgaaactctgyaaccacctagatgactgtttggacaacagcgatgagaaaggctgtggcattaatgaatgccatgacccttcaatcagtggctgcgatcacaactgcacag

SEQ ID NO: 3786 - DNA, 194 bp, Homo sapiens
cgcctggccccggctctctggaccttgtctcgctcgggagcggaaacagcggcagccagagcataaaatacacaagaggatttttatggaatgrctccttgttacaagaactgttttaatcatggacaaacaaaactcacagatgaatgcttctcacccggaaacaaacttgccagttgggtatcctcctcagt

SEQ ID NO: 3787 - DNA, 201 bp, Homo sapiens
aaaaataagtggtccatgtgttgtgtgcagctgttgtggagatgttgattttgagattaaatctcttgatgaacagtgtgtggttggcaaaatttccaagyactggactggaattttgagagaggcatttacagacgctgataactttggaatccagttccctttagaccttgatgttaaaatgaaagctgtaatgattgg

SEQ ID NO: 3788 - DNA, 201 bp, Homo sapiens
ttaaatctcttgatgaacagtgtgtggttggcaaaatttccaagcactggactggaattttgagagaggcatttacagacgctgataactttggaatccarttccctttagaccttgatgttaaaatgaaagctgtaatgattggtgcctgtttcctcattgacttcatgttttttgaaagcactggcagccaggaacaaa

SEQ ID NO: 3789 - DNA, 194 bp, Homo sapiens; identical to SEQ ID NO: 3786

SEQ ID NO: 3790 - DNA, 201 bp, Homo sapiens
cagcattccaagatagatcagatactgattcatcagcaaattgaacttctggaagattaaatctcttgatgaacagtgtgtggttggcaaaatttccaagyactggactggaattttgagagaggcatttacagacgctgataactttggaatccagttccctttagaccttgatgttaaaatgaaagctgtaatgattgg

SEQ ID NO: 3791 - DNA, 201 bp, Homo sapiens
ttcaggaaacgaaaccaggagccgcgggtgttggcgcaaaggttactcccagacccttttccggctgacttctgagaaggttgcgcagcagctgtgcccgrcagtctagaggcgcagaagaggaagccatcgcctggccccggctctctggaccttgtctcgctcgggagcggaaacagcggcagccagagaactgtttta

SEQ ID NO: 3792 - DNA, 201 bp, Homo sapiens; identical to SEQ ID NO: 3788

SEQ ID NO: 3793 - DNA, 201 bp, Homo sapiens
tatttaagtcagatagatcagatactgattcatcagcaaattgaacttctggaagattaaatctcttgatgaacagtgtgtggttggcaaaatttccaagyactggactggaattttgagagaggcatttacagacgctgataactttggaatccagttccctttagaccttgatgttaaaatgaaagctgtaatgattgg

SEQ ID NO: 3794 - DNA, 201 bp, Homo sapiens; identical to SEQ ID NO: 3791

SEQ ID NO: 3795 - DNA, 161 bp, Homo sapiens
ttaaatctcttgatgaacagtgtgtggttggcaaaatttccaagcactggactggaattttgagagaggcatttacagacgctgataactttggaatccarttccctttagaccttgatgttaaaatgaaagctgtaatgattggtgcctgtttcctcatt

SEQ ID NO: 3796 - DNA, 201 bp, Homo sapiens
acacaaaatactcataaaaaacagaactgtgcttccagcttgcttaaccagattagcaaatgaataattcaccaaagtctgaaatagcaaaactgtatttyctgctaacagattactctaattcttctaggtctggttcaattttaaagcaaaatacaaatgccttagaaaattgtattttctgttatcttaaatacaatc

SEQ ID NO: 3797 - DNA, 201 bp, Homo sapiens
ttcaggaaacgaaaccaggagccgcgggtgttggcgcaaaggttactcccagacccttttccggctgacttctgagaaggttgcgcagcagctgtgcccgrcagtctagaggcgcagaagaggaagccatcgcctggccccggctctctggaccttgtctcgctcgggagcggaaacagcggcagccagaggaccacataa

SEQ ID NO: 3798 - DNA, 141 bp, Homo sapiens
tatcttaaatacaatctatgataatggccaatagcaaacatttaattagcactgtttcctgcctttgttgtatgcctgatacatgtattaactcatttaawccttattgaaagtctgtgatgtataggtgctacatttttc

SEQ ID NO: 3799 - DNA, 201 bp, Homo sapiens; identical to SEQ ID NO: 3787

SEQ ID NO: 3800 - DNA, 201 bp, Homo sapiens; identical to SEQ ID NO: 3791

SEQ ID NO: 3801 - DNA, 201 bp, Homo sapiens; identical to SEQ ID NO: 3788

SEQ ID NO: 3802 - DNA, 201 bp, Homo sapiens; identical to SEQ ID NO: 3787

SEQ ID NO: 3803 - DNA, 201 bp, Homo sapiens; identical to SEQ ID NO: 3788

SEQ ID NO: 3804 - DNA, 201 bp, Homo sapiens; identical to SEQ ID NO: 3787

SEQ ID NO: 3805 - DNA, 201 bp, Homo sapiens
ttcaggaaacgaaaccaggagccgcgggtgttggcgcaaaggttactcccagacccttttccggctgacttctgagaaggttgcgcagcagctgtgcccgrcagtctagaggcgcagaagaggaagccatcgcctggccccggctctctggaccttgtctcgctcgggagcggaaacagcggcagccagagactcacagat

SEQ ID NO: 3806 - DNA, 201 bp, Homo sapiens; identical to SEQ ID NO: 3788

SEQ ID NO: 3807 - DNA, 201 bp, Homo sapiens
gtactccagaaagcatgtctgctagagaaaaagcaataattgctaagctacctcaagagacagcacgaagtgacaggcccatcgaggtaaaggaaacagcrtttgatccacatgaagggagaaatgatgattcacattataccctttgtcaacgagatacagtaggtgtaatctatgacaatgattttgaaaaggaatcac

SEQ ID NO: 3808 - DNA, 201 bp, Homo sapiens
gtgcattctgcttttaactcagacactaatagagctcctcagaatagctctcctttttccaaacatcatactgaaatttcagtgtcaactaatgagcaggmaattgctgtagagaatgcagttactaccatggctagccaacctatttctacgaaatcagaaaatatttgtaattcaacaagagaaatccagggtattgag

SEQ ID NO: 3809 - DNA, 201 bp, Homo sapiens
gagaagcacccttatcctgagtctaaacctgaagaagtttccagaagttcaggaatagtgacatcaggtagtagaaaagaaagatgcataggccagatttkccaaacagaagagtatagtgtggaaaaatctctagggccaatgattttaatcaacaaacctcttgagaatatggaagaagcaaggcatgaaaatgaagga

SEQ ID NO: 3810 - DNA, 201 bp, Homo sapiens
cacacacacacacacataccttctttatagctacaaagtcagggcgttcataggcaaaatctgacaagactgaaacaattgggagattatctttcaattcygaaaaattctgtgggtggcctgtctttaagcaatgcttttctcttgtgagggaagactgtaacacagctgaactatttcagtgtcaactattcagaattg

SEQ ID NO: 3811 - DNA, 201 bp, Homo sapiens
atgaatatccagtatagcagtgactttgactgctgttattacctatagctaagtgtgtatgataatgaaactcatcattttagtcaagtagaggcaatgcraagattcacatagtttatttcaactatttattgaatgattactatatgcaaaactctgtgctctgttctgtggcatagaacttcctttgatatgctgcat

SEQ ID NO: 3812 - DNA, 201 bp, Homo sapiens
tcatgggtcattacagaatatcaaaaagcaacttcaaaactggatttacagttgggaatgttaccaacagacaaaactgtattttcagaaaacagagatcwtaggcaggttcaagaattatcaaagaaaacagactcggatgccattgtgcattctgcttttaactcagacactaatagagctcctcagaatagctctcct

SEQ ID NO: 3813 - DNA, 201 bp, Homo sapiens
tcttttttcataggaaattccttcataaaacatgtaacactgatcttcagatagaaaaagcaatctgtttatttacctgtaagggcaaagtcaatgagtamaacttgcatatgtcatcccatataactaagacatatgcatttatgggaagacaaaacaagaatgaaacacttatactgactttcatctggtagtaaatga

SEQ ID NO: 3814 - DNA, 201 bp, Homo sapiens
aagacaaaacaagaatgaaacacttatactgactttcatctggtagtaaatgatttccttaatttttattaggtacgtaactatttccaaatcctctaatygcatactactctcaagtcccattgaaaatgaatgcttgacttcaactttttagttgaccaaatacaaacatcctaaagtagagcttagggcaaatatttg

SEQ ID NO: 3815 - DNA, 201 bp, Homo sapiens
acacaggtgtctgagctagaattattctcttaaaagacaacataactttttatgtcttttatttactttttggtaatattaacttaccaaatcttctcctrtgcatttttaatatgacaaaacaaattttaaaagatttgaaataattgtatttctctgaattcagtgaagaaataattcatgattcaactgcatctccaa

SEQ ID NO: 3816 - DNA, 201 bp, Homo sapiens
tcgaaattggattatgcaataggatcttatttagttatttgaatctgtcttagccagttcctgtagaactgagaaataagattgactttgaatctgcaacragatctgaaataaatgagaagccaagctcttcaagcacctctatctctgtactcctatatgaagagaacagtaaaaaaaattactggtatttatttggtt

SEQ ID NO: 3817 - DNA, 201 bp, Homo sapiens
gagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattc

SEQ ID NO: 3818 - DNA, 201 bp, Homo sapiens
agagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatatt

SEQ ID NO: 3819 - DNA, 201 bp, Homo sapiens
ccatggtgaaatatgtactgacttgttccaaaggtctctgtctccaagttcatcagcagaaagctccgtaaagggagatttttactgcaatgaaaaatatkcctcaggagatgactgtacacatcaaccttcagaggaaactacttcaaatatgggagaaatcaagccatcattgggagatactagtagtgatgaactagt

SEQ ID NO: 3820 - DNA, 201 bp, Homo sapiens
gagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatat

SEQ ID NO: 3821 - DNA, 201 bp, Homo sapiens
gggtcattacagaatatcaaaaagcaacttcaaaactggatttacagttgggaatgttaccaacagacaaaactgtattttcagaaaacagagatcatagkcaggttcaagaattatcaaagaaaacagactcggatgccattgtgcattctgcttttaactcagacactaatagagctcctcagaatagctctccttttt

SEQ ID NO: 3822 - DNA, 201 bp, Homo sapiens
acatgaccaagaaaggaagatgggtaaccctaaaataagtgtggcagggattggagctagtaacagagacctggctactctgctgagcgaacataccgcartccccacccgggcaatcacagcagatgtgtctcattcaccaaggacaaatttaagttgggaagaagctgtgttaaccccagagcatcatcatttgactag

SEQ ID NO: 3823 - DNA, 201 bp, Homo sapiens
ttgagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacat

SEQ ID NO: 3824 - DNA, 201 bp, Homo sapiens
gcataggtacgtagtgtgacacttctgacttcactgaaattatggaagaaagacacccagaggaggcctctttggttggttcttttttcataggaaattcmttcataaaacatgtaacactgatcttcagatagaaaaagcaatctgtttatttacctgtaagggcaaagtcaatgagtaaaacttgcatatgtcatccca

SEQ ID NO: 3825 - DNA, 201 bp, Homo sapiens
agacaaaactgtattttcagaaaacagagatcataggcaggttcaagaattatcaaagaaaacagactcggatgccattgtgcattctgcttttaactcakacactaatagagctcctcagaatagctctcctttttccaaacatcatactgaaatttcagtgtcaactaatgagcaggcaattgctgtagagaatgcagt

SEQ ID NO: 3826 - DNA, 201 bp, Homo sapiens
atttggaagccagtaatcgaaatgtaaaagatgtaaacagggaacatgatgaacataatgaaaaagaattagagttgatgataaatcaacacttaataagraccagaagtactgcttccagagatgaaaggaatacattttcaacagatccagtcaattttccaaataaagcagaggggttagagaagaagcaaatccatg

SEQ ID NO: 3827 - DNA, 151 bp, Homo sapiens
atattttgccattaatccaatatgtttccatcactttgccaaaacctatttaaaacagtgaattaaattttcactaggtttgaatgatcatgttttataasaaatgtctttattttagtgtgttaaaaccttattaaacaaacaactgttt

SEQ ID NO: 3828 - DNA, 201 bp, Homo sapiens
ttctctagctgatcatggcattactgagaaagcagaagctggtacagcctatataattaagacaacatcagaaagtactccagaaagcatgtctgctagaraaaaagcaataattgctaagctacctcaagagacagcacgaagtgacaggcccatcgaggtaaaggaaacagcgtttgatccacatgaagggagaaatga

SEQ ID NO: 3829 - DNA, 201 bp, Homo sapiens
agtaaaacttgcatatgtcatcccatataactaagacatatgcatttatgggaagacaaaacaagaatgaaacacttatactgactttcatctggtagtaratgatttccttaatttttattaggtacgtaactatttccaaatcctctaattgcatactactctcaagtcccattgaaaatgaatgcttgacttcaactt

SEQ ID NO: 3830 - DNA, 201 bp, Homo sapiens
atcattgggagatactagtagtgatgaactagtgcaattacatactggcagcaaagaagtcctggatgataatgctaatccagcccatggcaatggcacartgcaaataccttgcccctcttcagatcaactaatggcaggaaaccttaataaaaaacatgaaggaggagctaaaaaaattgaagtaaaagatttgggatg

SEQ ID NO: 3831 - DNA, 201 bp, Homo sapiens
atattttcccctacggttttaaaaaacagataaaacatggacaatggcagaggacttttttggtcttttagtattgaacatgaaatttgtatttaacactktatcatttatcaggattcattgatcaaatatttcaacctttcatatttttaagaaaacacccatatatattgaaatgcaaacttaaacatattctgttca

SEQ ID NO: 3832 - DNA, 201 bp, Homo sapiens
atccagcccatggcaatggcacaatgcaaataccttgcccctcttcagatcaactaatggcaggaaaccttaataaaaaacatgaaggaggagctaaaaawattgaagtaaaagatttgggatgtttacgaagagatttccattcagatacgtcggcatgtctcaaagaatcaacagaagaaggatcttctaaggaagatt

SEQ ID NO: 3833 - DNA, 201 bp, Homo sapiens
atatattttcccctacggttttaaaaaacagataaaacatggacaatggcagaggacttttttggtcttttagtattgaacatgaaatttgtatttaacamtgtatcatttatcaggattcattgatcaaatatttcaacctttcatatttttaagaaaacacccatatatattgaaatgcaaacttaaacatattctgtt

SEQ ID NO: 3834 - DNA, 201 bp, Homo sapiens
agtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattct

SEQ ID NO: 3835 - DNA, 201 bp, Homo sapiens
gctgtgttaaccccagagcatcatcatttgactagtgaaggcagcgctttaggagggataactggtcaagtttgttcatcaagaactggaaatgttttgargaatgattatcttttccaagttgaagaaaaatcaggtgggattaattctgaagatcaggataatagcccacagcataaacaaagttggaatgttctggaa

SEQ ID NO: 3836 - DNA, 201 bp, Homo sapiens
ggtacagcctatataattaagacaacatcagaaagtactccagaaagcatgtctgctagagaaaaagcaataattgctaagctacctcaagagacagcacraagtgacaggcccatcgaggtaaaggaaacagcgtttgatccacatgaagggagaaatgatgattcacattataccctttgtcaacgagatacagtaggt

SEQ ID NO: 3837 - DNA, 201 bp, Homo sapiens; identical to SEQ ID NO: 3807

SEQ ID NO: 3838 - DNA, 201 bp, Homo sapiens; identical to SEQ ID NO: 3808

SEQ ID NO: 3839 - DNA, 201 bp, Homo sapiens; identical to SEQ ID NO: 3809

SEQ ID NO: 3840 - DNA, 201 bp, Homo sapiens; identical to SEQ ID NO: 3810

SEQ ID NO: 3841 - DNA, 201 bp, Homo sapiens; identical to SEQ ID NO: 3811

SEQ ID NO: 3842 - DNA, 201 bp, Homo sapiens; identical to SEQ ID NO: 3812

SEQ ID NO: 3843 - DNA, 201 bp, Homo sapiens; identical to SEQ ID NO: 3813

SEQ ID NO: 3844 - DNA, 201 bp, Homo sapiens; identical to SEQ ID NO: 3814

SEQ ID NO: 3845 - DNA, 201 bp, Homo sapiens; identical to SEQ ID NO: 3815

SEQ ID NO: 3846 - DNA, 201 bp, Homo sapiens; identical to SEQ ID NO: 3816

SEQ ID NO: 3847 - DNA, 201 bp, Homo sapiens; identical to SEQ ID NO: 3817

SEQ ID NO: 3848 - DNA, 201 bp, Homo sapiens; identical to SEQ ID NO: 3818

SEQ ID NO: 3849 - DNA, 201 bp, Homo sapiens; identical to SEQ ID NO: 3819

SEQ ID NO: 3850 - DNA, 201 bp, Homo sapiens; identical to SEQ ID NO: 3820

SEQ ID NO: 3851 - DNA, 201 bp, Homo sapiens; identical to SEQ ID NO: 3821

SEQ ID NO: 3852 - DNA, 201 bp, Homo sapiens; identical to SEQ ID NO: 3822

SEQ ID NO: 3853 - DNA, 201 bp, Homo sapiens; identical to SEQ ID NO: 3823

SEQ ID NO: 3854 - DNA, 201 bp, Homo sapiens; identical to SEQ ID NO: 3824

SEQ ID NO: 3855 - DNA, 201 bp, Homo sapiens; identical to SEQ ID NO: 3825

SEQ ID NO: 3856 - DNA, 201 bp, Homo sapiens; identical to SEQ ID NO: 3826

SEQ ID NO: 3857 - DNA, 151 bp, Homo sapiens; identical to SEQ ID NO: 3827

SEQ ID NO: 3858 - DNA, 201 bp, Homo sapiens; identical to SEQ ID NO: 3828

SEQ ID NO: 3859 - DNA, 201 bp, Homo sapiens; identical to SEQ ID NO: 3829

SEQ ID NO: 3860 - DNA, 201 bp, Homo sapiens; identical to SEQ ID NO: 3830

SEQ ID NO: 3861 - DNA, 201 bp, Homo sapiens; identical to SEQ ID NO: 3831

SEQ ID NO: 3862 - DNA, 201 bp, Homo sapiens; identical to SEQ ID NO: 3832

SEQ ID NO: 3863 - DNA, 201 bp, Homo sapiens; identical to SEQ ID NO: 3833

SEQ ID NO: 3864 - DNA, 201 bp, Homo sapiens; identical to SEQ ID NO: 3834

SEQ ID NO: 3865 - DNA, 201 bp, Homo sapiens; identical to SEQ ID NO: 3835

SEQ ID NO: 3866 - DNA, 201 bp, Homo sapiens; identical to SEQ ID NO: 3836

SEQ ID NO: 3867 - DNA, 201 bp, Homo sapiens
cagaaccccagtgcccaggcactgggcctgggcaaacataattactgccggactggacggagtgtgagctctccggctacggcaagcatgaggccttgtcycctttctattcggagcggctgaaggaggctcatgtcagactgtacccatccagccgctgcacatcacaacatttacttaacagaacagtcaccgacaaca

SEQ ID NO: 3868 - DNA, 201 bp, Homo sapiens
cggagcggctgaaggaggctcatgtcagactgtacccatccagccgctgcacatcacaacatttacttaacagaacagtcaccgacaacatgctgtgtgcwggagacactcggagcggcgggccccaggcaaacttgcacgacgcctgccagggcgattcgggaggccccctggtgtgtctgaacgatggccgcatgactt

SEQ ID NO: 3869 - DNA, 201 bp, Homo sapiens
cgcatgactttggtgggcatcatcagctggggcctgggctgtggacagaaggatgtcccgggtgtgtacaccaaggttaccaactacctagactggattcrtgacaacatgcgaccgtgaccaggaacacccgactcctcaaaagcaaatgagatcccgcctcttcttcttcagaagacactgcaaaggcgcagtgcttct

SEQ ID NO: 3870 - DNA, 201 bp, Homo sapiens
ccagtgcccaggcactgggcctgggcaaacataattactgccggactggacggagtgtgagctctccggctacggcaagcatgaggccttgtctcctttcyattcggagcggctgaaggaggctcatgtcagactgtacccatccagccgctgcacatcacaacatttacttaacagaacagtcaccgacaacatgctgtg

SEQ ID NO: 3871 - DNA, 201 bp, Homo sapiens
caacagtggcagggcacagtgccactcagtgcctgtcaaaagttgcagcgagccaaggtgtttcaacgggggcacctgccagcaggccctgtacttctcaratttcgtgtgccagtgccccgaaggatttgctgggaagtgctgtgaaatagataccagggccacgtgctacgaggaccagggcatcagctacaggggcac

SEQ ID NO: 3872 - DNA, 201 bp, Homo sapiens
aaggtattccttttgtgtacagtgtgtaaagtgtaaatcctttttctttataaactttagagtagcatgagagaattgtatcatttgaacaactaggcttmagcatatttatagcaatccatgttagtttttactttctgttgccacaaccctgttttatactgtacttaataaattcagatatatttttcacagtttttc

SEQ ID NO: 3873 - DNA, 201 bp, Homo sapiens
acgggggcacctgccagcaggccctgtacttctcagatttcgtgtgccagtgccccgaaggatttgctgggaagtgctgtgaaatagataccagggccacrtgctacgaggaccagggcatcagctacaggggcacgtggagcacagcggagagtggcgccgagtgcaccaactggaacagcagcgcgttggcccagaagc

SEQ ID NO: 3874 - DNA, 201 bp, Homo sapiens
actggattcgtgacaacatgcgaccgtgaccaggaacacccgactcctcaaaagcaaatgagatcccgcctcttcttcttcagaagacactgcaaaggcgsagtgcttctctacagacttctccagacccaccacaccgcagaagcgggacgagaccctacaggagagggaagagtgcattttcccagatacttcccattt

SEQ ID NO: 3875 - DNA, 201 bp, Homo sapiens
ggtgggcatcatcagctggggcctgggctgtggacagaaggatgtcccgggtgtgtacaccaaggttaccaactacctagactggattcgtgacaacatgygaccgtgaccaggaacacccgactcctcaaaagcaaatgagatcccgcctcttcttcttcagaagacactgcaaaggcgcagtgcttctctacagacttc

SEQ ID NO: 3876 - DNA, 201 bp, Homo sapiens
ccagggcatcagctacaggggcacgtggagcacagcggagagtggcgccgagtgcaccaactggaacagcagcgcgttggcccagaagccctacagcgggyggaggccagatgccatcaggctgggcctggggaaccacaactactgcagaaacccagatcgagactcaaagccctggtgctacgtctttaaggcggggaa

SEQ ID NO: 3877 - DNA, 201 bp, Homo sapiens
gctacaggggcacgtggagcacagcggagagtggcgccgagtgcaccaactggaacagcagcgcgttggcccagaagccctacagcgggcggaggccagaygccatcaggctgggcctggggaaccacaactactgcagaaacccagatcgagactcaaagccctggtgctacgtctttaaggcggggaagtacagctcag

SEQ ID NO: 3878 - DNA, 201 bp, Homo sapiens
gcagcgtggtccgcactgtgtgccttcccccggcggacctgcagctgccggactggacggagtgtgagctctccggctacggcaagcatgaggccttgtcycctttctattcggagcggctgaaggaggctcatgtcagactgtacccatccagccgctgcacatcacaacatttacttaacagaacagtcaccgacaaca

SEQ ID NO: 3879 - DNA, 201 bp, Homo sapiens; identical to SEQ ID NO: 3868

SEQ ID NO: 3880 - DNA, 201 bp, Homo sapiens; identical to SEQ ID NO: 3869

SEQ ID NO: 3881 - DNA, 201 bp, Homo sapiens
ggtccgcactgtgtgccttcccccggcggacctgcagctgccggactggacggagtgtgagctctccggctacggcaagcatgaggccttgtctcctttcyattcggagcggctgaaggaggctcatgtcagactgtacccatccagccgctgcacatcacaacatttacttaacagaacagtcaccgacaacatgctgtg

SEQ ID NO: 3882 - DNA, 201 bp, Homo sapiens
cccactgcttccaggagaggtttccgccccaccacctgacggtgatcttgggcagaacataccgggtggtccctggcgaggaggagcagaaatttgaagtmgaaaaatacattgtccataaggaattcgatgatgacacttacgacaatgacattgcgctgctgcagctgaaatcggattcgtcccgctgtgcccaggaga

SEQ ID NO: 3883 - DNA, 201 bp, Homo sapiens; identical to SEQ ID NO: 3872

SEQ ID NO: 3884 - DNA, 201 bp, Homo sapiens
ccagtgcccaggcactgggcctgggcaaacataattactgccggaatcctgatggggatgccaagccctggtgccacgtgctgaagaaccgcaggctgacrtgggagtactgtgatgtgccctcctgctccacctgcggcctgagacagtacagccagcctcagtttcgcatcaaaggagggctcttcgccgacatcgcct

SEQ ID NO: 3885 - DNA, 201 bp, Homo sapiens
aatccatgcccgattcagaagaggagccagatcttaccaaggttgcagcgagccaaggtgtttcaacgggggcacctgccagcaggccctgtacttctcaratttcgtgtgccagtgccccgaaggatttgctgggaagtgctgtgaaatagataccagggccacgtgctacgaggaccagggcatcagctacaggggcac

SEQ ID NO: 3886 - DNA, 201 bp, Homo sapiens; identical to SEQ ID NO: 3873

SEQ ID NO: 3887 - DNA, 201 bp, Homo sapiens
ggattctctctgccgcccactgcttccaggagaggtttccgccccaccacctgacggtgatcttgggcagaacataccgggtggtccctggcgaggaggarcagaaatttgaagtcgaaaaatacattgtccataaggaattcgatgatgacacttacgacaatgacattgcgctgctgcagctgaaatcggattcgtccc

SEQ ID NO: 3888 - DNA, 201 bp, Homo sapiens; identical to SEQ ID NO: 3874

SEQ ID NO: 3889 - DNA, 201 bp, Homo sapiens; identical to SEQ ID NO: 3875

SEQ ID NO: 3890 - DNA, 201 bp, Homo sapiens; identical to SEQ ID NO: 3876

SEQ ID NO: 3891 - DNA, 201 bp, Homo sapiens; identical to SEQ ID NO: 3877

SEQ ID NO: 3892 - DNA, 201 bp, Homo sapiens; identical to SEQ ID NO: 3878

SEQ ID NO: 3893 - DNA, 201 bp, Homo sapiens; identical to SEQ ID NO: 3868

SEQ ID NO: 3894 - DNA, 201 bp, Homo sapiens; identical to SEQ ID NO: 3869

SEQ ID NO: 3895 - DNA, 201 bp, Homo sapiens; identical to SEQ ID NO: 3881

SEQ ID NO: 3896 - DNA, 201 bp, Homo sapiens; identical to SEQ ID NO: 3882

SEQ ID NO: 3897 - DNA, 201 bp, Homo sapiens; identical to SEQ ID NO: 3872

SEQ ID NO: 3898 - DNA, 201 bp, Homo sapiens; identical to SEQ ID NO: 3884

SEQ ID NO: 3899 - DNA, 201 bp, Homo sapiens; identical to SEQ ID NO: 3887

SEQ ID NO: 3900 - DNA, 201 bp, Homo sapiens; identical to SEQ ID NO: 3874

SEQ ID NO: 3901 - DNA, 201 bp, Homo sapiens; identical to SEQ ID NO: 3875

SEQ ID NO: 3902 - DNA, 201 bp, Homo sapiens
ccagcaacatcactacaggggcacgtggagcacagcggagagtggcgccgagtgcaccaactggaacagcagcgcgttggcccagaagccctacagcgggyggaggccagatgccatcaggctgggcctggggaaccacaactactgcagaaacccagatcgagactcaaagccctggtgctacgtctttaaggcggggaa

SEQ ID NO: 3903 - DNA, 201 bp, Homo sapiens
actacaggggcacgtggagcacagcggagagtggcgccgagtgcaccaactggaacagcagcgcgttggcccagaagccctacagcgggcggaggccagaygccatcaggctgggcctggggaaccacaactactgcagaaacccagatcgagactcaaagccctggtgctacgtctttaaggcggggaagtacagctcag

SEQ ID NO: 3904 - DNA, 201 bp, Homo sapiens; identical to SEQ ID NO: 3878

SEQ ID NO: 3905 - DNA, 201 bp, Homo sapiens; identical to SEQ ID NO: 3868

SEQ ID NO: 3906 - DNA, 201 bp, Homo sapiens; identical to SEQ ID NO: 3869

SEQ ID NO: 3907 - DNA, 201 bp, Homo sapiens; identical to SEQ ID NO: 3881

SEQ ID NO: 3908 - DNA, 201 bp, Homo sapiens; identical to SEQ ID NO: 3882

SEQ ID NO: 3909 - DNA, 201 bp, Homo sapiens; identical to SEQ ID NO: 3872

SEQ ID NO: 3910 - DNA, 201 bp, Homo sapiens; identical to SEQ ID NO: 3884

SEQ ID NO: 3911 - DNA, 201 bp, Homo sapiens; identical to SEQ ID NO: 3871

SEQ ID NO: 3912 - DNA, 201 bp, Homo sapiens; identical to SEQ ID NO: 3873

SEQ ID NO: 3913 - DNA, 201 bp, Homo sapiens; identical to SEQ ID NO: 3887

SEQ ID NO: 3914 - DNA, 201 bp, Homo sapiens; identical to SEQ ID NO: 3874

SEQ ID NO: 3915 - DNA, 201 bp, Homo sapiens; identical to SEQ ID NO: 3875

SEQ ID NO: 3916 - DNA, 201 bp, Homo sapiens; identical to SEQ ID NO: 3876

SEQ ID NO: 3917 - DNA, 201 bp, Homo sapiens; identical to SEQ ID NO: 3877

SEQ ID NO: 3918 - DNA, 201 bp, Homo sapiens
cccagtgcccaggcactgggcctgggcaaacataattactgccgctgccggactggacggagtgtgagctctccggctacggcaagcatgaggccttgtcycctttctattcggagcggctgaaggaggctcatgtcagactgtacccatccagccgctgcacatcacaacatttacttaacagaacagtcaccgacaaca

SEQ ID NO: 3919 - DNA, 201 bp, Homo sapiens; identical to SEQ ID NO: 3868

SEQ ID NO: 3920 - DNA, 201 bp, Homo sapiens; identical to SEQ ID NO: 3869

SEQ ID NO: 3921 - DNA, 201 bp, Homo sapiens
cccaggcactgggcctgggcaaacataattactgccgctgccggactggacggagtgtgagctctccggctacggcaagcatgaggccttgtctcctttcyattcggagcggctgaaggaggctcatgtcagactgtacccatccagccgctgcacatcacaacatttacttaacagaacagtcaccgacaacatgctgtg

SEQ ID NO: 3922 - DNA, 201 bp, Homo sapiens; identical to SEQ ID NO: 3871

SEQ ID NO: 3923 - DNA, 201 bp, Homo sapiens; identical to SEQ ID NO: 3872

SEQ ID NO: 3924 - DNA, 201 bp, Homo sapiens; identical to SEQ ID NO: 3873

SEQ ID NO: 3925 - DNA, 201 bp, Homo sapiens; identical to SEQ ID NO: 3874

SEQ ID NO: 3926 - DNA, 201 bp, Homo sapiens; identical to SEQ ID NO: 3875

SEQ ID NO: 3927 - DNA, 201 bp, Homo sapiens; identical to SEQ ID NO: 3876

SEQ ID NO: 3928 - DNA, 201 bp, Homo sapiens; identical to SEQ ID NO: 3877

SEQ ID NO: 3929 - DNA, 201 bp, Homo sapiens
tggtgcctactccattgtggcgggcgtgtttgtgtgcctgctggagtacccccgggggaagaggaagaagggctccaccatggagcgctggggacagaagyacatgaccgccgtggtgaagctgttcgggccctttaccaggaattactatgttcgggccgtcctgcatctcctgctctcggtgcccgccggcttcctgct

SEQ ID NO: 3930 - DNA, 201 bp, Homo sapiens
gtggccacagctgggcgcttcacccagtggtactttggtgcctactccattgtggcgggcgtgtttgtgtgcctgctggagtacccccgggggaagaggamgaagggctccaccatggagcgctggggacagaagtacatgaccgccgtggtgaagctgttcgggccctttaccaggaattactatgttcgggccgtcctg

SEQ ID NO: 3931 - DNA, 201 bp, Homo sapiens
ccgggttcgtgtcgccatggggcagatcgagtgggccatgtgggccaacgaacaggcgctggcgtccggcctgatcctcatcaccgggggcatcgtggccrcagctgggcgcttcacccagtggtactttggtgcctactccattgtggcgggcgtgtttgtgtgcctgctggagtacccccgggggaagaggaagaaggg

SEQ ID NO: 3932 - DNA, 201 bp, Homo sapiens
gcgtgtttgtgtgcctgctggagtacccccgggggaagaggaagaagggctccaccatggagcgctggggacagaagtacatgaccgccgtggtgaagctsttcgggccctttaccaggaattactatgttcgggccgtcctgcatctcctgctctcggtgcccgccggcttcctgctggccaccatccttgggaccgcct

SEQ ID NO: 3933 - DNA, 201 bp, Homo sapiens
agttgcaggaagtccacatatattttagctatttagcctttgtaacctttaaacactggggatgccttcatgctttctggtgagggtctgttaacttggcscgtggagtccttcactgcacggaagagcagaggtttccctgttcacctgctctatggtctgtgctttgtgaaaacacctttccctggccctgggtcctgc

SEQ ID NO: 3934 - DNA, 201 bp, Homo sapiens
gggattacaggcgtgagccaccgcgcccggcctgattgtctttttcttaagttgcaggaagtccacatatattttagctatttagcctttgtaacctttaracactggggatgccttcatgctttctggtgagggtctgttaacttggcgcgtggagtccttcactgcacggaagagcagaggtttccctgttcacctgct

SEQ ID NO: 3935 - DNA, 201 bp, Homo sapiens
gctgcaggccacctctcactgcgggggtctctgggtggacagagccctcagactttgcttatttaaatccttttgtccatagagccaagtccctcctgccmgcagaggcaactgccctccccttgctgtgcgtcttctagtgtgtgtgcgtgggaaaggtgcagcactttctgtgtacgccttccgcgtatggaagtggag

SEQ ID NO: 3936 - DNA, 201 bp, Homo sapiens; identical to SEQ ID NO: 3929

SEQ ID NO: 3937 - DNA, 201 bp, Homo sapiens; identical to SEQ ID NO: 3930

SEQ ID NO: 3938 - DNA, 201 bp, Homo sapiens
agtgctgggattacaggcgtgagccaccgcgcccggcctgattgtctttttcttaagttgcaggaagtccacatatattttagctatttagcctttgtaamctttaaacactggggatgccttcatgctttctggtgagggtctgttaacttggcgcgtggagtccttcactgcacggaagagcagaggtttccctgttca

SEQ ID NO: 3939 - DNA, 201 bp, Homo sapiens; identical to SEQ ID NO: 3932

SEQ ID NO: 3940 - DNA, 201 bp, Homo sapiens; identical to SEQ ID NO: 3931

SEQ ID NO: 3941 - DNA, 201 bp, Homo sapiens
acacccacacgtggctgcttcctccgagcaagtgcaccagagccgctagtgtccacatcaaggctgagaacacccaggaccgaaacaagccccggtccgcrcacgtcccctgggtctgcagtctgccttgtcctgagactttgtggccttggcccccagacctggggctccgttcccctttctgagtgcccttctgtgtcc

SEQ ID NO: 3942 - DNA, 201 bp, Homo sapiens
ctgtgtgtctgctggttactgccggctgaggccaggacacccacacgtggctgcttcctccgagcaagtgcaccagagccgctagtgtccacatcaaggcygagaacacccaggaccgaaacaagccccggtccgcgcacgtcccctgggtctgcagtctgccttgtcctgagactttgtggccttggcccccagacctgg

SEQ ID NO: 3943 - DNA, 201 bp, Homo sapiens
ggagggttccgtgctgtgtgtctgctggttactgccggctgaggccaggacacccacacgtggctgcttcctccgagcaagtgcaccagagccgctagtgkccacatcaaggctgagaacacccaggaccgaaacaagccccggtccgcgcacgtcccctgggtctgcagtctgccttgtcctgagactttgtggccttgg

SEQ ID NO: 3944 - DNA, 201 bp, Homo sapiens
gccgggctgcctggacaggagccacccccacttacctcagtgtttttccaaacaaaaattcgggtccctggctctggcagggcctgtgtctgctgtctagygtgcaggatttgtaaggatccactccaaatccgaggagctccgatccgtcgccagggtctggggtcagcatgcactgctggggggtcttgcctgggcttc

SEQ ID NO: 3945 - DNA, 201 bp, Homo sapiens
cattgtggcgggcgtgtttgtgtgcctgctggagtacccccgggggaagaggaagaagggctccaccatggagcgctggtgagtctcctcctgctctgggktctctccgggggttgcggggcccaggcagggctcacagggttgggtggagcttggtttctcacttggaggctccggaaccaaccctttggtgcttgtggg

SEQ ID NO: 3946 - DNA, 201 bp, Homo sapiens
ctgggtgccctggggtggtcagcagggcagcaaaggagtcccgagtgggagaggcccagccgcgccgtctcgccttcctccctcccccaggggacagaagyacatgaccgccgtggtgaagctgttcgggccctttaccaggaattactatgttcgggccgtcctgcatctcctgtgagtccccgtcccgcaccccctcta

SEQ ID NO: 3947 - DNA, 201 bp, Homo sapiens
gtggagggttccgtgctgtgtgtctgctggttactgccggctgaggccaggacacccacacgtggctgcttcctccgagcaagtgcaccagagccgctagygtccacatcaaggctgagaacacccaggaccgaaacaagccccggtccgcgcacgtcccctgggtctgcagtctgccttgtcctgagactttgtggcctt

SEQ ID NO: 3948 - DNA, 201 bp, Homo sapiens
ggtcttgcctgggcttcctggtagggtggagggttccgtgctgtgtgtctgctggttactgccggctgaggccaggacacccacacgtggctgcttcctcygagcaagtgcaccagagccgctagtgtccacatcaaggctgagaacacccaggaccgaaacaagccccggtccgcgcacgtcccctgggtctgcagtctg

SEQ ID NO: 3949 - DNA, 201 bp, Homo sapiens
gtggccacagctgggcgcttcacccagtggtactttggtgcctactccattgtggcgggcgtgtttgtgtgcctgctggagtacccccgggggaagaggamgaagggctccaccatggagcgctggtgagtctcctcctgctctggggtctctccgggggttgcggggcccaggcagggctcacagggttgggtggagctt

SEQ ID NO: 3950 - DNA, 201 bp, Homo sapiens
gtgtttgtgtgcctgctggagtacccccgggggaagaggaagaagggctccaccatggagcgctggtgagtctcctcctgctctggggtctctccgggggytgcggggcccaggcagggctcacagggttgggtggagcttggtttctcacttggaggctccggaaccaaccctttggtgcttgtgggtaaaccaaggccg

SEQ ID NO: 3951 - DNA, 201 bp, Homo sapiens
ctttggtgcctactccattgtggcgggcgtgtttgtgtgcctgctggagtacccccgggggaagaggaagaagggctccaccatggagcgctggtgagtcycctcctgctctggggtctctccgggggttgcggggcccaggcagggctcacagggttgggtggagcttggtttctcacttggaggctccggaaccaaccc

SEQ ID NO: 3952 - DNA, 201 bp, Homo sapiens
agggcagcaaaggagtcccgagtgggagaggcccagccgcgccgtctcgccttcctccctcccccaggggacagaagtacatgaccgccgtggtgaagctsttcgggccctttaccaggaattactatgttcgggccgtcctgcatctcctgtgagtccccgtcccgcaccccctctagggctcaggagggcttggagccg

SEQ ID NO: 3953 - DNA, 201 bp, Homo sapiens; identical to SEQ ID NO: 3931

SEQ ID NO: 3954 - DNA, 201 bp, Homo sapiens; identical to SEQ ID NO: 3929

SEQ ID NO: 3955 - DNA, 201 bp, Homo sapiens
gcgtgtttgtgtgcctgctggagtacccccgggggaagaggaagaagggctccaccatggagcgctggggacagaagcacatgaccgccgtggtgaagctsttcgggccctttaccaggaattactatgttcgggccgtcctgcatctcctgctctcggtgcccgccggcttcctgctggccaccatccttgggaccgcct

SEQ ID NO: 3956 - DNA, 201 bp, Homo sapiens
gtggccacagctgggcgcttcacccagtggtactttggtgcctactccattgtggcgggcgtgtttgtgtgcctgctggagtacccccgggggaagaggamgaagggctccaccatggagcgctggggacagaagcacatgaccgccgtggtgaagctgttcgggccctttaccaggaattactatgttcgggccgtcctg

SEQ ID NO: 3957 - DNA, 201 bp, Homo sapiens
ggggaagaggaagaagggctccaccatggagcgctggggacagaagcacatgaccgccgtggtgaagctgttcgggccctttaccaggaattactatgttygggccgtcctgcatctcctgctctcggtgcccgccggcttcctgctggccaccatccttgggaccgcctgcctggccattgcgagcggcatctacctact

SEQ ID NO: 3958 - DNA, 201 bp, Homo sapiens
gggaagaggaagaagggctccaccatggagcgctggggacagaagcacatgaccgccgtggtgaagctgttcgggccctttaccaggaattactatgttcrggccgtcctgcatctcctgctctcggtgcccgccggcttcctgctggccaccatccttgggaccgcctgcctggccattgcgagcggcatctacctactg

SEQ ID NO: 3959 - DNA, 201 bp, Homo sapiens
aagggctccaccatggagcgctggggacagaagcacatgaccgccgtggtgaagctgttcgggccctttaccaggaattactatgttcgggccgtcctgcrtctcctgctctcggtgcccgccggcttcctgctggccaccatccttgggaccgcctgcctggccattgcgagcggcatctacctactggcggctgtgcgt

SEQ ID NO: 3960 - DNA, 201 bp, Homo sapiens
ggaattactatgttcgggccgtcctgcatctcctgctctcggtgcccgccggcttcctgctggccaccatccttgggaccgcctgcctggccattgcgagmggcatctacctactggcggctgtgcgtggcgagcagtggacgcccatcgagcccaagccccgggagcggccgcagatcggaggcaccatcaagcagccgc

SEQ ID NO: 3961 - DNA, 201 bp, Homo sapiens
gccgtcctgcatctcctgctctcggtgcccgccggcttcctgctggccaccatccttgggaccgcctgcctggccattgcgagcggcatctacctactggyggctgtgcgtggcgagcagtggacgcccatcgagcccaagccccgggagcggccgcagatcggaggcaccatcaagcagccgcccagcaaccccccgccg

SEQ ID NO: 3962 - DNA, 201 bp, Homo sapiens
ctggcggctgtgcgtggcgagcagtggacgcccatcgagcccaagccccgggagcggccgcagatcggaggcaccatcaagcagccgcccagcaacccccmgccgcggcccccggccgaggcccgcaagaagcccagcgaggaggaggctgcggcggcggcggggggacccccgggaggtccccaggtcaaccccatcccg

SEQ ID NO: 3963 - DNA, 201 bp, Homo sapiens
cggccgcagatcggaggcaccatcaagcagccgcccagcaaccccccgccgcggcccccggccgaggcccgcaagaagcccagcgaggaggaggctgcggyggcggcggggggacccccgggaggtccccaggtcaaccccatcccggtgaccgacgaggtcgtgtgacctcgccccggacctgccctcccaccaggtgca

SEQ ID NO: 3964 - DNA, 201 bp, Homo sapiens
ccgggttcgtgtcgccatggggcagatcgagtgggccatgtgggccaacgagcaggcgctggcgtccggcctgatcctcatcaccgggggcatcgtggccrcagctgggcgcttcacccagtggtactttggtgcctactccattgtggcgggcgtgtttgtgtgcctgctggagtacccccgggggaagaggaagaaggg

SEQ ID NO: 3965 - DNA, 122 bp, Homo sapiens
gtgacacatgatgctgtgaacstcagggtgctcgccagggaagggccctacccagagggacagaaagaaagccaggaggggtagagtttgaagagaagatcatgttctccctgaagacgctt

SEQ ID NO: 3966 - DNA, 201 bp, Homo sapiens
taaggtgagatcacactgaattagggtgggctctaaatccattatgactgttgttcttataagaagaagagaggcatagccacctaggggaggaggccgtrtgaagacagaggcagagattggagtgacgcatctccaagccaaggaattccaaggactgtaagccaccagtagaagctttgaagaggcaaggaaggattc

SEQ ID NO: 3967 - DNA, 201 bp, Homo sapiens
aggccatctatggactttcaagcaaccctatccaacctactggaccaagcacacccaaaccctgtgaccccagtttgacatttgatgctatcaccacactycgtggagaaatacttttctttaaagacaggtacttctggagaaggcatcctcagctacaaagagtcgaaatgaattttatttctctattctggccatccc

SEQ ID NO: 3968 - DNA, 201 bp, Homo sapiens
atggcttaactgtagatatggctgaagcaaaatcaaatgtggctgtatccactttcagaatgttgaagggaagttcagcatgcattttcgttacattgtgwcctgcttatacttttctcaatattaagtcattgtttcccatcactgtatccattctacctgtcctccgtgaaaatatgtttggaatattccactatttgc

SEQ ID NO: 3969 - DNA, 201 bp, Homo sapiens
aagatcatgttctccctgaagacgcttccatttctgctcttactccatgtgcagatttccaaggcctttcctgtatcttctaaagagaaaaatacaaaaaytgttcaggactacctggaaaagttctaccaattaccaagcaaccagtatcagtctacaaggaagaatggcactaatgtgatcgttgaaaagcttaaagaa

SEQ ID NO: 3970 - DNA, 201 bp, Homo sapiens
caagcaaccctatccaacctactggaccaagcacacccaaaccctgtgaccccagtttgacatttgatgctatcaccacactccgtggagaaatacttttytttaaagacaggtacttctggagaaggcatcctcagctacaaagagtcgaaatgaattttatttctctattctggccatcccttccaactggtatacagg

SEQ ID NO: 3971 - DNA, 201 bp, Homo sapiens
gaatggcactaatgtgatcgttgaaaagcttaaagaaatgcagcgattttttgggttgaatgtgacggggaagccaaatgaggaaactctggacatgatgraaaagcctcgctgtggagtgcctgacagtggtggttttatgttaaccccaggaaaccccaagtgggaacgcactaacttgacctacaggattcgaaacta

SEQ ID NO: 3972 - DNA, 201 bp, Homo sapiens
gagatcacggtgacaattctccatttgatggacccaatggaatccttgctcatgcctttcagccaggccaaggtattggaggagatgctcattttgatgcygaagaaacatggaccaacacctccgcaaattacaacttgtttcttgttgctgctcatgaatttggccattctttggggctcgctcactcctctgaccctg

SEQ ID NO: 3973 - DNA, 201 bp, Homo sapiens
agagaaaaatacaaaaattgttcaggactacctggaaaagttctaccaattaccaagcaaccagtatcagtctacaaggaagaatggcactaatgtgatcrttgaaaagcttaaagaaatgcagcgattttttgggttgaatgtgacggggaagccaaatgaggaaactctggacatgatgaaaaagcctcgctgtggagt

SEQ ID NO: 3974 - DNA, 201 bp, Homo sapiens
gcaaccagtatcagtctacaaggaagaatggcactaatgtgatcgttgaaaagcttaaagaaatgcagcgattttttgggttgaatgtgacggggaagccmaatgaggaaactctggacatgatgaaaaagcctcgctgtggagtgcctgacagtggtggttttatgttaaccccaggaaaccccaagtgggaacgcacta

SEQ ID NO: 3975 - DNA, 173 bp, Homo sapiens
ggccgtgtgaagacagaggcagagattggagtgacgcatctccaagccaaggaattccaaggactgtaagccaccagtagaagctttgaagaggcaaggarggattccctccaatagccttcaagtgtgaccctgctgacacctgcagaattcggacttctatcctccaaaac

SEQ ID NO: 3976 - DNA, 201 bp, Homo sapiens
agagttgcaagaggcaataaatggcttaactgtagatatggctgaagcaaaatcaaatgtggctgtatccactttcagaatgttgaagggaagttcagcawgcattttcgttacattgtgtcctgcttatacttttctcaatattaagtcattgtttcccatcactgtatccattctacctgtcctccgtgaaaatatgtt

SEQ ID NO: 3977 - DNA, 201 bp, Homo sapiens
tgatgctgtgaacctcagggtgctcgccagggaagggccctacccagagggacagaaagaaagccaggaggggtagagtttgaagagaagatcatgttctvcctgaagacgcttccatttctgctcttactccatgtgcagatttccaaggcctttcctgtatcttctaaagagaaaaatacaaaaattgttcaggactac

SEQ ID NO: 3978 - DNA, 201 bp, Homo sapiens
gttttccagcaagaacatttcttccatgtcttcagtggaccaagatattacgcatttgatcttattgctcagagagttaccagagttgcaagaggcaatamatggcttaactgtagatatggctgaagcaaaatcaaatgtggctgtatccactttcagaatgttgaagggaagttcagcatgcattttcgttacattgtg

SEQ ID NO: 3979 - DNA, 201 bp, Homo sapiens
tgcagatgtaattagttaagttaaggtgagatcacactgaattagggtgggctctaaatccattatgactgttgttcttataagaagaagagaggcatagycacctaggggaggaggccgtgtgaagacagaggcagagattggagtgacgcatctccaagccaaggaattccaaggactgtaagccaccagtagaagctt

SEQ ID NO: 3980 - DNA, 201 bp, Homo sapiens
tctcccaaaaaaatacaaaaattagctgggcgtgctggtgtgcctgtattcccagctacttgggaggctgaggtgggaggattgcttcagctggggaggcrgaggctgcagggagccaagactgagccattgcacccagcctgggtgacagagcaagaccctgtctctaaaaatgaatgaaaggaaggaagaaagagagag

SEQ ID NO: 3981 - DNA, 201 bp, Homo sapiens
ttgaatgaaacaatcgctgggaaagcattaagagaattaaggctgggcactgtggctcatgcctgtaatcccagcactttgtgaggctgaggcaggcagayaacttgagcccaggagtttgagaccagcctgggcaacatggcaaaaccctgctctcccaaaaaaatacaaaaattagctgggcgtgctggtgtgcctgta

SEQ ID NO: 3982 - DNA, 201 bp, Homo sapiens
gacctgcagccttgggtcgaccctgccctaggggtgactgcaggagagcagggaggatggtcaggcgtcaccaacaaccccatcacccagtaacaagaacyttgactctctcagtccctctgcatcaagacacttacccatttcccacctcatgcctgctaacttgaatgaaacaatcgctgggaaagcattaagagaatt

SEQ ID NO: 3983 - DNA, 201 bp, Homo sapiens
cgcctgtcttccagaacgattccttcaccagccctctttccattgctctaggatgcagatgtctccagccctcacctgcctagtcctgggcctggcccttrtctttggtgaagggtctgctgtgcaccatcccccatcctacgtggcccacctggcctcagacttcggggtgagggtgtttcagcaggtggcgcaggcctc

SEQ ID NO: 3984 - DNA, 201 bp, Homo sapiens
cggatcatgaggtcaggagatcaagaccatcctggctaacacagtgaaactccatctctactaaaaatacaaaaaaaattagccaggcgtggtggcaggcrcctgtagtcccagctactcgggaggctgaggcaggagaatggcatgaacccaggaggcagagcttgcagtgagctgagatcgtgccactgcactccagcc

SEQ ID NO: 3985 - DNA, 201 bp, Homo sapiens
cgggcggatcatgaggtcaggagatcaagaccatcctggctaacacagtgaaactccatctctactaaaaatacaaaaaaaattagccaggcgtggtggcrggcgcctgtagtcccagctactcgggaggctgaggcaggagaatggcatgaacccaggaggcagagcttgcagtgagctgagatcgtgccactgcactcc

SEQ ID NO: 3986 - DNA, 201 bp, Homo sapiens
ccctcccgcctgtcttccagaacgattccttcaccagccctctttccattgctctaggatgcagatgtctccagccctcacctgcctagtcctgggcctgrcccttgtctttggtgaagggtctgctgtgcaccatcccccatcctacgtggcccacctggcctcagacttcggggtgagggtgtttcagcaggtggcgca

SEQ ID NO: 3987 - DNA, 201 bp, Homo sapiens
ttcatgagccgggcgcggtggctcaaacgcctgtaatcccagcactttgggaggccaaggcgggcggatcatgaggtcaggagatcaagaccatcctggcyaacacagtgaaactccatctctactaaaaatacaaaaaaaattagccaggcgtggtggcaggcgcctgtagtcccagctactcgggaggctgaggcagga

SEQ ID NO: 3988 - DNA, 201 bp, Homo sapiens
gccaaggaaaggctggctctggcttagccgagccaagccccatacagctgtgctgcaggggccaccccatcttcttcccactacactccaagtcactggayccttgaatctccaagggtgtctgaccagtagatttaccgcttattcaccaccgtgtgatcttaacctcgttaagtttgcccatctacaaaatgaggatta

SEQ ID NO: 3989 - DNA, 201 bp, Homo sapiens
gctgtcctaaagaattcatgagccgggcgcggtggctcaaacgcctgtaatcccagcactttgggaggccaaggcgggcggatcatgaggtcaggagatcragaccatcctggctaacacagtgaaactccatctctactaaaaatacaaaaaaaattagccaggcgtggtggcaggcgcctgtagtcccagctactcggg

SEQ ID NO: 3990 - DNA, 201 bp, Homo sapiens
tgctgtcctaaagaattcatgagccgggcgcggtggctcaaacgcctgtaatcccagcactttgggaggccaaggcgggcggatcatgaggtcaggagatyaagaccatcctggctaacacagtgaaactccatctctactaaaaatacaaaaaaaattagccaggcgtggtggcaggcgcctgtagtcccagctactcgg

SEQ ID NO: 3991 - DNA, 201 bp, Homo sapiens
gaatgaaacaatcgctgggaaagcattaagagaattaaggctgggcactgtggctcatgcctgtaatcccagcactttgtgaggctgaggcaggcagatawcttgagcccaggagtttgagaccagcctgggcaacatggcaaaaccctgctctcccaaaaaaatacaaaaattagctgggcgtgctggtgtgcctgtatt

SEQ ID NO: 3992 - DNA, 201 bp, Homo sapiens
gcccatctacaaaatgaggattatttgctgtcctaaagaattcatgagccgggcgcggtggctcaaacgcctgtaatcccagcactttgggaggccaaggmgggcggatcatgaggtcaggagatcaagaccatcctggctaacacagtgaaactccatctctactaaaaatacaaaaaaaattagccaggcgtggtggca

SEQ ID NO: 3993 - DNA, 201 bp, Homo sapiens
gtttgcccatctacaaaatgaggattatttgctgtcctaaagaattcatgagccgggcgcggtggctcaaacgcctgtaatcccagcactttgggaggccvaggcgggcggatcatgaggtcaggagatcaagaccatcctggctaacacagtgaaactccatctctactaaaaatacaaaaaaaattagccaggcgtggt

SEQ ID NO: 3994 - DNA, 169 bp, Homo sapiens
ctctactaaaaatacaaaaaaaattagccaggcgtggtggcaggcgcctgtagtcccagctactcgggaggctgaggcaggagaatggcatgaacccaggmggcagagcttgcagtgagctgagatcgtgccactgcactccagcctgggcgacagagagagactccgt

SEQ ID NO: 3995 - DNA, 201 bp, Homo sapiens
ccccctccagcagctgaattcctgcagctcagcagccgccgccagagcaggacgaaccgccaatcgcaaggcacctctgagaacttcaggtaggagaaaakcaaactccctccaacctcttacttcgggcttaaggcagagaactcgcctccccagaatctcctccctccatgatcccccgctattcctctattttctttt

SEQ ID NO: 3996 - DNA, 201 bp, Homo sapiens
tcttcccactacactccaagtcactggacccttgaatctccaagggtgtctgaccagtagatttaccgcttattcaccaccgtgtgatcttaacctcgttwagtttgcccatctacaaaatgaggattatttgctgtcctaaagaattcatgagccgggcgcggtggctcaaacgcctgtaatcccagcactttgggaggc

SEQ ID NO: 3997 - DNA, 176 bp, Homo sapiens
gcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggtaggagaaaagcaaactccctccaacctctta

SEQ ID NO: 3998 - DNA, 201 bp, Homo sapiens
caccagccctctttccattgctctaggatgcagatgtctccagccctcacctgcctagtcctgggcctggcccttgtctttggtgaagggtctgctgtgcmccatcccccatcctacgtggcccacctggcctcagacttcggggtgagggtgtttcagcaggtggcgcaggcctccaaggaccgcaacgtggttttctca

SEQ ID NO: 3999 - DNA, 201 bp, Homo sapiens
cccatacagctgtgctgcaggggccaccccatcttcttcccactacactccaagtcactggacccttgaatctccaagggtgtctgaccagtagatttacygcttattcaccaccgtgtgatcttaacctcgttaagtttgcccatctacaaaatgaggattatttgctgtcctaaagaattcatgagccgggcgcggtgg

SEQ ID NO: 4000 - DNA, 201 bp, Homo sapiens
catggtctcttcctgcaccttgccctagtgttcacttaccacctgcttgcaggaaacaagaagagcagggcccacagctggccagctcccctcccctcccrcctgtcttccagaacgattccttcaccagccctctttccattgctctaggatgcagatgtctccagccctcacctgcctagtcctgggcctggcccttgt

SEQ ID NO: 4001 - DNA, 201 bp, Homo sapiens
gaacttcaggtaggagaaaagcaaactccctccaacctcttacttcgggcttaaggcagagaactcgcctccccagaatctcctccctccatgatcccccrctattcctctattttcttttcctcggacctgcagccttgggtcgaccctgccctaggggtgactgcaggagagcagggaggatggtcaggcgtcaccaac

SEQ ID NO: 4002 - DNA, 201 bp, Homo sapiens
gggaagggagatggactggattccaagattcccacagggcaagatgggcgaagactccctgccactgcccggggataagtcagtctgagtgagacggagtrggatgggcttagaacctgaacatgtcatggtctcttcctgcaccttgccctagtgttcacttaccacctgcttgcaggaaacaagaagagcagggcccac

SEQ ID NO: 4003 - DNA, 201 bp, Homo sapiens
aagagagagaaagagagagaggaaagaaggaaggaagtaaagaagaaagaaagaaagaaagaggaaagaggaagaaagaaagaaaagaaagaaaagaaaakaaagcaaatttaaagcttatgcaaatcaaagatgttgtgataattgataattgagtctgggctaaattccccctgggctgcaaaggcagagagtggtaat

SEQ ID NO: 4004 - DNA, 201 bp, Homo sapiens
gggaggattgcttcagctggggaggcggaggctgcagggagccaagactgagccattgcacccagcctgggtgacagagcaagaccctgtctctaaaaatraatgaaaggaaggaagaaagagagagaaagagagagaggaaagaaggaaggaagtaaagaagaaagaaagaaagaaagaggaaagaggaagaaagaaaga

SEQ ID NO: 4005 - DNA, 201 bp, Homo sapiens
ccaactctcctggcctggccatctccctccccagaaacagtgtgcatgggttattttggagtgtaggtgacttgtttactcattgaagcagatttctgctyccttttatttttataggaatagaggaagaaatgtcagatgcgtgcccagctcttcaccccccaatctcttggtggggaggggtgtacctaaatatttatc

SEQ ID NO: 4006 - DNA, 201 bp, Homo sapiens
gtggcccaactctcctggcctggccatctccctccccagaaacagtgtgcatgggttattttggagtgtaggtgacttgtttactcattgaagcagatttytgcttccttttatttttataggaatagaggaagaaatgtcagatgcgtgcccagctcttcaccccccaatctcttggtggggaggggtgtacctaaatat

SEQ ID NO: 4007 - DNA, 201 bp, Homo sapiens
agcagattcaagcagctatgggattcaagattgatgacaagggcatggcccccgccctccggcatctgtacaaggagctcatggggccatggaacaaggaygagatcagcaccacagacgcgatcttcgtccagcgggatctgaagctggtccagggcttcatgccccacttcttcaggctgttccggagcacggtcaagc

SEQ ID NO: 4008 - DNA, 201 bp, Homo sapiens
gattcaagattgatgacaagggcatggcccccgccctccggcatctgtacaaggagctcatggggccatggaacaaggatgagatcagcaccacagacgcratcttcgtccagcgggatctgaagctggtccagggcttcatgccccacttcttcaggctgttccggagcacggtcaagcaagtggacttttcagaggtgg

SEQ ID NO: 4009 - DNA, 201 bp, Homo sapiens
tatccttgcccttgagtgcttgttagagagaaagagaactactaaggaaaataatattatttaaactcgctcctagtgtttctttgtggtctgtgtcaccrtatctcaggaagtccagccacttgactggcacacacccctccggacatccagcgtgacggagcccacactgccaccttgtggccgcctgagaccctcgcg

SEQ ID NO: 4010 - DNA, 201 bp, Homo sapiens
ccgccagagcaggacgaaccgccaatcgcaaggcacctctgagaacttcaggatgcagatgtctccagccctcacctgcctagtcctgggcctggcccttrtctttggtgaagggtctgctgtgcaccatcccccatcctacgtggcccacctggcctcagacttcggggtgagggtgtttcagcaggtggcgcaggcctc

SEQ ID NO: 4011 - DNA, 201 bp, Homo sapiens
tcctggcctggccatctccctccccagaaacagtgtgcatgggttattttggagtgtaggtgacttgtttactcattgaagcagatttctgcttccttttwtttttataggaatagaggaagaaatgtcagatgcgtgcccagctcttcaccccccaatctcttggtggggaggggtgtacctaaatatttatcatatcct

SEQ ID NO: 4012 - DNA, 143 bp, Homo sapiens
cagagagggaggtgtcgagggggacccgctggctgttcagacrgactcccagagccagtgagtgggtggggctggaacatgagttcatctatttcctgcccacatctggtataaaaggaggcagtggcccacagaggagcaca

SEQ ID NO: 4013 - DNA, 201 bp, Homo sapiens
cagccgccgccagagcaggacgaaccgccaatcgcaaggcacctctgagaacttcaggatgcagatgtctccagccctcacctgcctagtcctgggcctgrcccttgtctttggtgaagggtctgctgtgcaccatcccccatcctacgtggcccacctggcctcagacttcggggtgagggtgtttcagcaggtggcgca

SEQ ID NO: 4014 - DNA, 201 bp, Homo sapiens
gcccagctcttcaccccccaatctcttggtggggaggggtgtacctaaatatttatcatatccttgcccttgagtgcttgttagagagaaagagaactacyaaggaaaataatattatttaaactcgctcctagtgtttctttgtggtctgtgtcaccgtatctcaggaagtccagccacttgactggcacacacccctcc

SEQ ID NO: 4015 - DNA, 201 bp, Homo sapiens
tgacacggctggtgctggtgaatgccctctacttcaacggccagtggaagactcccttccccgactccagcacccaccgccgcctcttccacaaatcagayggcagcactgtctctgtgcccatgatggctcagaccaacaagttcaactatactgagttcaccacgcccgatggccattactacgacatcctggaactgc

SEQ ID NO: 4016 - DNA, 201 bp, Homo sapiens
cgtgcccagctcttcaccccccaatctcttggtggggaggggtgtacctaaatatttatcatatccttgcccttgagtgcttgttagagagaaagagaacyactaaggaaaataatattatttaaactcgctcctagtgtttctttgtggtctgtgtcaccgtatctcaggaagtccagccacttgactggcacacacccc

SEQ ID NO: 4017 - DNA, 201 bp, Homo sapiens
acctgagaccctgggagagaagtttgaagcacaactcccttaaggtctccaaaccagacggtgacgcctgcgggaccatctggggcacctgcttccacccrtctctctgcccactcgggtctgcagacctggttcccactgaggccctttgcaggacggaactacggggcttacaggagcttttgtgtgcctggtagaaac

SEQ ID NO: 4018 - DNA, 201 bp, Homo sapiens
gggaaaggagccgtggaccagctgacacggctggtgctggtgaatgccctctacttcaacggccagtggaagactcccttccccgactccagcacccaccrccgcctcttccacaaatcagacggcagcactgtctctgtgcccatgatggctcagaccaacaagttcaactatactgagttcaccacgcccgatggccat

SEQ ID NO: 4019 - DNA, 201 bp, Homo sapiens
gaaaagaattttagtgttaatgactctttctgaaggaagagaagacatttgccttttgttaaaagatggtaaaccagatctgtctccaagaccttggcctytccttggaggacctttaggtcaaactccctagtctccacctgagaccctgggagagaagtttgaagcacaactcccttaaggtctccaaaccagacggtg

SEQ ID NO: 4020 - DNA, 201 bp, Homo sapiens
gacggtgacgcctgcgggaccatctggggcacctgcttccacccgtctctctgcccactcgggtctgcagacctggttcccactgaggccctttgcaggayggaactacggggcttacaggagcttttgtgtgcctggtagaaactatttctgttccagtcacattgccatcactcttgtactccctttcatctcagagtc

SEQ ID NO: 4021 - DNA, 201 bp, Homo sapiens
ctgggacaaaactggagatgcatcgggaaagaagaaactccgaagaaaagaattttagtgttaatgactctttctgaaggaagagaagacatttgcctttygttaaaagatggtaaaccagatctgtctccaagaccttggcctctccttggaggacctttaggtcaaactccctagtctccacctgagaccctgggagag

SEQ ID NO: 4022 - DNA, 201 bp, Homo sapiens
agaaacagtgtgcatgggttattttggagtgtaggtgacttgtttactcattgaagcagatttctgcttccttttatttttataggaatagaggaagaaakgtcagatgcgtgcccagctcttcaccccccaatctcttggtggggaggggtgtacctaaatatttatcatatccttgcccttgagtgcttgttagagaga

SEQ ID NO: 4023 - DNA, 195 bp, Homo sapiens
cacgtgaggggggggtgggtgagagagacaggcagctcggattcaactaccttagataatatttctgaaaacctaccagccagagggtagggcacaaagayggatgtaatgcactttgggaggccaaggcgggaggattgcttgagcccaggagttcaagaccagcctgggcaacataccaagacccccgtctct

SEQ ID NO: 4024 - DNA, 201 bp, Homo sapiens
aaaggaggcagtggcccacagaggagcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggatgcagatgtctccagccctcacctgcctagt

SEQ ID NO: 4025 - DNA, 201 bp, Homo sapiens
acaggaggagaaacccagcagcagattcaagcagctatgggattcaagattgatgacaagggcatggcccccgccctccggcatctgtacaaggagctcayggggccatggaacaaggatgagatcagcaccacagacgcgatcttcgtccagcgggatctgaagctggtccagggcttcatgccccacttcttcaggctg

SEQ ID NO: 4026 - DNA, 201 bp, Homo sapiens
tcgcaaggcacctctgagaacttcaggatgcagatgtctccagccctcacctgcctagtcctgggcctggcccttgtctttggtgaagggtctgctgtgcmccatcccccatcctacgtggcccacctggcctcagacttcggggtgagggtgtttcagcaggtggcgcaggcctccaaggaccgcaacgtggttttctca

SEQ ID NO: 4027 - DNA, 201 bp, Homo sapiens
ctggctgttcagacggactcccagagccagtgagtgggtggggctggaacatgagttcatctatttcctgcccacatctggtataaaaggaggcagtggcycacagaggagcacagctgtgtttggctgcagggccaagagcgctgtcaagaagacccacacgcccccctccagcagctgaattcctgcagctcagcagcc

SEQ ID NO: 4028 - DNA, 201 bp, Homo sapiens
ttggagtgtaggtgacttgtttactcattgaagcagatttctgcttccttttatttttataggaatagaggaagaaatgtcagatgcgtgcccagctcttmaccccccaatctcttggtggggaggggtgtacctaaatatttatcatatccttgcccttgagtgcttgttagagagaaagagaactactaaggaaaataa

SEQ ID NO: 4029 - DNA, 104 bp, Homo sapiens
gcacaaagatggatgtaatgcactttgggaggccaaggcgggaggattgcttgagcccaggagttcaagaccagcctgggcaacataccaagacccccgtytct

SEQ ID NO: 4030 - DNA, 201 bp, Homo sapiens
gtgcccatgatggctcagaccaacaagttcaactatactgagttcaccacgcccgatggccattactacgacatcctggaactgccctaccacggggacamcctcagcatgttcattgctgccccttatgaaaaagaggtgcctctctctgccctcaccaacattctgagtgcccagctcatcagccactggaaaggcaac

SEQ ID NO: 4031 - DNA, 201 bp, Homo sapiens
actcagatgaggacagagtggtttccaatgtgttcaatagatttaggagcagaaatgcaaggggctgcatgacctaccaggacagaactttccccaattayagggtgactcacagccgcattggtgactcacttcaatgtgtcatttccggctgctgtgtgtgagcagtggacacgtgaggggggggtgggtgagagagac

SEQ ID NO: 4032 - DNA, 201 bp, Homo sapiens
aggagcagaaatgcaaggggctgcatgacctaccaggacagaactttccccaattacagggtgactcacagccgcattggtgactcacttcaatgtgtcawttccggctgctgtgtgtgagcagtggacacgtgaggggggggtgggtgagagagacaggcagctcggattcaactaccttagataatatttctgaaaacc

SEQ ID NO: 4033 - DNA, 184 bp, Homo sapiens
ctttctttcttttttgattttgcactggacggtgacgtcagccatgtacaggatccacaggggtggtgtcaaatgctattgaaattgtgttgaattgtatrctttttcacttttgataaataaacatgtaaaaatgtttcaaaaaaataataaaataaataaatacgaagaatatgtcaggaca

SEQ ID NO: 4034 - DNA, 201 bp, Homo sapiens; identical to SEQ ID NO: 4005

SEQ ID NO: 4035 - DNA, 201 bp, Homo sapiens; identical to SEQ ID NO: 4006

SEQ ID NO: 4036 - DNA, 201 bp, Homo sapiens; identical to SEQ ID NO: 4007

SEQ ID NO: 4037 - DNA, 201 bp, Homo sapiens; identical to SEQ ID NO: 4008

SEQ ID NO: 4038 - DNA, 201 bp, Homo sapiens; identical to SEQ ID NO: 4009

SEQ ID NO: 4039 - DNA, 201 bp, Homo sapiens; identical to SEQ ID NO: 4010

SEQ ID NO: 4040 - DNA, 201 bp, Homo sapiens; identical to SEQ ID NO: 4011

SEQ ID NO: 4041 - DNA, 143 bp, Homo sapiens; identical to SEQ ID NO: 4012

SEQ ID NO: 4042 - DNA, 201 bp, Homo sapiens; identical to SEQ ID NO: 4013

SEQ ID NO: 4043 - DNA, 201 bp, Homo sapiens; identical to SEQ ID NO: 4014

SEQ ID NO: 4044 - DNA, 201 bp, Homo sapiens; identical to SEQ ID NO: 4015

SEQ ID NO: 4045 - DNA, 201 bp, Homo sapiens; identical to SEQ ID NO: 4016

SEQ ID NO: 4046 - DNA, 201 bp, Homo sapiens; identical to SEQ ID NO: 4017

SEQ ID NO: 4047 - DNA, 201 bp, Homo sapiens; identical to SEQ ID NO: 4018

SEQ ID NO: 4048 - DNA, 201 bp, Homo sapiens; identical to SEQ ID NO: 4019

SEQ ID NO: 4049 - DNA, 201 bp, Homo sapiens
gacggtgacgcctgcgggaccatctggggcacctgcttccacccgtctctctgcccactcgggtctgcagacctggttcccactgaggccctttgcaggayggaactacggggcttacaggagcttttgtgtgcctggtagaaactatttctgttccagtcacattgccatcactcttgtactgcctgccaccgcggagga

SEQ ID NO: 4050 - DNA, 201 bp, Homo sapiens; identical to SEQ ID NO: 4021

SEQ ID NO: 4051 - DNA, 201 bp, Homo sapiens; identical to SEQ ID NO: 4022

SEQ ID NO: 4052 - DNA, 201 bp, Homo sapiens
cacgtgaggggggggtgggtgagagagacaggcagctcggattcaactaccttagataatatttctgaaaacctaccagccagagggtagggcacaaagayggatgtaatgcactttgggaggccaaggcgggaggattgcttgagcccaggagttcaagaccagcctgggcaacataccaagacccccgtctctttaaaa

SEQ ID NO: 4053 - DNA, 201 bp, Homo sapiens; identical to SEQ ID NO: 4024

SEQ ID NO: 4054 - DNA, 201 bp, Homo sapiens; identical to SEQ ID NO: 4025

SEQ ID NO: 4055 - DNA, 201 bp, Homo sapiens; identical to SEQ ID NO: 4026

SEQ ID NO: 4056 - DNA, 201 bp, Homo sapiens; identical to SEQ ID NO: 4027

SEQ ID NO: 4057 - DNA, 201 bp, Homo sapiens; identical to SEQ ID NO: 4028

SEQ ID NO: 4058 - DNA, 201 bp, Homo sapiens
gcacaaagatggatgtaatgcactttgggaggccaaggcgggaggattgcttgagcccaggagttcaagaccagcctgggcaacataccaagacccccgtytctttaaaaatatatatattttaaatatacttaaatatatatttctaatatctttaaatatatatatatattttaaagaccaatttatgggagaattgca

SEQ ID NO: 4059 - DNA, 201 bp, Homo sapiens; identical to SEQ ID NO: 4030

SEQ ID NO: 4060 - DNA, 201 bp, Homo sapiens; identical to SEQ ID NO: 4031

SEQ ID NO: 4061 - DNA, 201 bp, Homo sapiens; identical to SEQ ID NO: 4032

SEQ ID NO: 4062 - DNA, 201 bp, Homo sapiens
ataccgctggtaccagatgctgtaccaggctggcgtctttgcctcccgctcttctctccgctgctgtcgcatccgtttcacctgggccctggccctgctgyagtgcctcaacctggtgttcctgctggcagacgtgtggttcggctttctgccaagcatctacctcgtcttcctgatcattctgtatgaggggctcctggg

SEQ ID NO: 4063 - DNA, 201 bp, Homo sapiens
gctccccacttcatgtcttctgtcatctccaggccctctcagccttccagccccctcgttttggctgcctctaaggccctccaggtcctcctgggcttcckcctctacaatcttccctgtctttcccaccgccaccacccccagttcctcagccgcctgcgcctcccgctctacagtggggactgcatctcccaggagtgc

SEQ ID NO: 4064 - DNA, 201 bp, Homo sapiens
aagcagagagcgcagcccggcagcccctcataagaaccgaggccccggagtcgaagccaggctccagctccagcctctcccttcgggaaaggtggacagtrttcaagggtctgctgtggtacattgttcccttggtcgtagtttactttgccgagtatttcattaaccagggactttttgaactcctctttttctggaaca

SEQ ID NO: 4065 - DNA, 201 bp, Homo sapiens
cctgcctctctgcttgggacccatgggagctgccatctccccagccccaggtctgttctacagctgagctccccacttcatgtcttctgtcatctccaggycctctcagccttccagccccctcgttttggctgcctctaaggccctccaggtcctcctgggcttcctcctctacaatcttccctgtctttcccaccgcca

SEQ ID NO: 4066 - DNA, 201 bp, Homo sapiens
tctgacacactggggatctccctgtcggggctcctggctttgcctctgcatgacttcctctgccagctctcctgatactcgggatcctcaggacgcaggtmacattcacctgtgggcagagggacaggggggccagccattgtctcccacttggggagtttcttcctggcatcatgccttctgaataaatgccgattttat

SEQ ID NO: 4067 - DNA, 201 bp, Homo sapiens
atctacctcgtcttcctgatcattctgtatgaggggctcctgggaggcgcagcctacgtgaacaccttccacaacatcgccctggagaccagtgatgagcrccgggagtttgcaatggcggccacctgcatctctgacacactggggatctccctgtcggggctcctggctttgcctctgcatgacttcctctgccagctc

SEQ ID NO: 4068 - DNA, 201 bp, Homo sapiens
aggggctcctgggaggcgcagcctacgtgaacaccttccacaacatcgccctggagaccagtgatgagcaccgggagtttgcaatggcggccacctgcatytctgacacactggggatctccctgtcggggctcctggctttgcctctgcatgacttcctctgccagctctcctgatactcgggatcctcaggacgcaggt

SEQ ID NO: 4069 - DNA, 201 bp, Homo sapiens
tgccgagtatttcattaaccagggactttttgaactcctctttttctggaacacttccctgagtcacgctcagcaataccgctggtaccagatgctgtacyaggctggcgtctttgcctcccgctcttctctccgctgctgtcgcatccgtttcacctgggccctggccctgctgcagtgcctcaacctggtgttcctgct

SEQ ID NO: 4070 - DNA, 201 bp, Homo sapiens; identical to SEQ ID NO: 4063

SEQ ID NO: 4071 - DNA, 201 bp, Homo sapiens; identical to SEQ ID NO: 4064

SEQ ID NO: 4072 - DNA, 201 bp, Homo sapiens; identical to SEQ ID NO: 4065

SEQ ID NO: 4073 - DNA, 201 bp, Homo sapiens
acatcgggaaaccagagccatgtggacccaggcccaacgccgatcccccacaacagctcatcacgatttgactgcaactctgtctctacggctgctgtgcycctggcggacatcctccccacactcgtcatcaaattgttggctcctcttggccttcacctgctgccctacagcccccgggttctcgtcagtgggatttgt

SEQ ID NO: 4074 - DNA, 201 bp, Homo sapiens
tctgacacactggggatctccctgtcggggctcctggctttgcctctgcatgacttcctctgccagctctcctgatactcgggatcctcaggacgcaggtmacattcacctgtgggcagagggacaggtcagacacccaggcccaccccagagaccctccatgaactgtgctcccagccttcccggcaggtctgggagtag

SEQ ID NO: 4075 - DNA, 201 bp, Homo sapiens; identical to SEQ ID NO: 4067

SEQ ID NO: 4076 - DNA, 201 bp, Homo sapiens; identical to SEQ ID NO: 4068

SEQ ID NO: 4077 - DNA, 201 bp, Homo sapiens
tgccgagtatttcattaaccagggactttttgaactcctctttttctggaacacttccctgagtcacgctcagcaataccgctggtaccagatgctgtacyaggctggcgtctttgcctcccgctcttctctccgctgctgtcgcatccgtttcacctgggccctgttcacagtgcctcaacctggtgttcctgctggcag

SEQ ID NO: 4078 - DNA, 201 bp, Homo sapiens
ctgtgcaggctcgcggcggcgcttttcggattccgagggtgagtattcccgcccaccctcatggaacgaccacctctggctcgcagcccacctgaggggartgagagctgactcggccccgggaggacacgcaaggagcggtcgtgcacctgagagtaggtgggggtcatgccctcttctcgctctcccaggggaggagac

SEQ ID NO: 4079 - DNA, 201 bp, Homo sapiens; identical to SEQ ID NO: 4063

SEQ ID NO: 4080 - DNA, 201 bp, Homo sapiens; identical to SEQ ID NO: 4066

SEQ ID NO: 4081 - DNA, 201 bp, Homo sapiens; identical to SEQ ID NO: 4069

SEQ ID NO: 4082 - DNA, 201 bp, Homo sapiens; identical to SEQ ID NO: 4062

SEQ ID NO: 4083 - DNA, 201 bp, Homo sapiens; identical to SEQ ID NO: 4064

SEQ ID NO: 4084 - DNA, 201 bp, Homo sapiens; identical to SEQ ID NO: 4065

SEQ ID NO: 4085 - DNA, 201 bp, Homo sapiens
tctcgctctcccaggggaggagaccgtcccggagccccggctccctctgttggaccatcagggcgcgcattggaagaacgcggtgggcttctggctgtgcycctggcggacatcctccccacactcgtcatcaaattgttggctcctcttggccttcacctgctgccctacagcccccgggttctcgtcagtgggatttgt

SEQ ID NO: 4086 - DNA, 201 bp, Homo sapiens; identical to SEQ ID NO: 4067

SEQ ID NO: 4087 - DNA, 201 bp, Homo sapiens
tccgagggtgagtattcccgcccaccctcatggaacgaccacctctggctcgcagcccacctgaggggaatgagagctgactcggccccgggaggacacgsaaggagcggtcgtgcacctgagagtaggtgggggtcatgccctcttctcgctctcccaggggaggagaccgtcccggagccccggctccctctgttggac

SEQ ID NO: 4088 - DNA, 201 bp, Homo sapiens; identical to SEQ ID NO: 4068

SEQ ID NO: 4089 - DNA, 201 bp, Homo sapiens; identical to SEQ ID NO: 4063

SEQ ID NO: 4090 - DNA, 201 bp, Homo sapiens; identical to SEQ ID NO: 4066

SEQ ID NO: 4091 - DNA, 201 bp, Homo sapiens; identical to SEQ ID NO: 4069

SEQ ID NO: 4092 - DNA, 201 bp, Homo sapiens; identical to SEQ ID NO: 4062

SEQ ID NO: 4093 - DNA, 201 bp, Homo sapiens
gtgctgctggaagcttcgtcctggttgccttttctcattctgtggggaccagcctgtgtggctccagctccagcctctcccttcgggaaaggtggacagtrttcaagggtctgctgtggtacattgttcccttggtcgtagtttactttgccgagtatttcattaaccagggactttttgaactcctctttttctggaaca

SEQ ID NO: 4094 - DNA, 201 bp, Homo sapiens; identical to SEQ ID NO: 4065

SEQ ID NO: 4095 - DNA, 201 bp, Homo sapiens; identical to SEQ ID NO: 4073

SEQ ID NO: 4096 - DNA, 201 bp, Homo sapiens; identical to SEQ ID NO: 4067

SEQ ID NO: 4097 - DNA, 201 bp, Homo sapiens; identical to SEQ ID NO: 4068

SEQ ID NO: 4098 - DNA, 201 bp, Homo sapiens; identical to SEQ ID NO: 4062

SEQ ID NO: 4099 - DNA, 201 bp, Homo sapiens; identical to SEQ ID NO: 4063

SEQ ID NO: 4100 - DNA, 201 bp, Homo sapiens; identical to SEQ ID NO: 4064

SEQ ID NO: 4101 - DNA, 201 bp, Homo sapiens; identical to SEQ ID NO: 4065

SEQ ID NO: 4102 - DNA, 201 bp, Homo sapiens; identical to SEQ ID NO: 4066

SEQ ID NO: 4103 - DNA, 201 bp, Homo sapiens; identical to SEQ ID NO: 4067

SEQ ID NO: 4104 - DNA, 201 bp, Homo sapiens; identical to SEQ ID NO: 4068

SEQ ID NO: 4105 - DNA, 201 bp, Homo sapiens; identical to SEQ ID NO: 4069

SEQ ID NO: 4106 - DNA, 201 bp, Homo sapiens; identical to SEQ ID NO: 4063

SEQ ID NO: 4107 - DNA, 201 bp, Homo sapiens
cagggccgtgatctcctggtggtcctcagggactgggggagctgggctgctgggggccctgtcctacctgggcctcacccaggccggcctctcccctcagyagaccctgctgtccatgctgggtatccctgccctgctgctggccagctatttcttgttgctcacatctcctgaggcccaggaccctggaggggaagaaga

SEQ ID NO: 4108 - DNA, 201 bp, Homo sapiens
gttctcgtcagtgggatttgtgctgctggaagcttcgtcctggttgccttttctcattctgtggggaccagcctgtgtggtgtggtcttcgctagcatctsatcaggccttggggaggtcaccttcctctccctcactgccttctaccccagggccgtgatctcctggtggtcctcagggactgggggagctgggctgctg

SEQ ID NO: 4109 - DNA, 201 bp, Homo sapiens; identical to SEQ ID NO: 4066

SEQ ID NO: 4110 - DNA, 201 bp, Homo sapiens
ggaagcttcgtcctggttgccttttctcattctgtggggaccagcctgtgtggtgtggtcttcgctagcatctcatcaggccttggggaggtcaccttccyctccctcactgccttctaccccagggccgtgatctcctggtggtcctcagggactgggggagctgggctgctgggggccctgtcctacctgggcctcacc

SEQ ID NO: 4111 - DNA, 201 bp, Homo sapiens; identical to SEQ ID NO: 4069

SEQ ID NO: 4112 - DNA, 201 bp, Homo sapiens; identical to SEQ ID NO: 4062

SEQ ID NO: 4113 - DNA, 201 bp, Homo sapiens
aggtcaccttcctctccctcactgccttctaccccagggccgtgatctcctggtggtcctcagggactgggggagctgggctgctgggggccctgtcctamctgggcctcacccaggccggcctctcccctcagcagaccctgctgtccatgctgggtatccctgccctgctgctggccagctatttcttgttgctcacat

SEQ ID NO: 4114 - DNA, 201 bp, Homo sapiens; identical to SEQ ID NO: 4064

SEQ ID NO: 4115 - DNA, 201 bp, Homo sapiens; identical to SEQ ID NO: 4065

SEQ ID NO: 4116 - DNA, 201 bp, Homo sapiens
ttcggattccgagggggaggagaccgtcccggagccccggctccctctgttggaccatcagggcgcgcattggaagaacgcggtgggcttctggctgtgcycctggcggacatcctccccacactcgtcatcaaattgttggctcctcttggccttcacctgctgccctacagcccccgggttctcgtcagtgggatttgt

SEQ ID NO: 4117 - DNA, 201 bp, Homo sapiens; identical to SEQ ID NO: 4067

SEQ ID NO: 4118 - DNA, 201 bp, Homo sapiens; identical to SEQ ID NO: 4068

SEQ ID NO: 4119 - DNA, 201 bp, Homo sapiens; identical to SEQ ID NO: 4063

SEQ ID NO: 4120 - DNA, 201 bp, Homo sapiens
gttctcgtcagtgggatttgtgctgctggaagcttcgtcctggttgccttttctcattctgtggggaccagcctgtgtggtgtggtcttcgctagcatctsatcaggccttggggaggtcaccttcctctccctcactgccttctaccccagctatttcttgttgctcacatctcctgaggcccaggaccctggaggggaa

SEQ ID NO: 4121 - DNA, 201 bp, Homo sapiens; identical to SEQ ID NO: 4066

SEQ ID NO: 4122 - DNA, 201 bp, Homo sapiens
ggaagcttcgtcctggttgccttttctcattctgtggggaccagcctgtgtggtgtggtcttcgctagcatctcatcaggccttggggaggtcaccttccyctccctcactgccttctaccccagctatttcttgttgctcacatctcctgaggcccaggaccctggaggggaagaagaagcagagagcgcagcccggcag

SEQ ID NO: 4123 - DNA, 201 bp, Homo sapiens; identical to SEQ ID NO: 4069

SEQ ID NO: 4124 - DNA, 201 bp, Homo sapiens; identical to SEQ ID NO: 4062

SEQ ID NO: 4125 - DNA, 201 bp, Homo sapiens; identical to SEQ ID NO: 4064

SEQ ID NO: 4126 - DNA, 201 bp, Homo sapiens; identical to SEQ ID NO: 4065

SEQ ID NO: 4127 - DNA, 201 bp, Homo sapiens; identical to SEQ ID NO: 4073

SEQ ID NO: 4128 - DNA, 201 bp, Homo sapiens; identical to SEQ ID NO: 4067

SEQ ID NO: 4129 - DNA, 201 bp, Homo sapiens; identical to SEQ ID NO: 4068

SEQ ID NO: 4130 - DNA, 201 bp, Homo sapiens; identical to SEQ ID NO: 4078

SEQ ID NO: 4131 - DNA, 201 bp, Homo sapiens; identical to SEQ ID NO: 4063

SEQ ID NO: 4132 - DNA, 201 bp, Homo sapiens; identical to SEQ ID NO: 4107

SEQ ID NO: 4133 - DNA, 201 bp, Homo sapiens; identical to SEQ ID NO: 4108

SEQ ID NO: 4134 - DNA, 201 bp, Homo sapiens; identical to SEQ ID NO: 4066

SEQ ID NO: 4135 - DNA, 201 bp, Homo sapiens; identical to SEQ ID NO: 4110

SEQ ID NO: 4136 - DNA, 201 bp, Homo sapiens; identical to SEQ ID NO: 4069

SEQ ID NO: 4137 - DNA, 201 bp, Homo sapiens; identical to SEQ ID NO: 4062

SEQ ID NO: 4138 - DNA, 201 bp, Homo sapiens; identical to SEQ ID NO: 4113

SEQ ID NO: 4139 - DNA, 201 bp, Homo sapiens; identical to SEQ ID NO: 4064

SEQ ID NO: 4140 - DNA, 201 bp, Homo sapiens; identical to SEQ ID NO: 4065

SEQ ID NO: 4141 - DNA, 201 bp, Homo sapiens; identical to SEQ ID NO: 4067

SEQ ID NO: 4142 - DNA, 201 bp, Homo sapiens; identical to SEQ ID NO: 4068

SEQ ID NO: 4143 - DNA, 201 bp, Homo sapiens; identical to SEQ ID NO: 4087

SEQ ID NO: 4144 - DNA, 201 bp, Homo sapiens; identical to SEQ ID NO: 4063

SEQ ID NO: 4145 - DNA, 201 bp, Homo sapiens; identical to SEQ ID NO: 4107

SEQ ID NO: 4146 - DNA, 201 bp, Homo sapiens; identical to SEQ ID NO: 4108

SEQ ID NO: 4147 - DNA, 201 bp, Homo sapiens; identical to SEQ ID NO: 4066

SEQ ID NO: 4148 - DNA, 201 bp, Homo sapiens; identical to SEQ ID NO: 4110

SEQ ID NO: 4149 - DNA, 201 bp, Homo sapiens
agtgttcaaggttcggatgatggctgggtttgaactcctctttttctggaacacttccctgagtcacgctcagcaataccgctggtaccagatgctgtacyaggctggcgtctttgcctcccgctcttctctccgctgctgtcgcatccgtttcacctgggccctggccctgctgcagtgcctcaacctggtgttcctgct

SEQ ID NO: 4150 - DNA, 201 bp, Homo sapiens; identical to SEQ ID NO: 4062

SEQ ID NO: 4151 - DNA, 201 bp, Homo sapiens; identical to SEQ ID NO: 4113

SEQ ID NO: 4152 - DNA, 201 bp, Homo sapiens
aagcagagagcgcagcccggcagcccctcataagaaccgaggccccggagtcgaagccaggctccagctccagcctctcccttcgggaaaggtggacagtrttcaaggttcggatgatggctgggtttgaactcctctttttctggaacacttccctgagtcacgctcagcaataccgctggtaccagatgctgtaccagg

SEQ ID NO: 4153 - DNA, 201 bp, Homo sapiens; identical to SEQ ID NO: 4065

SEQ ID NO: 4154 - DNA, 201 bp, Homo sapiens; identical to SEQ ID NO: 4073

SEQ ID NO: 4155 - DNA, 201 bp, Homo sapiens; identical to SEQ ID NO: 4067

SEQ ID NO: 4156 - DNA, 201 bp, Homo sapiens; identical to SEQ ID NO: 4068

SEQ ID NO: 4157 - DNA, 201 bp, Homo sapiens; identical to SEQ ID NO: 4062

SEQ ID NO: 4158 - DNA, 201 bp, Homo sapiens; identical to SEQ ID NO: 4063

SEQ ID NO: 4159 - DNA, 201 bp, Homo sapiens; identical to SEQ ID NO: 4064

SEQ ID NO: 4160 - DNA, 201 bp, Homo sapiens; identical to SEQ ID NO: 4065

SEQ ID NO: 4161 - DNA, 201 bp, Homo sapiens; identical to SEQ ID NO: 4066

SEQ ID NO: 4162 - DNA, 201 bp, Homo sapiens; identical to SEQ ID NO: 4067

SEQ ID NO: 4163 - DNA, 201 bp, Homo sapiens; identical to SEQ ID NO: 4068

SEQ ID NO: 4164 - DNA, 201 bp, Homo sapiens; identical to SEQ ID NO: 4069

SEQ ID NO: 4165 - DNA, 201 bp, Homo sapiens; identical to SEQ ID NO: 4063

SEQ ID NO: 4166 - DNA, 201 bp, Homo sapiens; identical to SEQ ID NO: 4107

SEQ ID NO: 4167 - DNA, 201 bp, Homo sapiens; identical to SEQ ID NO: 4108

SEQ ID NO: 4168 - DNA, 201 bp, Homo sapiens; identical to SEQ ID NO: 4066

SEQ ID NO: 4169 - DNA, 201 bp, Homo sapiens; identical to SEQ ID NO: 4110

SEQ ID NO: 4170 - DNA, 201 bp, Homo sapiens; identical to SEQ ID NO: 4069

SEQ ID NO: 4171 - DNA, 201 bp, Homo sapiens; identical to SEQ ID NO: 4062

SEQ ID NO: 4172 - DNA, 201 bp, Homo sapiens; identical to SEQ ID NO: 4113

SEQ ID NO: 4173 - DNA, 201 bp, Homo sapiens; identical to SEQ ID NO: 4064

SEQ ID NO: 4174 - DNA, 201 bp, Homo sapiens; identical to SEQ ID NO: 4065

SEQ ID NO: 4175 - DNA, 201 bp, Homo sapiens; identical to SEQ ID NO: 4073

SEQ ID NO: 4176 - DNA, 201 bp, Homo sapiens; identical to SEQ ID NO: 4067

SEQ ID NO: 4177 - DNA, 201 bp, Homo sapiens; identical to SEQ ID NO: 4068

SEQ ID NO: 4178 - DNA, 201 bp, Homo sapiens; identical to SEQ ID NO: 4063

SEQ ID NO: 4179 - DNA, 201 bp, Homo sapiens; identical to SEQ ID NO: 4107

SEQ ID NO: 4180 - DNA, 201 bp, Homo sapiens; identical to SEQ ID NO: 4108

SEQ ID NO: 4181 - DNA, 201 bp, Homo sapiens; identical to SEQ ID NO: 4066

SEQ ID NO: 4182 - DNA, 201 bp, Homo sapiens; identical to SEQ ID NO: 4110

SEQ ID NO: 4183 - DNA, 201 bp, Homo sapiens; identical to SEQ ID NO: 4069

SEQ ID NO: 4184 - DNA, 201 bp, Homo sapiens; identical to SEQ ID NO: 4062

SEQ ID NO: 4185 - DNA, 201 bp, Homo sapiens; identical to SEQ ID NO: 4113

SEQ ID NO: 4186 - DNA, 201 bp, Homo sapiens; identical to SEQ ID NO: 4064

SEQ ID NO: 4187 - DNA, 201 bp, Homo sapiens; identical to SEQ ID NO: 4065

SEQ ID NO: 4188 - DNA, 201 bp, Homo sapiens; identical to SEQ ID NO: 4073

SEQ ID NO: 4189 - DNA, 201 bp, Homo sapiens; identical to SEQ ID NO: 4067

SEQ ID NO: 4190 - DNA, 201 bp, Homo sapiens; identical to SEQ ID NO: 4068

SEQ ID NO: 4191 - DNA, 201 bp, Homo sapiens
tacctcctgggagatgcagtccccactgtagagcgggaggcgcaggcggctgaggaactgggggtggtggcggtgggaaagacagggaagattgtagaggmggaagcccaggaggacctggagggccttagaggcagccaaaacgagggggctggaaggctgagagggcctggagatgacagaagacatgaagtggggagc

SEQ ID NO: 4192 - DNA, 201 bp, Homo sapiens
ggagggggatgaggagagagaggctgaggtgagccctttccccaaacagccccaggtcctgggcactgaaagaacagaagaggctgctgagagccagaccrcagggagggaagctgtgggaggccaggaggcaggggagagctttgagggccaggtagacctgcgtggtaaggaggctgagatgaggcaggacttggggat

SEQ ID NO: 4193 - DNA, 184 bp, Homo sapiens
cagacagagacagacaggatggacttcctccggctatacctccctgggctgcaccaggccttgaggggggcactggattccctyggcacctttgtctcctacctcctgggagatgcagtccccactgtagagcgggaggcgcaggcggctgaggaactgggggtggtggcggtgggaaagacag

SEQ ID NO: 4194 - DNA, 201 bp, Homo sapiens
cccaggagaaaggctcctagaggctactggaaaagtctgggtcctagaggaggagggggatgaggagagagaggctgaggtgagccctttccccaaacagscccaggtcctgggcactgaaagaacagaagaggctgctgagagccagaccgcagggagggaagctgtgggaggccaggaggcaggggagagctttgaggg

SEQ ID NO: 4195 - DNA, 201 bp, Homo sapiens
gaaatccaaggcagggtctggggcttgccaagacaggagcggccaagcccaggagaggcaggagtcccatgagcaggaagtgaacagagaagagaggctgrgaagctgggaacaggaggaggaggaggaagaggtcagggcaagagagccagggatggccagaggggcggagtcagagtggacctggcatggggagacgga

SEQ ID NO: 4196 - DNA, 201 bp, Homo sapiens
agagccagggatggccagaggggcggagtcagagtggacctggcatggggagacggaggggaaggctggtgctgttgggccaaaggcggcaggggacaacygggagatggagcagggggtcagggaggcagatgcaggggaaactgaggagcctggggccgaaggggctgggaaaggagaagaggtggtagtggtggagaa

SEQ ID NO: 4197 - DNA, 201 bp, Homo sapiens
aggccagaaagaaatccaaggcagggtctggggcttgccaagacaggagcggccaagcccaggagaggcaggagtcccatgagcaggaagtgaacagagargagaggctgagaagctgggaacaggaggaggaggaggaagaggtcagggcaagagagccagggatggccagaggggcggagtcagagtggacctggcatg

SEQ ID NO: 4198 - DNA, 201 bp, Homo sapiens
tggcggtgggaaagacagggaagattgtagaggaggaagcccaggaggacctggagggccttagaggcagccaaaacgagggggctggaaggctgagaggrcctggagatgacagaagacatgaagtggggagctcagctgtagaacagacctggggctggggagatggcagctcccatgggtcccaagcagagaggcagg

SEQ ID NO: 4199 - DNA, 201 bp, Homo sapiens
gctgaaacagcctcaggcggggaggaggccgggacagcctcgggaggggaggaggccgggatagcctcaggcggggaggctgggacagcctcaggaggggrggaggccgggacagcctcaggaggggaggaggccgggacagcctcaggaggggacgaggcctggacaacctcaggcaaagaggaggctgacctgctggga

SEQ ID NO: 4200 - DNA, 201 bp, Homo sapiens
ccgtcactgggagaggcctatgccagagaaactgaggatgaggaggcggaggctgacagaacatccagaagaggctggaggctgcaagcggtggctgtggscctcccggaccgtgaggatgcacagactggctctgtggctgctgggattatggggggtgatgtggtcccacacatcagcgctgctggcgctggtgaagct

SEQ ID NO: 4201 - DNA, 201 bp, Homo sapiens
cagcctcaggcggggaggaggccgggacagcctcgggaggggaggaggccgggatagcctcaggcggggaggctgggacagcctcaggaggggaggaggcygggacagcctcaggaggggaggaggccgggacagcctcaggaggggacgaggcctggacaacctcaggcaaagaggaggctgacctgctgggagtcagac

SEQ ID NO: 4202 - DNA, 201 bp, Homo sapiens
agccaggacaatctcaggcggggaggaggctgaaacagcctcaggcggggaggaggccgggacagcctcgggaggggaggaggccgggatagcctcaggcrgggaggctgggacagcctcaggaggggaggaggccgggacagcctcaggaggggaggaggccgggacagcctcaggaggggacgaggcctggacaacctc

SEQ ID NO: 4203 - DNA, 201 bp, Homo sapiens
cgtgaggatgcacagactggctctgtggctgctgggattatggggggtgatgtggtcccacacatcagcgctgctggcgctggtgaagctttggaaggggygcttgggcaaggctgggactcgaaagaaaaggaagaggcagcagcaggagagcatgcaggtgggcaagaatttggtctggagggctcagcagaggaagag

SEQ ID NO: 4204 - DNA, 201 bp, Homo sapiens
cagtgtcttgatgtatcattcatggagcaggcaaaaccagacgtctgggaagaccgtgaacttaaggagtctgattctccgacacaggctggtggaccacstaccccactgagaccacctctcagggtgcctgccctggttcctccccagcctgagtcagctgtctggactgcaaggaggctgggcacgggggctcacgcc

SEQ ID NO: 4205 - DNA, 201 bp, Homo sapiens
gagactgcgggaggccagaccctggcggctgaggctgaaggagaccgagagtctgaactatcagaagtcccagaggcaggcggggaggggctgacaacccrggacgcgggatgtggaactgaggagggagaggcatctgtctcagagaaccaggagctggacggaagcacaggggcagacgcagggccttgcccgtcactg

SEQ ID NO: 4206 - DNA, 201 bp, Homo sapiens
ctgaaggagaccgagagtctgaactatcagaagtcccagaggcaggcggggaggggctgacaacccaggacgcgggatgtggaactgaggagggagaggcrtctgtctcagagaaccaggagctggacggaagcacaggggcagacgcagggccttgcccgtcactgggagaggcctatgccagagaaactgaggatgagg

SEQ ID NO: 4207 - DNA, 201 bp, Homo sapiens
agagtgaggcggcccagactagctgtggcctactgggcgtggaatggggtggcctcacacacagcgtcaccaaaggccaaggacctgagctgatggggggygcccagaccccaactaagcaacccgaggaaagggaggcaggggaggtggagctcatgggagttctggccctgagcaaagaggagcaggagaggagcctgg

SEQ ID NO: 4208 - DNA, 201 bp, Homo sapiens
aggaggagctcacaggggaggagagtgaggcggcccagactagctgtggcctactgggcgtggaatggggtggcctcacacacagcgtcaccaaaggccarggacctgagctgatggggggcgcccagaccccaactaagcaacccgaggaaagggaggcaggggaggtggagctcatgggagttctggccctgagcaaag

SEQ ID NO: 4209 - DNA, 201 bp, Homo sapiens
tccccgggtccctcctagacgtctctgtcccaaggagtcgcgtgcacctctcgagaagctcctcacagcgtcgctcccggccctcttttcgtcggactccrgcctgggagcagcaggaggagcccccagcccccaaccctcctgaggaggagctgtcagctcctgagcagagacccctccagctggaggaacccctggagc

SEQ ID NO: 4210 - DNA, 201 bp, Homo sapiens; identical to SEQ ID NO: 4191

SEQ ID NO: 4211 - DNA, 201 bp, Homo sapiens; identical to SEQ ID NO: 4192

SEQ ID NO: 4212 - DNA, 184 bp, Homo sapiens; identical to SEQ ID NO: 4193

SEQ ID NO: 4213 - DNA, 201 bp, Homo sapiens; identical to SEQ ID NO: 4194

SEQ ID NO: 4214 - DNA, 201 bp, Homo sapiens; identical to SEQ ID NO: 4195

SEQ ID NO: 4215 - DNA, 201 bp, Homo sapiens; identical to SEQ ID NO: 4196

SEQ ID NO: 4216 - DNA, 201 bp, Homo sapiens; identical to SEQ ID NO: 4197

SEQ ID NO: 4217 - DNA, 201 bp, Homo sapiens; identical to SEQ ID NO: 4198

SEQ ID NO: 4218 - DNA, 201 bp, Homo sapiens; identical to SEQ ID NO: 4199

SEQ ID NO: 4219 - DNA, 201 bp, Homo sapiens; identical to SEQ ID NO: 4200

SEQ ID NO: 4220 - DNA, 201 bp, Homo sapiens; identical to SEQ ID NO: 4201

SEQ ID NO: 4221 - DNA, 201 bp, Homo sapiens
ggctgagacagcctcaggcggggaggaggctgaaacagcctcaggcggggaggaggccgggacagcctcgggaggggaggaggccgggatagcctcaggcrgggaggctgggacagcctcaggaggggaggaggccgggacagcctcaggaggggaggaggccgggacagcctcaggaggggacgaggcctggacaacctc

SEQ ID NO: 4222 - DNA, 201 bp, Homo sapiens; identical to SEQ ID NO: 4203

SEQ ID NO: 4223 - DNA, 201 bp, Homo sapiens; identical to SEQ ID NO: 4204

SEQ ID NO: 4224 - DNA, 201 bp, Homo sapiens; identical to SEQ ID NO: 4205

SEQ ID NO: 4225 - DNA, 201 bp, Homo sapiens; identical to SEQ ID NO: 4206

SEQ ID NO: 4226 - DNA, 201 bp, Homo sapiens; identical to SEQ ID NO: 4207

SEQ ID NO: 4227 - DNA, 201 bp, Homo sapiens; identical to SEQ ID NO: 4208

SEQ ID NO: 4228 - DNA, 201 bp, Homo sapiens; identical to SEQ ID NO: 4209

SEQ ID NO: 4229 - DNA, 201 bp, Homo sapiens; identical to SEQ ID NO: 4191

SEQ ID NO: 4230 - DNA, 201 bp, Homo sapiens; identical to SEQ ID NO: 4203

SEQ ID NO: 4231 - DNA, 201 bp, Homo sapiens; identical to SEQ ID NO: 4192

SEQ ID NO: 4232 - DNA, 184 bp, Homo sapiens; identical to SEQ ID NO: 4193

SEQ ID NO: 4233 - DNA, 201 bp, Homo sapiens; identical to SEQ ID NO: 4194

SEQ ID NO: 4234 - DNA, 201 bp, Homo sapiens; identical to SEQ ID NO: 4205

SEQ ID NO: 4235 - DNA, 201 bp, Homo sapiens; identical to SEQ ID NO: 4204

SEQ ID NO: 4236 - DNA, 201 bp, Homo sapiens; identical to SEQ ID NO: 4195

SEQ ID NO: 4237 - DNA, 201 bp, Homo sapiens; identical to SEQ ID NO: 4196

SEQ ID NO: 4238 - DNA, 201 bp, Homo sapiens; identical to SEQ ID NO: 4206

SEQ ID NO: 4239 - DNA, 201 bp, Homo sapiens; identical to SEQ ID NO: 4207

SEQ ID NO: 4240 - DNA, 201 bp, Homo sapiens; identical to SEQ ID NO: 4197

SEQ ID NO: 4241 - DNA, 201 bp, Homo sapiens; identical to SEQ ID NO: 4198

SEQ ID NO: 4242 - DNA, 201 bp, Homo sapiens; identical to SEQ ID NO: 4208

SEQ ID NO: 4243 - DNA, 201 bp, Homo sapiens; identical to SEQ ID NO: 4209

SEQ ID NO: 4244 - DNA, 201 bp, Homo sapiens
gccaggacaatctcaggcggggaggaggctgaaacagcctcaggcggggaggaggccgggacagcctcgggaggggaggaggccgggatagcctcaggggrggaggccgggacagcctcaggaggggaggaggccgggacagcctcaggaggggacgaggcctggacaacctcaggcaaagaggaggctgacctgctggga

SEQ ID NO: 4245 - DNA, 201 bp, Homo sapiens; identical to SEQ ID NO: 4200

SEQ ID NO: 4246 - DNA, 201 bp, Homo sapiens
caatctcaggcggggaggaggctgaaacagcctcaggcggggaggaggccgggacagcctcgggaggggaggaggccgggatagcctcaggggaggaggcygggacagcctcaggaggggaggaggccgggacagcctcaggaggggacgaggcctggacaacctcaggcaaagaggaggctgacctgctgggagtcagac

SEQ ID NO: 4247 - DNA, 201 bp, Homo sapiens
cagtgtcttgatgtatcattcatggagcaggcaaaaccagacgtctgggaataccgtgaacttaaggagtctgattctccgacacaggctggtggaccacstaccccactgagaccacctctcagggtgcctgccctggttcctccccagcctgagtcagctgtctggactgcaaggaggctgggcacgggggctcacgcc

SEQ ID NO: 4248 - DNA, 201 bp, Homo sapiens; identical to SEQ ID NO: 4191

SEQ ID NO: 4249 - DNA, 201 bp, Homo sapiens; identical to SEQ ID NO: 4200

SEQ ID NO: 4250 - DNA, 201 bp, Homo sapiens; identical to SEQ ID NO: 4195

SEQ ID NO: 4251 - DNA, 201 bp, Homo sapiens; identical to SEQ ID NO: 4198

SEQ ID NO: 4252 - DNA, 201 bp, Homo sapiens; identical to SEQ ID NO: 4205

SEQ ID NO: 4253 - DNA, 201 bp, Homo sapiens; identical to SEQ ID NO: 4203

SEQ ID NO: 4254 - DNA, 201 bp, Homo sapiens
ggagggggatgaggagagagaggctgaggtgagccctttccccaaacaggcccaggtcctgggcactgaaagaacagaagaggctgctgagagccagaccrcagggagggaagctgtgggaggccaggaggcaggggagagctttgagggccaggtagacctgcgtggtaaggaggctgagatgaggcaggacttggggat

SEQ ID NO: 4255 - DNA, 201 bp, Homo sapiens; identical to SEQ ID NO: 4196

SEQ ID NO: 4256 - DNA, 201 bp, Homo sapiens; identical to SEQ ID NO: 4197

SEQ ID NO: 4257 - DNA, 201 bp, Homo sapiens
tccaggagaaaggctcctagaggctactggaaaagtctgggtcctagaggaggagggggatgaggagagagaggctgaggtgagccctttccccaaacagscccaggtcctgggcactgaaagaacagaagaggctgctgagagccagaccgcagggagggaagctgtgggaggccaggaggcaggggagagctttgaggg

SEQ ID NO: 4258 - DNA, 201 bp, Homo sapiens; identical to SEQ ID NO: 4206

SEQ ID NO: 4259 - DNA, 201 bp, Homo sapiens
agagtgaggcggcccagactagctgtggcctactgggcgtggaatggggtggcctcacacacagcgtcaccaaaggccagggacctgagctgatggggggygcccagaccccaactaagcaacccgaggaaagggaggcaggggaggtggagctcatgggagttctggccctgagcaaagaggagcaggagaggagcctgg

SEQ ID NO: 4260 - DNA, 201 bp, Homo sapiens
aggaggagctcacaggggaggagagtgaggcggcccagactagctgtggcctactgggcgtggaatggggtggcctcacacacagcgtcaccaaaggccarggacctgagctgatggggggtgcccagaccccaactaagcaacccgaggaaagggaggcaggggaggtggagctcatgggagttctggccctgagcaaag

SEQ ID NO: 4261 - DNA, 109 bp, Homo sapiens
aaaaaaaaycctcctgggagatgcagtccccactgtagagcgggaggcgcaggcggctgaggaactgggggtggtggcggtgggaaagacagggaagattgtagaggag

SEQ ID NO: 4262 - DNA, 201 bp, Homo sapiens; identical to SEQ ID NO: 4209

SEQ ID NO: 4263 - DNA, 201 bp, Homo sapiens
acaaagtcagggttcttcaagtcacaaagggaagggcaggaacaactcttgcctctcagtcccacacaaggcagctgtctcacactttacaagctgtgagrgacacatcagagccctgggcactgtcactgcttgcagcctgagtcctcctccacctcacagcagcgaccacagctccagtgatcacagctccaaagagaa

SEQ ID NO: 4264 - DNA, 201 bp, Homo sapiens
gccgccatgtccgccgcggtccaagagcgcaggtcctcgttcaaggcgatgtaatccttgccgtcgtaggcgtcctgccggtacccgcggaggaagcgccmgtccgaccccacgtcgcagccatacatcatctggatgggtgttagaccctggccccgcccccgctgtcagccccgcccaccgagccccgcccccgccccg

SEQ ID NO: 4265 - DNA, 201 bp, Homo sapiens
caagggtctcggggtcccgcggtttcggggaggatctcggacccagagactcgaggcgacccggccctccgtgggggatggggaggggtcgtgacctgcgycccgggccggggtcactcaccgccctcgctctggttgtagtagctgtctcctcttcccaatactccggcccctcctgctccacccacggcgcccgcggct

SEQ ID NO: 4266 - DNA, 201 bp, Homo sapiens
atctgagccgccatgtccgccgcggtccaagagcgcaggtcctcgttcaaggcgatgtaatccttgccgtcgtaggcgtcctgccggtacccgcggaggargcgcccgtccgaccccacgtcgcagccatacatcatctggatgggtgttagaccctggccccgcccccgctgtcagccccgcccaccgagccccgccccc

SEQ ID NO: 4267 - DNA, 201 bp, Homo sapiens
actttacaagctgtgagagacacatcagagccctgggcactgtcactgcttgcagcctgagtcctcctccacctcacagcagcgaccacagctccagtgawcacagctccaaagagaaccaggccagcaatgatgcccacgatggggatggtgggctgggaagacggctcccatctcagggtgaggggcttgggcaaaccc

SEQ ID NO: 4268 - DNA, 201 bp, Homo sapiens
ccacttgcgctgggtgatctgagccgccatgtccgccgcggtccaagagcgcaggtcctcgttcaaggcgatgtaatccttgccgtcgtaggcgtcctgcyggtacccgcggaggaagcgcccgtccgaccccacgtcgcagccatacatcatctggatgggtgttagaccctggccccgcccccgctgtcagccccgccc

SEQ ID NO: 4269 - DNA, 201 bp, Homo sapiens
taggctctcaactgctccgccacacgggccgcctcccacttgcgctgggtgatctgagccgccatgtccgccgcggtccaagagcgcaggtcctcgttcarggcgatgtaatccttgccgtcgtaggcgtcctgccggtacccgcggaggaagcgcccgtccgaccccacgtcgcagccatacatcatctggatgggtgtt

SEQ ID NO: 4270 - DNA, 201 bp, Homo sapiens
ccaggtatctgcggagccactccacgcacgtgccctccaggtaggctctcaactgctccgccacacgggccgcctcccacttgcgctgggtgatctgagcygccatgtccgccgcggtccaagagcgcaggtcctcgttcaaggcgatgtaatccttgccgtcgtaggcgtcctgccggtacccgcggaggaagcgcccgt

SEQ ID NO: 4271 - DNA, 201 bp, Homo sapiens
tcgttcaaggcgatgtaatccttgccgtcgtaggcgtcctgccggtacccgcggaggaagcgcccgtccgaccccacgtcgcagccatacatcatctggaygggtgttagaccctggccccgcccccgctgtcagccccgcccaccgagccccgcccccgccccgaccaacccgcggggattttggctgaaaatgaaaccg

SEQ ID NO: 4272 - DNA, 201 bp, Homo sapiens
tctctcttcactttgcatcacggaatccccgtcccagaactggactccctgcctcctactccttacctgtccccgtggactcttctagaagaaaaatcacbccagggagcttgttgccagagagtgagcttgccctgggaatggaggtgtagagacagggttttttgttgttattgtttgtttgttttttaaatctggaaa

SEQ ID NO: 4273 - DNA, 201 bp, Homo sapiens
gtgcgtgggaactttagaaccgggaccgcggctacattgattggcttctctaggaacccgacactcaatgggagtgagaactggggcagcctggtgagtakccaggaagaaggacccgacacaggttgggagagggagaagagaaaccctgcggagatggggaatccccagcgctgggcctccccaatccatacaccgcct

SEQ ID NO: 4274 - DNA, 201 bp, Homo sapiens
cccgttctccaggtatctgcggagccactccacgcacgtgccctccaggtaggctctcaactgctccgccacacgggccgcctcccacttgcgctgggtgrtctgagccgccatgtccgccgcggtccaagagcgcaggtcctcgttcaaggcgatgtaatccttgccgtcgtaggcgtcctgccggtacccgcggaggaa

SEQ ID NO: 4275 - DNA, 201 bp, Homo sapiens
tcccggtgggtgcgtgggaactttagaaccgggaccgcggctacattgattggcttctctaggaacccgacactcaatgggagtgagaactggggcagcckggtgagtatccaggaagaaggacccgacacaggttgggagagggagaagagaaaccctgcggagatggggaatccccagcgctgggcctccccaatccat

SEQ ID NO: 4276 - DNA, 201 bp, Homo sapiens
tccttcccgttctccaggtatctgcggagccactccacgcacgtgccctccaggtaggctctcaactgctccgccacacgggccgcctcccacttgcgctkggtgatctgagccgccatgtccgccgcggtccaagagcgcaggtcctcgttcaaggcgatgtaatccttgccgtcgtaggcgtcctgccggtacccgcgg

SEQ ID NO: 4277 - DNA, 201 bp, Homo sapiens
gccatgacaccatcctcggcgactggggagaatcggagtcccggtgggtgcgtgggaactttagaaccgggaccgcggctacattgattggcttctctagraacccgacactcaatgggagtgagaactggggcagcctggtgagtatccaggaagaaggacccgacacaggttgggagagggagaagagaaaccctgcgg

SEQ ID NO: 4278 - DNA, 201 bp, Homo sapiens
cgtctccttcccgttctccaggtatctgcggagccactccacgcacgtgccctccaggtaggctctcaactgctccgccacacgggccgcctcccacttgygctgggtgatctgagccgccatgtccgccgcggtccaagagcgcaggtcctcgttcaaggcgatgtaatccttgccgtcgtaggcgtcctgccggtaccc

SEQ ID NO: 4279 - DNA, 201 bp, Homo sapiens
gaccccgcactcacctgcccaggtctgggtcaggaccagggcccccgagagcagcagaagcagggttcggggcgccatgacaccatcctcggcgactgggragaatcggagtcccggtgggtgcgtgggaactttagaaccgggaccgcggctacattgattggcttctctaggaacccgacactcaatgggagtgagaac

SEQ ID NO: 4280 - DNA, 201 bp, Homo sapiens
gtgcgctgcagcgtctccttcccgttctccaggtatctgcggagccactccacgcacgtgccctccaggtaggctctcaactgctccgccacacgggccgyctcccacttgcgctgggtgatctgagccgccatgtccgccgcggtccaagagcgcaggtcctcgttcaaggcgatgtaatccttgccgtcgtaggcgtcc

SEQ ID NO: 4281 - DNA, 201 bp, Homo sapiens
cccacgatggggatggtgggctgggaagacggctcccatctcagggtgaggggcttgggcaaaccctcatgctgcacatggcaggtgtatctctgctcctbtccagaaggcaccaccacagccgcccacttctggaaggttccatcccctgcaggcctggtctccacgagctccgtgtcctgggtctggtcctccccatcc

SEQ ID NO: 4282 - DNA, 201 bp, Homo sapiens
atgatgcccacgatggggatggtgggctgggaagacggctcccatctcagggtgaggggcttgggcaaaccctcatgctgcacatggcaggtgtatctctkctcctgtccagaaggcaccaccacagccgcccacttctggaaggttccatcccctgcaggcctggtctccacgagctccgtgtcctgggtctggtcctcc

SEQ ID NO: 4283 - DNA, 201 bp, Homo sapiens
tacctcaaggagtggaagcctgggagcaaggagggggctgagactctcccgaccctcctcccggcaccgcaaccgggttcctgcgcccccgccgggcaggmccctagctactccccacagaggccgtttccctcccgaccccgcactcacctgcccaggtctgggtcaggaccagggcccccgagagcagcagaagcaggg

SEQ ID NO: 4284 - DNA, 201 bp, Homo sapiens
gagacagagatggagacacctcagccccacctctctggaacaggaaagatgattggggagggagcacaggtcagcgtgggaagagggtcatggtggacatsggggtggggtggtctccccacctcctcacattatgcctacacgaacacagacacatgcaggtgcctttgcagaaacaaagtcagggttcttcaagtcaca

SEQ ID NO: 4285 - DNA, 201 bp, Homo sapiens
acctcctcacattatgcctacacgaacacagacacatgcaggtgcctttgcagaaacaaagtcagggttcttcaagtcacaaagggaagggcaggaacaamtcttgcctctcagtcccacacaaggcagctgtctcacactttacaagctgtgagagacacatcagagccctgggcactgtcactgcttgcagcctgagtc

SEQ ID NO: 4286 - DNA, 201 bp, Homo sapiens
  misc_feature (1)...(201): n = A,T,C or G, or insertion/deletion polymorphism (see Tables 1-2)
ggaaagatgattggggagggagcacaggtcagcgtgggaagagggtcatggtggacatgggggtggggtggtctccccacctcctcacattatgcctacangaacacagacacatgcaggtgcctttgcagaaacaaagtcagggttcttcaagtcacaaagggaagggcaggaacaactcttgcctctcagtcccacaca

SEQ ID NO: 4287 - DNA, 201 bp, Homo sapiens
caacctctcatggcaagaatttgagaaagtaaatttatactcaggttctaattttaatagggaaggaagaagttacagctcagtgcaccatgaagttgagrcagagatggagacacctcagccccacctctctggaacaggaaagatgattggggagggagcacaggtcagcgtgggaagagggtcatggtggacatgggg

SEQ ID NO: 4288 - DNA, 201 bp, Homo sapiens
gtccgtgcgctgcagcgtctccttcccgttctccaggtatctgcggagccactccacgcacgtgccctccaggtaggctctcaactgctccgccacacggrccgcctcccacttgcgctgggtgatctgagccgccatgtccgccgcggtccaagagcgcaggtcctcgttcaaggcgatgtaatccttgccgtcgtaggc

SEQ ID NO: 4289 - DNA, 201 bp, Homo sapiens
attttaggaatcttctcctttaattaactcatcaacctctcatggcaagaatttgagaaagtaaatttatactcaggttctaattttaatagggaaggaaraagttacagctcagtgcaccatgaagttgagacagagatggagacacctcagccccacctctctggaacaggaaagatgattggggagggagcacaggtc

SEQ ID NO: 4290 - DNA, 201 bp, Homo sapiens
atgtgttccatttattttgtctctcaaattttaggaatcttctcctttaattaactcatcaacctctcatggcaagaatttgagaaagtaaatttatactmaggttctaattttaatagggaaggaagaagttacagctcagtgcaccatgaagttgagacagagatggagacacctcagccccacctctctggaacagga

SEQ ID NO: 4291 - DNA, 201 bp, Homo sapiens
ggcgtccgtgcgctgcagcgtctccttcccgttctccaggtatctgcggagccactccacgcacgtgccctccaggtaggctctcaactgctccgccacaygggccgcctcccacttgcgctgggtgatctgagccgccatgtccgccgcggtccaagagcgcaggtcctcgttcaaggcgatgtaatccttgccgtcgta

SEQ ID NO: 4292 - DNA, 195 bp, Homo sapiens
gttctcatgtgttccatttattttgtctctcaaattttaggaatcttctcctttaattaactcatcaacctctcatggcaagaatttgagaaagkaaatttatactcaggttctaattttaatagggaaggaagaagttacagctcagtgcaccatgaagttgagacagagatggagacacctcagccccacctc

SEQ ID NO: 4293 - DNA, 201 bp, Homo sapiens
ggggcgtccgtgcgctgcagcgtctccttcccgttctccaggtatctgcggagccactccacgcacgtgccctccaggtaggctctcaactgctccgccasacgggccgcctcccacttgcgctgggtgatctgagccgccatgtccgccgcggtccaagagcgcaggtcctcgttcaaggcgatgtaatccttgccgtcg

SEQ ID NO: 4294 - DNA, 201 bp, Homo sapiens
gggggcgtccgtgcgctgcagcgtctccttcccgttctccaggtatctgcggagccactccacgcacgtgccctccaggtaggctctcaactgctccgccdcacgggccgcctcccacttgcgctgggtgatctgagccgccatgtccgccgcggtccaagagcgcaggtcctcgttcaaggcgatgtaatccttgccgtc

SEQ ID NO: 4295 - DNA, 201 bp, Homo sapiens
gtgagtcatatgcgttttgggggcgtccgtgcgctgcagcgtctccttcccgttctccaggtatctgcggagccactccacgcacgtgccctccaggtagrctctcaactgctccgccacacgggccgcctcccacttgcgctgggtgatctgagccgccatgtccgccgcggtccaagagcgcaggtcctcgttcaaggc

SEQ ID NO: 4296 - DNA, 119 bp, Homo sapiens
gttctcatgtgttccattwattttgtctctcaaattttaggaatcttctcctttaattaactcatcaacctctcatggcaagaatttgagaaagtaaatttatactcaggttctaattt

SEQ ID NO: 4297 - DNA, 201 bp, Homo sapiens
agacagcgtggtgagtcatatgcgttttgggggcgtccgtgcgctgcagcgtctccttcccgttctccaggtatctgcggagccactccacgcacgtgccmtccaggtaggctctcaactgctccgccacacgggccgcctcccacttgcgctgggtgatctgagccgccatgtccgccgcggtccaagagcgcaggtcct

SEQ ID NO: 4298 - DNA, 111 bp, Homo sapiens
gttctcatgtsttccatttattttgtctctcaaattttaggaatcttctcctttaattaactcatcaacctctcatggcaagaatttgagaaagtaaatttatactcaggt

SEQ ID NO: 4299 - DNA, 201 bp, Homo sapiens
cctccacctcacagcagcgaccacagctccagtgatcacagctccaaagagaaccaggccagcaatgatgcccacgatggggatggtgggctgggaagacrgctcccatctcagggtgaggggcttgggcaaaccctcatgctgcacatggcaggtgtatctctgctcctgtccagaaggcaccaccacagccgcccactt

SEQ ID NO: 4300 - DNA, 201 bp, Homo sapiens
gtaggcgtcctgccggtacccgcggaggaagcgcccgtccgaccccacgtcgcagccatacatcatctggatgggtgttagaccctggccccgcccccgckgtcagccccgcccaccgagccccgcccccgccccgaccaacccgcggggattttggctgaaaatgaaaccgggtaaaggcgcctgggcctctcccaggtc

SEQ ID NO: 4301 - DNA, 201 bp, Homo sapiens
gggagcaaggagggggctgagactctcccgaccctcctcccggcaccgcaaccgggttcctgcgcccccgccgggcaggcccctagctactccccacagasgccgtttccctcccgaccccgcactcacctgcccaggtctgggtcaggaccagggcccccgagagcagcagaagcagggttcggggcgccatgacaccat

SEQ ID NO: 4302 - DNA, 201 bp, Homo sapiens
ccacggagaggaagcggggatccgcgcggccgggccgggacatggtggtgtggaaatacctcaaggagtggaagcctgggagcaaggagggggctgagacbctcccgaccctcctcccggcaccgcaaccgggttcctgcgcccccgccgggcaggcccctagctactccccacagaggccgtttccctcccgaccccgca

SEQ ID NO: 4303 - DNA, 201 bp, Homo sapiens
acatgggggtggggtggtctccccacctcctcacattatgcctacacgaacacagacacatgcaggtgcctttgcagaaacaaagtcagggttcttcaagycacaaagggaagggcaggaacaactcttgcctctcagtcccacacaaggcagctgtctcacactttacaagctgtgagagacacatcagagccctgggca

SEQ ID NO: 4304 - DNA, 201 bp, Homo sapiens
taaatctggaaaagttgtgcctgagtgcatgagatagaatagagaccagtttgctttttgtttattaactacagtgggtagcagaatcttggtaactcctratgatcaggaatctaatcggccaaaaatgtgactttggtcccttgacatataaatgtgtctaaaagcattacaacaggaatcacaaagctcctaagtttc

SEQ ID NO: 4305 - DNA, 201 bp, Homo sapiens
cttgcagcctgagtcctcctccacctcacagcagcgaccacagctccagtgatcacagctccaaagagaaccaggccagcaatgatgcccacgatggggayggtgggctgggaagacggctcccatctcagggtgaggggcttgggcaaaccctcatgctgcacatggcaggtgtatctctgctcctgtccagaaggcacc

SEQ ID NO: 4306 - DNA, 201 bp, Homo sapiens
acacatcagagccctgggcactgtcactgcttgcagcctgagtcctcctccacctcacagcagcgaccacagctccagtgatcacagctccaaagagaacyaggccagcaatgatgcccacgatggggatggtgggctgggaagacggctcccatctcagggtgaggggcttgggcaaaccctcatgctgcacatggcagg

SEQ ID NO: 4307 - DNA, 201 bp, Homo sapiens
ttacaagctgtgagagacacatcagagccctgggcactgtcactgcttgcagcctgagtcctcctccacctcacagcagcgaccacagctccagtgatcayagctccaaagagaaccaggccagcaatgatgcccacgatggggatggtgggctgggaagacggctcccatctcagggtgaggggcttgggcaaaccctca

SEQ ID NO: 4308 - DNA, 201 bp, Homo sapiens
cacactttacaagctgtgagagacacatcagagccctgggcactgtcactgcttgcagcctgagtcctcctccacctcacagcagcgaccacagctccagygatcacagctccaaagagaaccaggccagcaatgatgcccacgatggggatggtgggctgggaagacggctcccatctcagggtgaggggcttgggcaaa

SEQ ID NO: 4309 - DNA, 201 bp, Homo sapiens
catggtggacatgggggtggggtggtctccccacctcctcacattatgcctacacgaacacagacacatgcaggtgcctttgcagaaacaaagtcagggtwcttcaagtcacaaagggaagggcaggaacaactcttgcctctcagtcccacacaaggcagctgtctcacactttacaagctgtgagagacacatcagagc

SEQ ID NO: 4310 - DNA, 201 bp, Homo sapiens
gagacacctcagccccacctctctggaacaggaaagatgattggggagggagcacaggtcagcgtgggaagagggtcatggtggacatgggggtggggtgstctccccacctcctcacattatgcctacacgaacacagacacatgcaggtgcctttgcagaaacaaagtcagggttcttcaagtcacaaagggaagggca

SEQ ID NO: 4311 - DNA, 110 bp, Homo sapiens
gttctcatgygttccatttattttgtctctcaaattttaggaatcttctcctttaattaactcatcaacctctcatggcaagaatttgagaaagtaaatttatactcagg

SEQ ID NO: 4312 - DNA, 201 bp, Homo sapiens
cctgggtctggtcctccccatcccgctgccaggtcagtgtgatctccgcagggtagaagctcagggcccagcacctcagggtggcttcatggtcagagacrgcgtggtgagtcatatgcgttttgggggcgtccgtgcgctgcagcgtctccttcccgttctccaggtatctgcggagccactccacgcacgtgccctcca

SEQ ID NO: 4313 - DNA, 201 bp, Homo sapiens
tggttgtagtagctgtctcctcttcccaatactccggcccctcctgctccacccacggcgcccgcggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtgga

SEQ ID NO: 4314 - DNA, 201 bp, Homo sapiens
caggtcctcgttcaaggcgatgtaatccttgccgtcgtaggcgtcctgccggtacccgcggaggaagcgcccgtccgaccccacgtcgcagccatacatcmtctggatgggtgttagaccctggccccgcccccgctgtcagccccgcccaccgagccccgcccccgccccgaccaacccgcggggattttggctgaaaat

SEQ ID NO: 4315 - DNA, 201 bp, Homo sapiens
atgtccgccgcggtccaagagcgcaggtcctcgttcaaggcgatgtaatccttgccgtcgtaggcgtcctgccggtacccgcggaggaagcgcccgtccgrccccacgtcgcagccatacatcatctggatgggtgttagaccctggccccgcccccgctgtcagccccgcccaccgagccccgcccccgccccgaccaac

SEQ ID NO: 4316 - DNA, 201 bp, Homo sapiens
catcccgctgccaggtcagtgtgatctccgcagggtagaagctcagggcccagcacctcagggtggcttcatggtcagagacagcgtggtgagtcatatgygttttgggggcgtccgtgcgctgcagcgtctccttcccgttctccaggtatctgcggagccactccacgcacgtgccctccaggtaggctctcaactgct

SEQ ID NO: 4317 - DNA, 201 bp, Homo sapiens
ggtcctccccatcccgctgccaggtcagtgtgatctccgcagggtagaagctcagggcccagcacctcagggtggcttcatggtcagagacagcgtggtgrgtcatatgcgttttgggggcgtccgtgcgctgcagcgtctccttcccgttctccaggtatctgcggagccactccacgcacgtgccctccaggtaggctc

SEQ ID NO: 4318 - DNA, 201 bp, Homo sapiens
tcctgggtctggtcctccccatcccgctgccaggtcagtgtgatctccgcagggtagaagctcagggcccagcacctcagggtggcttcatggtcagagayagcgtggtgagtcatatgcgttttgggggcgtccgtgcgctgcagcgtctccttcccgttctccaggtatctgcggagccactccacgcacgtgccctcc

SEQ ID NO: 4319 - DNA, 201 bp, Homo sapiens
taccttcattccatagccctgagtttctgtgtgagtccaggacatctcctaatacaaggtagccactgtgttactatatgttgtaaccaggagccagtacrgactttattcatctcacagtggcaagcactcaatgcagtcacaatgcccctcaccagtgctcatgcactgcctgtttttaggaagtatccacttctaagt

SEQ ID NO: 4320 - DNA, 201 bp, Homo sapiens
atagccctgagtttctgtgtgagtccaggacatctcctaatacaaggtagccactgtgttactatatgttgtaaccaggagccagtacggactttattcahctcacagtggcaagcactcaatgcagtcacaatgcccctcaccagtgctcatgcactgcctgtttttaggaagtatccacttctaagtgttgtgtatatt

SEQ ID NO: 4321 - DNA, 201 bp, Homo sapiens
cccgctgccaggtcagtgtgatctccgcagggtagaagctcagggcccagcacctcagggtggcttcatggtcagagacagcgtggtgagtcatatgcgtyttgggggcgtccgtgcgctgcagcgtctccttcccgttctccaggtatctgcggagccactccacgcacgtgccctccaggtaggctctcaactgctccg

SEQ ID NO: 4322 - DNA, 201 bp, Homo sapiens
ccacgagctccgtgtcctgggtctggtcctccccatcccgctgccaggtcagtgtgatctccgcagggtagaagctcagggcccagcacctcagggtggcytcatggtcagagacagcgtggtgagtcatatgcgttttgggggcgtccgtgcgctgcagcgtctccttcccgttctccaggtatctgcggagccactcca

SEQ ID NO: 4323 - DNA, 201 bp, Homo sapiens
ctccgtgggggatggggaggggtcgtgacctgcgccccgggccggggtcactcaccgccctcgctctggttgtagtagctgtctcctcttcccaatactcyggcccctcctgctccacccacggcgcccgcggctccatcctgggactcgtggcgtcgctgtcgagccgcacgcactgcgtgtcgtccacgtcgcccacgg

SEQ ID NO: 4324 - DNA, 201 bp, Homo sapiens
tggtctccacgagctccgtgtcctgggtctggtcctccccatcccgctgccaggtcagtgtgatctccgcagggtagaagctcagggcccagcacctcagrgtggcttcatggtcagagacagcgtggtgagtcatatgcgttttgggggcgtccgtgcgctgcagcgtctccttcccgttctccaggtatctgcggagcc

SEQ ID NO: 4325 - DNA, 201 bp, Homo sapiens
acatggtggtgtggaaatacctcaaggagtggaagcctgggagcaaggagggggctgagactctcccgaccctcctcccggcaccgcaaccgggttcctgmgcccccgccgggcaggcccctagctactccccacagaggccgtttccctcccgaccccgcactcacctgcccaggtctgggtcaggaccagggcccccga

SEQ ID NO: 4326 - DNA, 201 bp, Homo sapiens
gggccgcctcccacttgcgctgggtgatctgagccgccatgtccgccgcggtccaagagcgcaggtcctcgttcaaggcgatgtaatccttgccgtcgtargcgtcctgccggtacccgcggaggaagcgcccgtccgaccccacgtcgcagccatacatcatctggatgggtgttagaccctggccccgcccccgctgtc

SEQ ID NO: 4327 - DNA, 201 bp, Homo sapiens
gagatggagacacctcagccccacctctctggaacaggaaagatgattggggagggagcacaggtcagcgtgggaagagggtcatggtggacatgggggtkgggtggtctccccacctcctcacattatgcctacacgaacacagacacatgcaggtgcctttgcagaaacaaagtcagggttcttcaagtcacaaaggga

SEQ ID NO: 4328 - DNA, 201 bp, Homo sapiens
ttaatagggaaggaagaagttacagctcagtgcaccatgaagttgagacagagatggagacacctcagccccacctctctggaacaggaaagatgattggrgagggagcacaggtcagcgtgggaagagggtcatggtggacatgggggtggggtggtctccccacctcctcacattatgcctacacgaacacagacacat

SEQ ID NO: 4329 - DNA, 201 bp, Homo sapiens
gcaggtcctcgttcaaggcgatgtaatccttgccgtcgtaggcgtcctgccggtacccgcggaggaagcgcccgtccgaccccacgtcgcagccatacatyatctggatgggtgttagaccctggccccgcccccgctgtcagccccgcccaccgagccccgcccccgccccgaccaacccgcggggattttggctgaaaa

SEQ ID NO: 4330 - DNA, 201 bp, Homo sapiens
ttatactcaggttctaattttaatagggaaggaagaagttacagctcagtgcaccatgaagttgagacagagatggagacacctcagccccacctctctgsaacaggaaagatgattggggagggagcacaggtcagcgtgggaagagggtcatggtggacatgggggtggggtggtctccccacctcctcacattatgcc

SEQ ID NO: 4331 - DNA, 201 bp, Homo sapiens
agagcgcaggtcctcgttcaaggcgatgtaatccttgccgtcgtaggcgtcctgccggtacccgcggaggaagcgcccgtccgaccccacgtcgcagccawacatcatctggatgggtgttagaccctggccccgcccccgctgtcagccccgcccaccgagccccgcccccgccccgaccaacccgcggggattttggct

SEQ ID NO: 4332 - DNA, 201 bp, Homo sapiens
tgggtctggtcctccccatcccgctgccaggtcagtgtgatctccgcagggtagaagctcagggcccagcacctcagggtggcttcatggtcagagacagsgtggtgagtcatatgcgttttgggggcgtccgtgcgctgcagcgtctccttcccgttctccaggtatctgcggagccactccacgcacgtgccctccagg

SEQ ID NO: 4333 - DNA, 201 bp, Homo sapiens
ccaggtaggctctcaactgctccgccacacgggccgcctcccacttgcgctgggtgatctgagccgccatgtccgccgcggtccaagagcgcaggtcctckttcaaggcgatgtaatccttgccgtcgtaggcgtcctgccggtacccgcggaggaagcgcccgtccgaccccacgtcgcagccatacatcatctggatgg

SEQ ID NO: 4334 - DNA, 201 bp, Homo sapiens
gtgatcacagctccaaagagaaccaggccagcaatgatgcccacgatggggatggtgggctgggaagacggctcccatctcagggtgaggggcttgggcaraccctcatgctgcacatggcaggtgtatctctgctcctgtccagaaggcaccaccacagccgcccacttctggaaggttccatcccctgcaggcctggtc

SEQ ID NO: 4335 - DNA, 201 bp, Homo sapiens
caggcctggtctccacgagctccgtgtcctgggtctggtcctccccatcccgctgccaggtcagtgtgatctccgcagggtagaagctcagggcccagcayctcagggtggcttcatggtcagagacagcgtggtgagtcatatgcgttttgggggcgtccgtgcgctgcagcgtctccttcccgttctccaggtatctgc

SEQ ID NO: 4336 - DNA, 201 bp, Homo sapiens
ccccgctacttctgtgccaagcgctctgtctcaacgtttccgagtcttggcccaggagctgtctgagaaaccagggagaaaccctcgaaatgggccccgtbcctctctcttcactttgcatcacggaatccccgtcccagaactggactccctgcctcctactccttacctgtccccgtggactcttctagaagaaaaatc

SEQ ID NO: 4337 - DNA, 201 bp, Homo sapiens
gttccatcccctgcaggcctggtctccacgagctccgtgtcctgggtctggtcctccccatcccgctgccaggtcagtgtgatctccgcagggtagaagcycagggcccagcacctcagggtggcttcatggtcagagacagcgtggtgagtcatatgcgttttgggggcgtccgtgcgctgcagcgtctccttcccgttc

SEQ ID NO: 4338 - DNA, 201 bp, Homo sapiens
caggaatctaatcggccaaaaatgtgactttggtcccttgacatataaatgtgtctaaaagcattacaacaggaatcacaaagctcctaagtttcactttyccagacaatgtatctgtgactcccgcttgtagtattttaaatttaccttcattccatagccctgagtttctgtgtgagtccaggacatctcctaatacaa

SEQ ID NO: 4339 - DNA, 201 bp, Homo sapiens
gacttcgccctgaccccgctacttctgtgccaagcgctctgtctcaacgtttccgagtcttggcccaggagctgtctgagaaaccagggagaaaccctcgraatgggccccgttcctctctcttcactttgcatcacggaatccccgtcccagaactggactccctgcctcctactccttacctgtccccgtggactcttc

SEQ ID NO: 4340 - DNA, 201 bp, Homo sapiens
ccatacaccgcctttggggcctgagatcctgagagccatgcctgaggccctgggacttcgccctgaccccgctacttctgtgccaagcgctctgtctcaamgtttccgagtcttggcccaggagctgtctgagaaaccagggagaaaccctcgaaatgggccccgttcctctctcttcactttgcatcacggaatccccgt

SEQ ID NO: 4341 - DNA, 201 bp, Homo sapiens
catgctgcacatggcaggtgtatctctgctcctgtccagaaggcaccaccacagccgcccacttctggaaggttccatcccctgcaggcctggtctccacragctccgtgtcctgggtctggtcctccccatcccgctgccaggtcagtgtgatctccgcagggtagaagctcagggcccagcacctcagggtggcttcat

SEQ ID NO: 4342 - DNA, 201 bp, Homo sapiens
tgggagagggagaagagaaaccctgcggagatggggaatccccagcgctgggcctccccaatccatacaccgcctttggggcctgagatcctgagagccakgcctgaggccctgggacttcgccctgaccccgctacttctgtgccaagcgctctgtctcaacgtttccgagtcttggcccaggagctgtctgagaaacca

SEQ ID NO: 4343 - DNA, 201 bp, Homo sapiens
tcagggtgaggggcttgggcaaaccctcatgctgcacatggcaggtgtatctctgctcctgtccagaaggcaccaccacagccgcccacttctggaaggtyccatcccctgcaggcctggtctccacgagctccgtgtcctgggtctggtcctccccatcccgctgccaggtcagtgtgatctccgcagggtagaagctca

SEQ ID NO: 4344 - DNA, 201 bp, Homo sapiens
cccacttgcgctgggtgatctgagccgccatgtccgccgcggtccaagagcgcaggtcctcgttcaaggcgatgtaatccttgccgtcgtaggcgtcctgscggtacccgcggaggaagcgcccgtccgaccccacgtcgcagccatacatcatctggatgggtgttagaccctggccccgcccccgctgtcagccccgcc

SEQ ID NO: 4345 - DNA, 201 bp, Homo sapiens
caatgggagtgagaactggggcagcctggtgagtatccaggaagaaggacccgacacaggttgggagagggagaagagaaaccctgcggagatggggaatscccagcgctgggcctccccaatccatacaccgcctttggggcctgagatcctgagagccatgcctgaggccctgggacttcgccctgaccccgctacttc

SEQ ID NO: 4346 - DNA, 201 bp, Homo sapiens
ggaagacggctcccatctcagggtgaggggcttgggcaaaccctcatgctgcacatggcaggtgtatctctgctcctgtccagaaggcaccaccacagccrcccacttctggaaggttccatcccctgcaggcctggtctccacgagctccgtgtcctgggtctggtcctccccatcccgctgccaggtcagtgtgatctc

SEQ ID NO: 4347 - DNA, 201 bp, Homo sapiens
gaacccgacactcaatgggagtgagaactggggcagcctggtgagtatccaggaagaaggacccgacacaggttgggagagggagaagagaaaccctgcgragatggggaatccccagcgctgggcctccccaatccatacaccgcctttggggcctgagatcctgagagccatgcctgaggccctgggacttcgccctga

SEQ ID NO: 4348 - DNA, 201 bp, Homo sapiens
tgggaagacggctcccatctcagggtgaggggcttgggcaaaccctcatgctgcacatggcaggtgtatctctgctcctgtccagaaggcaccaccacagmcgcccacttctggaaggttccatcccctgcaggcctggtctccacgagctccgtgtcctgggtctggtcctccccatcccgctgccaggtcagtgtgatc

SEQ ID NO: 4349 - DNA, 201 bp, Homo sapiens
gcctgagtgcatgagatagaatagagaccagtttgctttttgtttattaactacagtgggtagcagaatcttggtaactcctaatgatcaggaatctaatbggccaaaaatgtgactttggtcccttgacatataaatgtgtctaaaagcattacaacaggaatcacaaagctcctaagtttcactttcccagacaatgta

SEQ ID NO: 4350 - DNA, 201 bp, Homo sapiens
ccgtggactcttctagaagaaaaatcactccagggagcttgttgccagagagtgagcttgccctgggaatggaggtgtagagacagggttttttgttgttrttgtttgtttgttttttaaatctggaaaagttgtgcctgagtgcatgagatagaatagagaccagtttgctttttgtttattaactacagtgggtagcag

SEQ ID NO: 4351 - DNA, 201 bp, Homo sapiens
ggaacccgacactcaatgggagtgagaactggggcagcctggtgagtatccaggaagaaggacccgacacaggttgggagagggagaagagaaaccctgcrgagatggggaatccccagcgctgggcctccccaatccatacaccgcctttggggcctgagatcctgagagccatgcctgaggccctgggacttcgccctg

SEQ ID NO: 4352 - DNA, 201 bp, Homo sapiens
ggatggtgggctgggaagacggctcccatctcagggtgaggggcttgggcaaaccctcatgctgcacatggcaggtgtatctctgctcctgtccagaaggyaccaccacagccgcccacttctggaaggttccatcccctgcaggcctggtctccacgagctccgtgtcctgggtctggtcctccccatcccgctgccagg

SEQ ID NO: 4353 - DNA, 201 bp, Homo sapiens
gcctcccacttgcgctgggtgatctgagccgccatgtccgccgcggtccaagagcgcaggtcctcgttcaaggcgatgtaatccttgccgtcgtaggcgtmctgccggtacccgcggaggaagcgcccgtccgaccccacgtcgcagccatacatcatctggatgggtgttagaccctggccccgcccccgctgtcagccc

SEQ ID NO: 4354 - DNA, 201 bp, Homo sapiens
gtcagggttcttcaagtcacaaagggaagggcaggaacaactcttgcctctcagtcccacacaaggcagctgtctcacactttacaagctgtgagagacayatcagagccctgggcactgtcactgcttgcagcctgagtcctcctccacctcacagcagcgaccacagctccagtgatcacagctccaaagagaaccagg

SEQ ID NO: 4355 - DNA, 201 bp, Homo sapiens; identical to SEQ ID NO: 4264

SEQ ID NO: 4356 - DNA, 201 bp, Homo sapiens; identical to SEQ ID NO: 4265

SEQ ID NO: 4357 - DNA, 201 bp, Homo sapiens; identical to SEQ ID NO: 4266

SEQ ID NO: 4358 - DNA, 201 bp, Homo sapiens; identical to SEQ ID NO: 4268

SEQ ID NO: 4359 - DNA, 201 bp, Homo sapiens; identical to SEQ ID NO: 4269

SEQ ID NO: 4360 - DNA, 201 bp, Homo sapiens; identical to SEQ ID NO: 4313

SEQ ID NO: 4361 - DNA, 201 bp, Homo sapiens; identical to SEQ ID NO: 4270

SEQ ID NO: 4362 - DNA, 201 bp, Homo sapiens; identical to SEQ ID NO: 4315

SEQ ID NO: 4363 - DNA, 201 bp, Homo sapiens; identical to SEQ ID NO: 4271

SEQ ID NO: 4364 - DNA, 201 bp, Homo sapiens; identical to SEQ ID NO: 4314

SEQ ID NO: 4365 - DNA, 201 bp, Homo sapiens; identical to SEQ ID NO: 4272

SEQ ID NO: 4366 - DNA, 201 bp, Homo sapiens; identical to SEQ ID NO: 4273

SEQ ID NO: 4367 - DNA, 201 bp, Homo sapiens; identical to SEQ ID NO: 4274

SEQ ID NO: 4368 - DNA, 201 bp, Homo sapiens; identical to SEQ ID NO: 4275

SEQ ID NO: 4369 - DNA, 201 bp, Homo sapiens; identical to SEQ ID NO: 4276

SEQ ID NO: 4370 - DNA, 201 bp, Homo sapiens; identical to SEQ ID NO: 4277

SEQ ID NO: 4371 - DNA, 201 bp, Homo sapiens; identical to SEQ ID NO: 4278

SEQ ID NO: 4372 - DNA, 201 bp, Homo sapiens; identical to SEQ ID NO: 4279

SEQ ID NO: 4373 - DNA, 201 bp, Homo sapiens; identical to SEQ ID NO: 4280

SEQ ID NO: 4374 - DNA, 201 bp, Homo sapiens; identical to SEQ ID NO: 4319

SEQ ID NO: 4375 - DNA, 201 bp, Homo sapiens; identical to SEQ ID NO: 4320

SEQ ID NO: 4376 - DNA, 201 bp, Homo sapiens; identical to SEQ ID NO: 4323

SEQ ID NO: 4377 - DNA, 201 bp, Homo sapiens; identical to SEQ ID NO: 4325

SEQ ID NO: 4378 - DNA, 201 bp, Homo sapiens; identical to SEQ ID NO: 4283

SEQ ID NO: 4379 - DNA, 201 bp, Homo sapiens; identical to SEQ ID NO: 4326

SEQ ID NO: 4380 - DNA, 201 bp, Homo sapiens; identical to SEQ ID NO: 4329

SEQ ID NO: 4381 - DNA, 201 bp, Homo sapiens; identical to SEQ ID NO: 4331

SEQ ID NO: 4382 - DNA, 199 bp, Homo sapiens
ccgtgcgctgcagcgtctccttcccgttctccaggtatctgcggagccactccacgcacgtgccctccaggtaggctctcaactgctccgccacacggrccgcctcccacttgcgctgggtgatctgagccgccatgtccgccgcggtccaagagcgcaggtcctcgttcaaggcgatgtaatccttgccgtcgtaggc

SEQ ID NO: 4383 - DNA, 196 bp, Homo sapiens
ccgtgcgctgcagcgtctccttcccgttctccaggtatctgcggagccactccacgcacgtgccctccaggtaggctctcaactgctccgccacaygggccgcctcccacttgcgctgggtgatctgagccgccatgtccgccgcggtccaagagcgcaggtcctcgttcaaggcgatgtaatccttgccgtcgta

SEQ ID NO: 4384 - DNA, 201 bp, Homo sapiens; identical to SEQ ID NO: 4333

SEQ ID NO: 4385 - DNA, 194 bp, Homo sapiens
ccgtgcgctgcagcgtctccttcccgttctccaggtatctgcggagccactccacgcacgtgccctccaggtaggctctcaactgctccgccasacgggccgcctcccacttgcgctgggtgatctgagccgccatgtccgccgcggtccaagagcgcaggtcctcgttcaaggcgatgtaatccttgccgtcg

SEQ ID NO: 4386 - DNA, 193 bp, Homo sapiens
ccgtgcgctgcagcgtctccttcccgttctccaggtatctgcggagccactccacgcacgtgccctccaggtaggctctcaactgctccgccdcacgggccgcctcccacttgcgctgggtgatctgagccgccatgtccgccgcggtccaagagcgcaggtcctcgttcaaggcgatgtaatccttgccgtc

SEQ ID NO: 4387 - DNA, 175 bp, Homo sapiens
ccgtgcgctgcagcgtctccttcccgttctccaggtatctgcggagccactccacgcacgtgccctccaggtagrctctcaactgctccgccacacgggccgcctcccacttgcgctgggtgatctgagccgccatgtccgccgcggtccaagagcgcaggtcctcgttcaaggc

SEQ ID NO: 4388 - DNA, 201 bp, Homo sapiens; identical to SEQ ID NO: 4338

SEQ ID NO: 4389 - DNA, 201 bp, Homo sapiens; identical to SEQ ID NO: 4336

SEQ ID NO: 4390 - DNA, 165 bp, Homo sapiens
ccgtgcgctgcagcgtctccttcccgttctccaggtatctgcggagccactccacgcacgtgccmtccaggtaggctctcaactgctccgccacacgggccgcctcccacttgcgctgggtgatctgagccgccatgtccgccgcggtccaagagcgcaggtcct

SEQ ID NO: 4391 - DNA, 201 bp, Homo sapiens; identical to SEQ ID NO: 4339

SEQ ID NO: 4392 - DNA, 201 bp, Homo sapiens; identical to SEQ ID NO: 4340

SEQ ID NO: 4393 - DNA, 201 bp, Homo sapiens; identical to SEQ ID NO: 4344

SEQ ID NO: 4394 - DNA, 201 bp, Homo sapiens; identical to SEQ ID NO: 4342

SEQ ID NO: 4395 - DNA, 201 bp, Homo sapiens; identical to SEQ ID NO: 4345

SEQ ID NO: 4396 - DNA, 201 bp, Homo sapiens; identical to SEQ ID NO: 4347

SEQ ID NO: 4397 - DNA, 201 bp, Homo sapiens; identical to SEQ ID NO: 4349

SEQ ID NO: 4398 - DNA, 201 bp, Homo sapiens; identical to SEQ ID NO: 4351

SEQ ID NO: 4399 - DNA, 201 bp, Homo sapiens; identical to SEQ ID NO: 4350

SEQ ID NO: 4400 - DNA, 201 bp, Homo sapiens; identical to SEQ ID NO: 4300

SEQ ID NO: 4401 - DNA, 201 bp, Homo sapiens; identical to SEQ ID NO: 4301

SEQ ID NO: 4402 - DNA, 201 bp, Homo sapiens; identical to SEQ ID NO: 4302

SEQ ID NO: 4403 - DNA, 201 bp, Homo sapiens; identical to SEQ ID NO: 4304

SEQ ID NO: 4404 - DNA, 201 bp, Homo sapiens; identical to SEQ ID NO: 4353

SEQ ID NO: 4405 - DNA, 201 bp, Homo sapiens
tggtcgctgctgtgaggtggaggaggaagagctcagatagaaaaggagggagctactctcaggctgcaagcagtgacagtgcccagggctctgatgtgtcyctcacagcttgtaaagtgtgagacagctgccttgtgtgggactgagaggcaagagttgttcctgcccttccctttgtgacttgaagaaccctgactttgt

SEQ ID NO: 4406 - DNA, 201 bp, Homo sapiens
tgaccgagcgaacctggggaccctgcgcggctactacaaccagagcgaggccggttctcacaccatccagatgatgtatggctgcgacgtggggtcggackggcgcttcctccgcgggtaccggcaggacgcctacgacggcaaggattacatcgccttgaacgaggacctgcgctcttggaccgcggcggacatggcggc

SEQ ID NO: 4407 - DNA, 201 bp, Homo sapiens
agcgaacctggggaccctgcgcggctactacaaccagagcgaggccggttctcacaccatccagatgatgtatggctgcgacgtggggtcggacgggcgcytcctccgcgggtaccggcaggacgcctacgacggcaaggattacatcgccttgaacgaggacctgcgctcttggaccgcggcggacatggcggctcagat

SEQ ID NO: 4408 - DNA, 201 bp, Homo sapiens
gggtttgcccaagcccctcaccctgagatgggagccgtcttcccagcccaccatccccatcgtgggcatcattgctggcctggttctctttggagctgtgwtcactggagctgtggtcgctgctgtgaggtggaggaggaagagctcagatagaaaaggagggagctactctcaggctgcaagcagtgacagtgcccaggg

SEQ ID NO: 4409 - DNA, 201 bp, Homo sapiens
ctgcgcggctactacaaccagagcgaggccggttctcacaccatccagatgatgtatggctgcgacgtggggtcggacgggcgcttcctccgcgggtaccrgcaggacgcctacgacggcaaggattacatcgccttgaacgaggacctgcgctcttggaccgcggcggacatggcggctcagatcacccagcgcaagtgg

SEQ ID NO: 4410 - DNA, 201 bp, Homo sapiens
tcacaccatccagatgatgtatggctgcgacgtggggtcggacgggcgcttcctccgcgggtaccggcaggacgcctacgacggcaaggattacatcgccytgaacgaggacctgcgctcttggaccgcggcggacatggcggctcagatcacccagcgcaagtgggaggcggcccgtgtggcggagcagttgagagccta

SEQ ID NO: 4411 - DNA, 201 bp, Homo sapiens
acgggcgcttcctccgcgggtaccggcaggacgcctacgacggcaaggattacatcgccttgaacgaggacctgcgctcttggaccgcggcggacatggcrgctcagatcacccagcgcaagtgggaggcggcccgtgtggcggagcagttgagagcctacctggagggcacgtgcgtggagtggctccgcagatacctgg

SEQ ID NO: 4412 - DNA, 201 bp, Homo sapiens
cctgcagacacggaatgtgaaggcccagtcacagactgaccgagcgaacctggggaccctgcgcggctactacaaccagagcgaggccggttctcacaccrtccagatgatgtatggctgcgacgtggggtcggacgggcgcttcctccgcgggtaccggcaggacgcctacgacggcaaggattacatcgccttgaacga

SEQ ID NO: 4413 - DNA, 201 bp, Homo sapiens
ttcctccgcgggtaccggcaggacgcctacgacggcaaggattacatcgccttgaacgaggacctgcgctcttggaccgcggcggacatggcggctcagaycacccagcgcaagtgggaggcggcccgtgtggcggagcagttgagagcctacctggagggcacgtgcgtggagtggctccgcagatacctggagaacggg

SEQ ID NO: 4414 - DNA, 201 bp, Homo sapiens
ccgcgggtaccggcaggacgcctacgacggcaaggattacatcgccttgaacgaggacctgcgctcttggaccgcggcggacatggcggctcagatcaccmagcgcaagtgggaggcggcccgtgtggcggagcagttgagagcctacctggagggcacgtgcgtggagtggctccgcagatacctggagaacgggaagga

SEQ ID NO: 4415 - DNA, 201 bp, Homo sapiens
gggtaccggcaggacgcctacgacggcaaggattacatcgccttgaacgaggacctgcgctcttggaccgcggcggacatggcggctcagatcacccagcrcaagtgggaggcggcccgtgtggcggagcagttgagagcctacctggagggcacgtgcgtggagtggctccgcagatacctggagaacgggaaggagacg

SEQ ID NO: 4416 - DNA, 201 bp, Homo sapiens
ggacgcctacgacggcaaggattacatcgccttgaacgaggacctgcgctcttggaccgcggcggacatggcggctcagatcacccagcgcaagtgggagrcggcccgtgtggcggagcagttgagagcctacctggagggcacgtgcgtggagtggctccgcagatacctggagaacgggaaggagacgctgcagcgcac

SEQ ID NO: 4417 - DNA, 201 bp, Homo sapiens
ggatggggaggaccagacccaggacacggagctcgtggagaccaggcctgcaggggatggaaccttccagaagtgggcggctgtggtggtgccttctggavaggagcagagatacacctgccatgtgcagcatgagggtttgcccaagcccctcaccctgagatgggagccgtcttcccagcccaccatccccatcgtggg

SEQ ID NO: 4418 - DNA, 201 bp, Homo sapiens
ggaggaccagacccaggacacggagctcgtggagaccaggcctgcaggggatggaaccttccagaagtgggcggctgtggtggtgccttctggacaggagmagagatacacctgccatgtgcagcatgagggtttgcccaagcccctcaccctgagatgggagccgtcttcccagcccaccatccccatcgtgggcatcat

SEQ ID NO: 4419 - DNA, 201 bp, Homo sapiens
gacgacacgcagttcgtgcggtttgacagcgacgccgcgagccagaggatggagccgcgggcaccgtggatagagcaggaggggccggagtattgggaccrgcagacacggaatgtgaaggcccagtcacagactgaccgagcgaacctggggaccctgcgcggctactacaaccagagcgaggccggttctcacaccatc

SEQ ID NO: 4420 - DNA, 201 bp, Homo sapiens
acacgcagttcgtgcggtttgacagcgacgccgcgagccagaggatggagccgcgggcaccgtggatagagcaggaggggccggagtattgggacctgcasacacggaatgtgaaggcccagtcacagactgaccgagcgaacctggggaccctgcgcggctactacaaccagagcgaggccggttctcacaccatccaga

SEQ ID NO: 4421 - DNA, 201 bp, Homo sapiens
gcagttcgtgcggtttgacagcgacgccgcgagccagaggatggagccgcgggcaccgtggatagagcaggaggggccggagtattgggacctgcagacasggaatgtgaaggcccagtcacagactgaccgagcgaacctggggaccctgcgcggctactacaaccagagcgaggccggttctcacaccatccagatgat

SEQ ID NO: 4422 - DNA, 201 bp, Homo sapiens
tcgtgcggtttgacagcgacgccgcgagccagaggatggagccgcgggcaccgtggatagagcaggaggggccggagtattgggacctgcagacacggaawgtgaaggcccagtcacagactgaccgagcgaacctggggaccctgcgcggctactacaaccagagcgaggccggttctcacaccatccagatgatgtatg

SEQ ID NO: 4423 - DNA, 201 bp, Homo sapiens
cgtgcggtttgacagcgacgccgcgagccagaggatggagccgcgggcaccgtggatagagcaggaggggccggagtattgggacctgcagacacggaatrtgaaggcccagtcacagactgaccgagcgaacctggggaccctgcgcggctactacaaccagagcgaggccggttctcacaccatccagatgatgtatgg

SEQ ID NO: 4424 - DNA, 201 bp, Homo sapiens
ccaccgggactcagattctccccagacgccgaggatggccgtcatggcgccccgaaccctcctcctgctactcttgggggccctggccctgacccagaccwgggcgggctcccactccatgaggtatttcaccacatccgtgtcccggcccggccgcggggagccccgcttcatcgccgtgggctacgtggacgacacgca

SEQ ID NO: 4425 - DNA, 201 bp, Homo sapiens
ctctcaggctgcaagcagtgacagtgcccagggctctgatgtgtctctcacagcttgtaaagtgtgagacagctgccttgtgtgggactgagaggcaagakttgttcctgcccttccctttgtgacttgaagaaccctgactttgtttctgcaaaggcaccttccaccatgaccctcttcccacgctgacctgtgctccct

SEQ ID NO: 4426 - DNA, 201 bp, Homo sapiens
gcctacgacggcaaggattacatcgccttgaacgaggacctgcgctcttggaccgcggcggacatggcggctcagatcacccagcgcaagtgggaggcggyccgtgtggcggagcagttgagagcctacctggagggcacgtgcgtggagtggctccgcagatacctggagaacgggaaggagacgctgcagcgcacggac

SEQ ID NO: 4427 - DNA, 101 bp, Homo sapiens
mgcttggcacagaagcagaggggtcagggcgaagtcccagggccccaggcgtggctctcagggtctcaggccccgaaggcggtgtatggattggggagtcc

SEQ ID NO: 4428 - DNA, 113 bp, Homo sapiens
cgcttggcacagragcagaggggtcagggcgaagtcccagggccccaggcgtggctctcagggtctcaggccccgaaggcggtgtatggattggggagtcccagccttgggga

SEQ ID NO: 4429 - DNA, 201 bp, Homo sapiens
tacgacggcaaggattacatcgccttgaacgaggacctgcgctcttggaccgcggcggacatggcggctcagatcacccagcgcaagtgggaggcggcccrtgtggcggagcagttgagagcctacctggagggcacgtgcgtggagtggctccgcagatacctggagaacgggaaggagacgctgcagcgcacggacgcc

SEQ ID NO: 4430 - DNA, 201 bp, Homo sapiens
cgacggcaaggattacatcgccttgaacgaggacctgcgctcttggaccgcggcggacatggcggctcagatcacccagcgcaagtgggaggcggcccgtstggcggagcagttgagagcctacctggagggcacgtgcgtggagtggctccgcagatacctggagaacgggaaggagacgctgcagcgcacggacgcccc

SEQ ID NO: 4431 - DNA, 201 bp, Homo sapiens
gacggcaaggattacatcgccttgaacgaggacctgcgctcttggaccgcggcggacatggcggctcagatcacccagcgcaagtgggaggcggcccgtghggcggagcagttgagagcctacctggagggcacgtgcgtggagtggctccgcagatacctggagaacgggaaggagacgctgcagcgcacggacgccccc

SEQ ID NO: 4432 - DNA, 201 bp, Homo sapiens
gccttgaacgaggacctgcgctcttggaccgcggcggacatggcggctcagatcacccagcgcaagtgggaggcggcccgtgtggcggagcagttgagagyctacctggagggcacgtgcgtggagtggctccgcagatacctggagaacgggaaggagacgctgcagcgcacggacgcccccaaaacgcatatgactcac

SEQ ID NO: 4433 - DNA, 201 bp, Homo sapiens
aggacctgcgctcttggaccgcggcggacatggcggctcagatcacccagcgcaagtgggaggcggcccgtgtggcggagcagttgagagcctacctggakggcacgtgcgtggagtggctccgcagatacctggagaacgggaaggagacgctgcagcgcacggacgcccccaaaacgcatatgactcaccacgctgtct

SEQ ID NO: 4434 - DNA, 201 bp, Homo sapiens
aagtgggcggctgtggtggtgccttctggacaggagcagagatacacctgccatgtgcagcatgagggtttgcccaagcccctcaccctgagatgggagcygtcttcccagcccaccatccccatcgtgggcatcattgctggcctggttctctttggagctgtgatcactggagctgtggtcgctgctgtgaggtggagg

SEQ ID NO: 4435 - DNA, 201 bp, Homo sapiens
tccgtgtcccggcccggccgcggggagccccgcttcatcgccgtgggctacgtggacgacacgcagttcgtgcggtttgacagcgacgccgcgagccagargatggagccgcgggcaccgtggatagagcaggaggggccggagtattgggacctgcagacacggaatgtgaaggcccagtcacagactgaccgagcgaac

SEQ ID NO: 4436 - DNA, 201 bp, Homo sapiens
tgcggtttgacagcgacgccgcgagccagaggatggagccgcgggcaccgtggatagagcaggaggggccggagtattgggacctgcagacacggaatgtsaaggcccagtcacagactgaccgagcgaacctggggaccctgcgcggctactacaaccagagcgaggccggttctcacaccatccagatgatgtatggct

SEQ ID NO: 4437 - DNA, 201 bp, Homo sapiens
acagcgacgccgcgagccagaggatggagccgcgggcaccgtggatagagcaggaggggccggagtattgggacctgcagacacggaatgtgaaggcccastcacagactgaccgagcgaacctggggaccctgcgcggctactacaaccagagcgaggccggttctcacaccatccagatgatgtatggctgcgacgtgg

SEQ ID NO: 4438 - DNA, 201 bp, Homo sapiens
cagcgacgccgcgagccagaggatggagccgcgggcaccgtggatagagcaggaggggccggagtattgggacctgcagacacggaatgtgaaggcccagkcacagactgaccgagcgaacctggggaccctgcgcggctactacaaccagagcgaggccggttctcacaccatccagatgatgtatggctgcgacgtggg

SEQ ID NO: 4439 - DNA, 201 bp, Homo sapiens
tgcccagggctctgatgtgtctctcacagcttgtaaagtgtgagacagctgccttgtgtgggactgagaggcaagagttgttcctgcccttccctttgtgrcttgaagaaccctgactttgtttctgcaaaggcaccttccaccatgaccctcttcccacgctgacctgtgctccctccccaatcatctttcctgttccag

SEQ ID NO: 4440 - DNA, 201 bp, Homo sapiens
gccgcgagccagaggatggagccgcgggcaccgtggatagagcaggaggggccggagtattgggacctgcagacacggaatgtgaaggcccagtcacagaytgaccgagcgaacctggggaccctgcgcggctactacaaccagagcgaggccggttctcacaccatccagatgatgtatggctgcgacgtggggtcggac

SEQ ID NO: 4441 - DNA, 201 bp, Homo sapiens
cgcgagccagaggatggagccgcgggcaccgtggatagagcaggaggggccggagtattgggacctgcagacacggaatgtgaaggcccagtcacagactsaccgagcgaacctggggaccctgcgcggctactacaaccagagcgaggccggttctcacaccatccagatgatgtatggctgcgacgtggggtcggacgg

SEQ ID NO: 4442 - DNA, 201 bp, Homo sapiens
cagaggatggagccgcgggcaccgtggatagagcaggaggggccggagtattgggacctgcagacacggaatgtgaaggcccagtcacagactgaccgaghgaacctggggaccctgcgcggctactacaaccagagcgaggccggttctcacaccatccagatgatgtatggctgcgacgtggggtcggacgggcgcttc

SEQ ID NO: 4443 - DNA, 201 bp, Homo sapiens
ggtgccttctggacaggagcagagatacacctgccatgtgcagcatgagggtttgcccaagcccctcaccctgagatgggagccgtcttcccagcccaccrtccccatcgtgggcatcattgctggcctggttctctttggagctgtgatcactggagctgtggtcgctgctgtgaggtggaggaggaagagctcagatag

SEQ ID NO: 4444 - DNA, 201 bp, Homo sapiens
cgtcatggcgccccgaaccctcctcctgctactcttgggggccctggccctgacccagacctgggcgggctcccactccatgaggtatttcaccacatccrtgtcccggcccggccgcggggagccccgcttcatcgccgtgggctacgtggacgacacgcagttcgtgcggtttgacagcgacgccgcgagccagaggat

SEQ ID NO: 4445 - DNA, 201 bp, Homo sapiens
cctgccatgtgcagcatgagggtttgcccaagcccctcaccctgagatgggagccgtcttcccagcccaccatccccatcgtgggcatcattgctggcctrgttctctttggagctgtgatcactggagctgtggtcgctgctgtgaggtggaggaggaagagctcagatagaaaaggagggagctactctcaggctgcaa

SEQ ID NO: 4446 - DNA, 201 bp, Homo sapiens
gggactcagattctccccagacgccgaggatggccgtcatggcgccccgaaccctcctcctgctactcttgggggccctggccctgacccagacctgggcrggctcccactccatgaggtatttcaccacatccgtgtcccggcccggccgcggggagccccgcttcatcgccgtgggctacgtggacgacacgcagttcg

SEQ ID NO: 4447 - DNA, 201 bp, Homo sapiens
tgagggtttgcccaagcccctcaccctgagatgggagccgtcttcccagcccaccatccccatcgtgggcatcattgctggcctggttctctttggagctrtgatcactggagctgtggtcgctgctgtgaggtggaggaggaagagctcagatagaaaaggagggagctactctcaggctgcaagcagtgacagtgccca

SEQ ID NO: 4448 - DNA, 201 bp, Homo sapiens
cagattctccccagacgccgaggatggccgtcatggcgccccgaaccctcctcctgctactcttgggggccctggccctgacccagacctgggcgggctcycactccatgaggtatttcaccacatccgtgtcccggcccggccgcggggagccccgcttcatcgccgtgggctacgtggacgacacgcagttcgtgcggt

SEQ ID NO: 4449 - DNA, 201 bp, Homo sapiens
tttgcccaagcccctcaccctgagatgggagccgtcttcccagcccaccatccccatcgtgggcatcattgctggcctggttctctttggagctgtgatcrctggagctgtggtcgctgctgtgaggtggaggaggaagagctcagatagaaaaggagggagctactctcaggctgcaagcagtgacagtgcccagggctc

SEQ ID NO: 4450 - DNA, 201 bp, Homo sapiens
caggcgtggctctcagggtctcaggccccgaaggcggtgtatggattggggagtcccagccttggggattccccaactccgcagtttcttttctccctctsccaacctatgtagggtccttcttcctggatactcacgacgcggacccagttctcactcccattgggtgtcgggtttccagagaagccaatcagtgtcgtc

SEQ ID NO: 4451 - DNA, 195 bp, Homo sapiens
gctctgatgtgtctctcacagcttgtaaagtgtgagacagctgccttgtgtgggactgagaggcaagagttgttcctgcccttccctttgtgacttgaagwaccctgactttgtttctgcaaaggcaccttccaccatgaccctcttcccacgctgacctgtgctccctccccaatcatctttcctgttccagag

SEQ ID NO: 4452 - DNA, 201 bp, Homo sapiens
ttctaaagtccgcacgcacccaccgggactcagattctccccagacgccgaggatggccgtcatggcgccccgaaccctcctcctgctactcttgggggcyctggccctgacccagacctgggcgggctcccactccatgaggtatttcaccacatccgtgtcccggcccggccgcggggagccccgcttcatcgccgtgg

SEQ ID NO: 4453 - DNA, 201 bp, Homo sapiens
ttcttcctggatactcacgacgcggacccagttctcactcccattgggtgtcgggtttccagagaagccaatcagtgtcgtcgcggtcgcggttctaaagyccgcacgcacccaccgggactcagattctccccagacgccgaggatggccgtcatggcgccccgaaccctcctcctgctactcttgggggccctggccct

SEQ ID NO: 4454 - DNA, 201 bp, Homo sapiens
gaggatggccgtcatggcgccccgaaccctcctcctgctactcttgggggccctggccctgacccagacctgggcgggctcccactccatgaggtatttcwccacatccgtgtcccggcccggccgcggggagccccgcttcatcgccgtgggctacgtggacgacacgcagttcgtgcggtttgacagcgacgccgcgag

SEQ ID NO: 4455 - DNA, 201 bp, Homo sapiens
cgggtttccagagaagccaatcagtgtcgtcgcggtcgcggttctaaagtccgcacgcacccaccgggactcagattctccccagacgccgaggatggccrtcatggcgccccgaaccctcctcctgctactcttgggggccctggccctgacccagacctgggcgggctcccactccatgaggtatttcaccacatccgt

SEQ ID NO: 4456 - DNA, 201 bp, Homo sapiens
tccagagaagccaatcagtgtcgtcgcggtcgcggttctaaagtccgcacgcacccaccgggactcagattctccccagacgccgaggatggccgtcatgscgccccgaaccctcctcctgctactcttgggggccctggccctgacccagacctgggcgggctcccactccatgaggtatttcaccacatccgtgtcccg

SEQ ID NO: 4457 - DNA, 201 bp, Homo sapiens
aaccctcctcctgctactcttgggggccctggccctgacccagacctgggcgggctcccactccatgaggtatttcaccacatccgtgtcccggcccggcmgcggggagccccgcttcatcgccgtgggctacgtggacgacacgcagttcgtgcggtttgacagcgacgccgcgagccagaggatggagccgcgggcacc

SEQ ID NO: 4458 - DNA, 201 bp, Homo sapiens
cagagaagccaatcagtgtcgtcgcggtcgcggttctaaagtccgcacgcacccaccgggactcagattctccccagacgccgaggatggccgtcatggckccccgaaccctcctcctgctactcttgggggccctggccctgacccagacctgggcgggctcccactccatgaggtatttcaccacatccgtgtcccggc

SEQ ID NO: 4459 - DNA, 201 bp, Homo sapiens
tggagggcacgtgcgtggagtggctccgcagatacctggagaacgggaaggagacgctgcagcgcacggacgcccccaaaacgcatatgactcaccacgcygtctctgaccatgaagccaccctgaggtgctgggccctgagcttctaccctgcggagatcacactgacctggcagcgggatggggaggaccagacccagg

SEQ ID NO: 4460 - DNA, 201 bp, Homo sapiens
gttctaaagtccgcacgcacccaccgggactcagattctccccagacgccgaggatggccgtcatggcgccccgaaccctcctcctgctactcttgggggycctggccctgacccagacctgggcgggctcccactccatgaggtatttcaccacatccgtgtcccggcccggccgcggggagccccgcttcatcgccgtg

SEQ ID NO: 4461 - DNA, 201 bp, Homo sapiens
acacggaatgtgaaggcccagtcacagactgaccgagcgaacctggggaccctgcgcggctactacaaccagagcgaggccggttctcacaccatccagakgatgtatggctgcgacgtggggtcggacgggcgcttcctccgcgggtaccggcaggacgcctacgacggcaaggattacatcgccttgaacgaggacctg

SEQ ID NO: 4462 - DNA, 201 bp, Homo sapiens
acagactgaccgagcgaacctggggaccctgcgcggctactacaaccagagcgaggccggttctcacaccatccagatgatgtatggctgcgacgtggggycggacgggcgcttcctccgcgggtaccggcaggacgcctacgacggcaaggattacatcgccttgaacgaggacctgcgctcttggaccgcggcggacat

SEQ ID NO: 4463 - DNA, 201 bp, Homo sapiens
agcagttgagagcctacctggagggcacgtgcgtggagtggctccgcagatacctggagaacgggaaggagacgctgcagcgcacggacgcccccaaaacrcatatgactcaccacgctgtctctgaccatgaagccaccctgaggtgctgggccctgagcttctaccctgcggagatcacactgacctggcagcgggatg

SEQ ID NO: 4464 - DNA, 201 bp, Homo sapiens
gagcctacctggagggcacgtgcgtggagtggctccgcagatacctggagaacgggaaggagacgctgcagcgcacggacgcccccaaaacgcatatgacycaccacgctgtctctgaccatgaagccaccctgaggtgctgggccctgagcttctaccctgcggagatcacactgacctggcagcgggatggggaggacc

SEQ ID NO: 4465 - DNA, 201 bp, Homo sapiens
ggagggcacgtgcgtggagtggctccgcagatacctggagaacgggaaggagacgctgcagcgcacggacgcccccaaaacgcatatgactcaccacgctrtctctgaccatgaagccaccctgaggtgctgggccctgagcttctaccctgcggagatcacactgacctggcagcgggatggggaggaccagacccagga

SEQ ID NO: 4466 - DNA, 201 bp, Homo sapiens
cggagcagttgagagcctacctggagggcacgtgcgtggagtggctccgcagatacctggagaacgggaaggagacgctgcagcgcacggacgcccccaaracgcatatgactcaccacgctgtctctgaccatgaagccaccctgaggtgctgggccctgagcttctaccctgcggagatcacactgacctggcagcggg

SEQ ID NO: 4467 - DNA, 201 bp, Homo sapiens
tggagtggctccgcagatacctggagaacgggaaggagacgctgcagcgcacggacgcccccaaaacgcatatgactcaccacgctgtctctgaccatgargccaccctgaggtgctgggccctgagcttctaccctgcggagatcacactgacctggcagcgggatggggaggaccagacccaggacacggagctcgtgg

SEQ ID NO: 4468 - DNA, 201 bp, Homo sapiens
ggctccgcagatacctggagaacgggaaggagacgctgcagcgcacggacgcccccaaaacgcatatgactcaccacgctgtctctgaccatgaagccacyctgaggtgctgggccctgagcttctaccctgcggagatcacactgacctggcagcgggatggggaggaccagacccaggacacggagctcgtggagacca

SEQ ID NO: 4469 - DNA, 201 bp, Homo sapiens
gaggatggagccgcgggcaccgtggatagagcaggaggggccggagtattgggacctgcagacacggaatgtgaaggcccagtcacagactgaccgagcgracctggggaccctgcgcggctactacaaccagagcgaggccggttctcacaccatccagatgatgtatggctgcgacgtggggtcggacgggcgcttcct

SEQ ID NO: 4470 - DNA, 201 bp, Homo sapiens
cagtgtcgtcgcggtcgcggttctaaagtccgcacgcacccaccgggactcagattctccccagacgccgaggatggccgtcatggcgccccgaaccctcstcctgctactcttgggggccctggccctgacccagacctgggcgggctcccactccatgaggtatttcaccacatccgtgtcccggcccggccgcgggga

SEQ ID NO: 4471 - DNA, 201 bp, Homo sapiens
ggagccgcgggcaccgtggatagagcaggaggggccggagtattgggacctgcagacacggaatgtgaaggcccagtcacagactgaccgagcgaacctgsggaccctgcgcggctactacaaccagagcgaggccggttctcacaccatccagatgatgtatggctgcgacgtggggtcggacgggcgcttcctccgcgg

SEQ ID NO: 4472 - DNA, 201 bp, Homo sapiens
ccggagtattgggacctgcagacacggaatgtgaaggcccagtcacagactgaccgagcgaacctggggaccctgcgcggctactacaaccagagcgaggmcggttctcacaccatccagatgatgtatggctgcgacgtggggtcggacgggcgcttcctccgcgggtaccggcaggacgcctacgacggcaaggattac

SEQ ID NO: 4473 - DNA, 201 bp, Homo sapiens
aggatggccgtcatggcgccccgaaccctcctcctgctactcttgggggccctggccctgacccagacctgggcgggctcccactccatgaggtatttcahcacatccgtgtcccggcccggccgcggggagccccgcttcatcgccgtgggctacgtggacgacacgcagttcgtgcggtttgacagcgacgccgcgagc

SEQ ID NO: 4474 - DNA, 201 bp, Homo sapiens
cgacacgcagttcgtgcggtttgacagcgacgccgcgagccagaggatggagccgcgggcaccgtggatagagcaggaggggccggagtattgggacctgvagacacggaatgtgaaggcccagtcacagactgaccgagcgaacctggggaccctgcgcggctactacaaccagagcgaggccggttctcacaccatcca

SEQ ID NO: 4475 - DNA, 201 bp, Homo sapiens
actacaaccagagcgaggccggttctcacaccatccagatgatgtatggctgcgacgtggggtcggacgggcgcttcctccgcgggtaccggcaggacgcytacgacggcaaggattacatcgccttgaacgaggacctgcgctcttggaccgcggcggacatggcggctcagatcacccagcgcaagtgggaggcggccc

SEQ ID NO: 4476 - DNA, 201 bp, Homo sapiens
actccatgaggtatttcaccacatccgtgtcccggcccggccgcggggagccccgcttcatcgccgtgggctacgtggacgacacgcagttcgtgcggttygacagcgacgccgcgagccagaggatggagccgcgggcaccgtggatagagcaggaggggccggagtattgggacctgcagacacggaatgtgaaggccc

SEQ ID NO: 4477 - DNA, 201 bp, Homo sapiens
tggccgtcatggcgccccgaaccctcctcctgctactcttgggggccctggccctgacccagacctgggcgggctcccactccatgaggtatttcaccacmtccgtgtcccggcccggccgcggggagccccgcttcatcgccgtgggctacgtggacgacacgcagttcgtgcggtttgacagcgacgccgcgagccaga

SEQ ID NO: 4478 - DNA, 201 bp, Homo sapiens
cacggaatgtgaaggcccagtcacagactgaccgagcgaacctggggaccctgcgcggctactacaaccagagcgaggccggttctcacaccatccagatratgtatggctgcgacgtggggtcggacgggcgcttcctccgcgggtaccggcaggacgcctacgacggcaaggattacatcgccttgaacgaggacctgc

SEQ ID NO: 4479 - DNA, 125 bp, Homo sapiens
tgttcctgcccttccctttgtgacttgaagaaccctgactttgtttctgcaaaggcaccttccaccatgaccctcttcccacgctgacctgtgctccctcyccaatcatctttcctgttccagag

SEQ ID NO: 4480 - DNA, 201 bp, Homo sapiens
aatgtgaaggcccagtcacagactgaccgagcgaacctggggaccctgcgcggctactacaaccagagcgaggccggttctcacaccatccagatgatgtwtggctgcgacgtggggtcggacgggcgcttcctccgcgggtaccggcaggacgcctacgacggcaaggattacatcgccttgaacgaggacctgcgctct

SEQ ID NO: 4481 - DNA, 162 bp, Homo sapiens
cgcttggcacagaagcagaggggtcagggcgaagtcccagggccccaggcgtggctctcagrgtctcaggccccgaaggcggtgtatggattggggagtcccagccttggggattccccaactccgcagtttcttttctccctctcccaacctatgtagggt

SEQ ID NO: 4482 - DNA, 106 bp, Homo sapiens
gtgacttgaagaaccctgactttgtttctgcaaaggcaccttccaccatgaccctcttcccacgctgacctgtgctccctccccaatcatctttcctgttscagag

SEQ ID NO: 4483 - DNA, 201 bp, Homo sapiens
ccctcctcctgctactcttgggggccctggccctgacccagacctgggcgggctcccactccatgaggtatttcaccacatccgtgtcccggcccggccgyggggagccccgcttcatcgccgtgggctacgtggacgacacgcagttcgtgcggtttgacagcgacgccgcgagccagaggatggagccgcgggcaccgt

SEQ ID NO: 4484 - DNA, 201 bp, Homo sapiens
cctggagggcacgtgcgtggagtggctccgcagatacctggagaacgggaaggagacgctgcagcgcacggacgcccccaaaacgcatatgactcaccacsctgtctctgaccatgaagccaccctgaggtgctgggccctgagcttctaccctgcggagatcacactgacctggcagcgggatggggaggaccagaccca

SEQ ID NO: 4485 - DNA, 201 bp, Homo sapiens
ccatccagatgatgtatggctgcgacgtggggtcggacgggcgcttcctccgcgggtaccggcaggacgcctacgacggcaaggattacatcgccttgaamgaggacctgcgctcttggaccgcggcggacatggcggctcagatcacccagcgcaagtgggaggcggcccgtgtggcggagcagttgagagcctacctgg

SEQ ID NO: 4486 - DNA, 201 bp, Homo sapiens
gacctgggcgggctcccactccatgaggtatttcaccacatccgtgtcccggcccggccgcggggagccccgcttcatcgccgtgggctacgtggacgacwcgcagttcgtgcggtttgacagcgacgccgcgagccagaggatggagccgcgggcaccgtggatagagcaggaggggccggagtattgggacctgcagac

SEQ ID NO: 4487 - DNA, 201 bp, Homo sapiens
gaccaggcctgcaggggatggaaccttccagaagtgggcggctgtggtggtgccttctggacaggagcagagatacacctgccatgtgcagcatgagggtytgcccaagcccctcaccctgagatgggagccgtcttcccagcccaccatccccatcgtgggcatcattgctggcctggttctctttggagctgtgatcac

SEQ ID NO: 4488 - DNA, 201 bp, Homo sapiens
tcccactccatgaggtatttcaccacatccgtgtcccggcccggccgcggggagccccgcttcatcgccgtgggctacgtggacgacacgcagttcgtgcrgtttgacagcgacgccgcgagccagaggatggagccgcgggcaccgtggatagagcaggaggggccggagtattgggacctgcagacacggaatgtgaag

SEQ ID NO: 4489 - DNA, 201 bp, Homo sapiens
gcagatacctggagaacgggaaggagacgctgcagcgcacggacgcccccaaaacgcatatgactcaccacgctgtctctgaccatgaagccaccctgagrtgctgggccctgagcttctaccctgcggagatcacactgacctggcagcgggatggggaggaccagacccaggacacggagctcgtggagaccaggcctg

SEQ ID NO: 4490 - DNA, 201 bp, Homo sapiens
gaacgggaaggagacgctgcagcgcacggacgcccccaaaacgcatatgactcaccacgctgtctctgaccatgaagccaccctgaggtgctgggccctgrgcttctaccctgcggagatcacactgacctggcagcgggatggggaggaccagacccaggacacggagctcgtggagaccaggcctgcaggggatggaac

SEQ ID NO: 4491 - DNA, 201 bp, Homo sapiens
catcgccgtgggctacgtggacgacacgcagttcgtgcggtttgacagcgacgccgcgagccagaggatggagccgcgggcaccgtggatagagcaggagrggccggagtattgggacctgcagacacggaatgtgaaggcccagtcacagactgaccgagcgaacctggggaccctgcgcggctactacaaccagagcga

SEQ ID NO: 4492 - DNA, 201 bp, Homo sapiens
atgaagccaccctgaggtgctgggccctgagcttctaccctgcggagatcacactgacctggcagcgggatggggaggaccagacccaggacacggagctygtggagaccaggcctgcaggggatggaaccttccagaagtgggcggctgtggtggtgccttctggacaggagcagagatacacctgccatgtgcagcatg

SEQ ID NO: 4493 - DNA, 201 bp, Homo sapiens
gggccctggccctgacccagacctgggcgggctcccactccatgaggtatttcaccacatccgtgtcccggcccggccgcggggagccccgcttcatcgcmgtgggctacgtggacgacacgcagttcgtgcggtttgacagcgacgccgcgagccagaggatggagccgcgggcaccgtggatagagcaggaggggccgg

SEQ ID NO: 4494 - DNA, 201 bp, Homo sapiens
tgagcttctaccctgcggagatcacactgacctggcagcgggatggggaggaccagacccaggacacggagctcgtggagaccaggcctgcaggggatggraccttccagaagtgggcggctgtggtggtgccttctggacaggagcagagatacacctgccatgtgcagcatgagggtttgcccaagcccctcaccctga

SEQ ID NO: 4495 - DNA, 201 bp, Homo sapiens
tgcgcggctactacaaccagagcgaggccggttctcacaccatccagatgatgtatggctgcgacgtggggtcggacgggcgcttcctccgcgggtaccgscaggacgcctacgacggcaaggattacatcgccttgaacgaggacctgcgctcttggaccgcggcggacatggcggctcagatcacccagcgcaagtggg

SEQ ID NO: 4496 - DNA, 201 bp, Homo sapiens
gagatcacactgacctggcagcgggatggggaggaccagacccaggacacggagctcgtggagaccaggcctgcaggggatggaaccttccagaagtgggyggctgtggtggtgccttctggacaggagcagagatacacctgccatgtgcagcatgagggtttgcccaagcccctcaccctgagatgggagccgtcttcc

SEQ ID NO: 4497 - DNA, 201 bp, Homo sapiens
gatcacactgacctggcagcgggatggggaggaccagacccaggacacggagctcgtggagaccaggcctgcaggggatggaaccttccagaagtgggcgkctgtggtggtgccttctggacaggagcagagatacacctgccatgtgcagcatgagggtttgcccaagcccctcaccctgagatgggagccgtcttccca

SEQ ID NO: 4498 - DNA, 201 bp, Homo sapiens
atcgccgtgggctacgtggacgacacgcagttcgtgcggtttgacagcgacgccgcgagccagaggatggagccgcgggcaccgtggatagagcaggaggrgccggagtattgggacctgcagacacggaatgtgaaggcccagtcacagactgaccgagcgaacctggggaccctgcgcggctactacaaccagagcgag

SEQ ID NO: 4499 - DNA, 201 bp, Homo sapiens
cctggcagcgggatggggaggaccagacccaggacacggagctcgtggagaccaggcctgcaggggatggaaccttccagaagtgggcggctgtggtggtrccttctggacaggagcagagatacacctgccatgtgcagcatgagggtttgcccaagcccctcaccctgagatgggagccgtcttcccagcccaccatcc

SEQ ID NO: 4500 - DNA, 201 bp, Homo sapiens
tcgccgtgggctacgtggacgacacgcagttcgtgcggtttgacagcgacgccgcgagccagaggatggagccgcgggcaccgtggatagagcaggagggkccggagtattgggacctgcagacacggaatgtgaaggcccagtcacagactgaccgagcgaacctggggaccctgcgcggctactacaaccagagcgagg

SEQ ID NO: 4501 - DNA, 201 bp, Homo sapiens
ccgtgggctacgtggacgacacgcagttcgtgcggtttgacagcgacgccgcgagccagaggatggagccgcgggcaccgtggatagagcaggaggggcckgagtattgggacctgcagacacggaatgtgaaggcccagtcacagactgaccgagcgaacctggggaccctgcgcggctactacaaccagagcgaggccg

SEQ ID NO: 4502 - DNA, 201 bp, Homo sapiens
gtcgcggttctaaagtccgcacgcacccaccgggactcagattctccccagacgccgaggatggccgtcatggcgccccgaaccctcctcctgctactctygggggccctggccctgacccagacctgggcgggctcccactccatgaggtatttcaccacatccgtgtcccggcccggccgcggggagccccgcttcatc

SEQ ID NO: 4503 - DNA, 201 bp, Homo sapiens
ggacgacacgcagttcgtgcggtttgacagcgacgccgcgagccagaggatggagccgcgggcaccgtggatagagcaggaggggccggagtattgggacstgcagacacggaatgtgaaggcccagtcacagactgaccgagcgaacctggggaccctgcgcggctactacaaccagagcgaggccggttctcacaccat

SEQ ID NO: 4504 - DNA, 201 bp, Homo sapiens
cggctactacaaccagagcgaggccggttctcacaccatccagatgatgtatggctgcgacgtggggtcggacgggcgcttcctccgcgggtaccggcagkacgcctacgacggcaaggattacatcgccttgaacgaggacctgcgctcttggaccgcggcggacatggcggctcagatcacccagcgcaagtgggaggc

SEQ ID NO: 4505 - DNA, 201 bp, Homo sapiens
tcctcctgctactcttgggggccctggccctgacccagacctgggcgggctcccactccatgaggtatttcaccacatccgtgtcccggcccggccgcggrgagccccgcttcatcgccgtgggctacgtggacgacacgcagttcgtgcggtttgacagcgacgccgcgagccagaggatggagccgcgggcaccgtgga

SEQ ID NO: 4506 - DNA, 201 bp, Homo sapiens
agctgtggtcgctgctgtgaggtggaggaggaagagctcagatagaaaaggagggagctactctcaggctgcaagcagtgacagtgcccagggctctgatrtgtctctcacagcttgtaaagtgtgagacagctgccttgtgtgggactgagaggcaagagttgttcctgcccttccctttgtgacttgaagaaccctgac

SEQ ID NO: 4507 - DNA, 201 bp, Homo sapiens; identical to SEQ ID NO: 4405

SEQ ID NO: 4508 - DNA, 201 bp, Homo sapiens; identical to SEQ ID NO: 4406

SEQ ID NO: 4509 - DNA, 201 bp, Homo sapiens; identical to SEQ ID NO: 4407

SEQ ID NO: 4510 - DNA, 201 bp, Homo sapiens; identical to SEQ ID NO: 4408

SEQ ID NO: 4511 - DNA, 201 bp, Homo sapiens; identical to SEQ ID NO: 4409

SEQ ID NO: 4512 - DNA, 201 bp, Homo sapiens; identical to SEQ ID NO: 4410

SEQ ID NO: 4513 - DNA, 201 bp, Homo sapiens; identical to SEQ ID NO: 4411

SEQ ID NO: 4514 - DNA, 201 bp, Homo sapiens; identical to SEQ ID NO: 4412

SEQ ID NO: 4515 - DNA, 201 bp, Homo sapiens; identical to SEQ ID NO: 4413

SEQ ID NO: 4516 - DNA, 201 bp, Homo sapiens; identical to SEQ ID NO: 4414

SEQ ID NO: 4517 - DNA, 201 bp, Homo sapiens; identical to SEQ ID NO: 4415

SEQ ID NO: 4518 - DNA, 201 bp, Homo sapiens; identical to SEQ ID NO: 4416

SEQ ID NO: 4519 - DNA, 201 bp, Homo sapiens; identical to SEQ ID NO: 4417

SEQ ID NO: 4520 - DNA, 201 bp, Homo sapiens; identical to SEQ ID NO: 4418

SEQ ID NO: 4521 - DNA, 201 bp, Homo sapiens; identical to SEQ ID NO: 4419

SEQ ID NO: 4522 - DNA, 201 bp, Homo sapiens; identical to SEQ ID NO: 4420

SEQ ID NO: 4523 - DNA, 201 bp, Homo sapiens; identical to SEQ ID NO: 4421

SEQ ID NO: 4524 - DNA, 201 bp, Homo sapiens; identical to SEQ ID NO: 4422

SEQ ID NO: 4525 - DNA, 201 bp, Homo sapiens; identical to SEQ ID NO: 4423

SEQ ID NO: 4526 - DNA, 201 bp, Homo sapiens; identical to SEQ ID NO: 4424

SEQ ID NO: 4527 - DNA, 201 bp, Homo sapiens
tgtgacttgaagaaccctgactttgtttctgcaaaggcacctgcatgtgtctgtgttcgtgtaggcataatgtgaggaggtggggagaccaccccaccccsatgtccaccatgaccctcttcccacgctgacctgtgctccctccccaatcatctttcctgttccagagaggtggggctgaggtgtctccatctctgtctc

SEQ ID NO: 4528 - DNA, 201 bp, Homo sapiens
ctctcaggctgcaagcagtgacagtgcccagggctctgatgtgtctctcacagcttgtaaagtgtgagacagctgccttgtgtgggactgagaggcaagakttgttcctgcccttccctttgtgacttgaagaaccctgactttgtttctgcaaaggcacctgcatgtgtctgtgttcgtgtaggcataatgtgaggaggt

SEQ ID NO: 4529 - DNA, 201 bp, Homo sapiens
  misc_feature (1)...(201): n = A,T,C or G, or insertion/deletion polymorphism (see Tables 1-2)
tgtgtgggactgagaggcaagagttgttcctgcccttccctttgtgacttgaagaaccctgactttgtttctgcaaaggcacctgcatgtgtctgtgttcntgtaggcataatgtgaggaggtggggagaccaccccacccccatgtccaccatgaccctcttcccacgctgacctgtgctccctccccaatcatctttcc

SEQ ID NO: 4530 - DNA, 201 bp, Homo sapiens
ccccatgtccaccatgaccctcttcccacgctgacctgtgctccctccccaatcatctttcctgttccagagaggtggggctgaggtgtctccatctctgyctcaacttcatggtgcactgagctgtaacttcttccttccctattaaaattagaacctgagtataaatttactttctcaaattcttgccatgagaggttg

SEQ ID NO: 4531 - DNA, 201 bp, Homo sapiens; identical to SEQ ID NO: 4426

SEQ ID NO: 4532 - DNA, 201 bp, Homo sapiens
gacctgtgctccctccccaatcatctttcctgttccagagaggtggggctgaggtgtctccatctctgtctcaacttcatggtgcactgagctgtaacttyttccttccctattaaaattagaacctgagtataaatttactttctcaaattcttgccatgagaggttgatgagttaattaaaggagaagattcctaaaat

SEQ ID NO: 4533 - DNA, 101 bp, Homo sapiens; identical to SEQ ID NO: 4427

SEQ ID NO: 4534 - DNA, 201 bp, Homo sapiens
tcctgttccagagaggtggggctgaggtgtctccatctctgtctcaacttcatggtgcactgagctgtaacttcttccttccctattaaaattagaacctkagtataaatttactttctcaaattcttgccatgagaggttgatgagttaattaaaggagaagattcctaaaatttgagagacaaaataaatggaacacat

SEQ ID NO: 4535 - DNA, 113 bp, Homo sapiens; identical to SEQ ID NO: 4428

SEQ ID NO: 4536 - DNA, 201 bp, Homo sapiens; identical to SEQ ID NO: 4429

SEQ ID NO: 4537 - DNA, 198 bp, Homo sapiens
gaggtggggctgaggtgtctccatctctgtctcaacttcatggtgcactgagctgtaacttcttccttccctattaaaattagaacctgagtataaatttmctttctcaaattcttgccatgagaggttgatgagttaattaaaggagaagattcctaaaatttgagagacaaaataaatggaacacatgagaacctt

SEQ ID NO: 4538 - DNA, 201 bp, Homo sapiens; identical to SEQ ID NO: 4430

SEQ ID NO: 4539 - DNA, 201 bp, Homo sapiens; identical to SEQ ID NO: 4431

SEQ ID NO: 4540 - DNA, 201 bp, Homo sapiens; identical to SEQ ID NO: 4432

SEQ ID NO: 4541 - DNA, 122 bp, Homo sapiens
aaattagaacctgagtataaatttactttctcaaattcttgccatgagaggttgatgagttaattaaaggagaagattcctaaaatttgagagacaaaatwaatggaacacatgagaacctt

SEQ ID NO: 4542 - DNA, 201 bp, Homo sapiens; identical to SEQ ID NO: 4433

SEQ ID NO: 4543 - DNA, 114 bp, Homo sapiens
acctgagtataaatttactttctcaaattcttgccatgagaggttgatgagttaattaaaggagaagattcctaaaatttgagagacaaaataaatggaasacatgagaacctt

SEQ ID NO: 4544 - DNA, 201 bp, Homo sapiens; identical to SEQ ID NO: 4434

SEQ ID NO: 4545 - DNA, 201 bp, Homo sapiens; identical to SEQ ID NO: 4435

SEQ ID NO: 4546 - DNA, 201 bp, Homo sapiens; identical to SEQ ID NO: 4436

SEQ ID NO: 4547 - DNA, 201 bp, Homo sapiens; identical to SEQ ID NO: 4437

SEQ ID NO: 4548 - DNA, 201 bp, Homo sapiens; identical to SEQ ID NO: 4438

SEQ ID NO: 4549 - DNA, 201 bp, Homo sapiens
tgcccagggctctgatgtgtctctcacagcttgtaaagtgtgagacagctgccttgtgtgggactgagaggcaagagttgttcctgcccttccctttgtgrcttgaagaaccctgactttgtttctgcaaaggcacctgcatgtgtctgtgttcgtgtaggcataatgtgaggaggtggggagaccaccccacccccatgt

SEQ ID NO: 4550 - DNA, 201 bp, Homo sapiens; identical to SEQ ID NO: 4440

SEQ ID NO: 4551 - DNA, 201 bp, Homo sapiens; identical to SEQ ID NO: 4441

SEQ ID NO: 4552 - DNA, 201 bp, Homo sapiens; identical to SEQ ID NO: 4442

SEQ ID NO: 4553 - DNA, 201 bp, Homo sapiens; identical to SEQ ID NO: 4443

SEQ ID NO: 4554 - DNA, 201 bp, Homo sapiens; identical to SEQ ID NO: 4444

SEQ ID NO: 4555 - DNA, 201 bp, Homo sapiens; identical to SEQ ID NO: 4445

SEQ ID NO: 4556 - DNA, 201 bp, Homo sapiens; identical to SEQ ID NO: 4446

SEQ ID NO: 4557 - DNA, 201 bp, Homo sapiens; identical to SEQ ID NO: 4447

SEQ ID NO: 4558 - DNA, 201 bp, Homo sapiens; identical to SEQ ID NO: 4448

SEQ ID NO: 4559 - DNA, 201 bp, Homo sapiens; identical to SEQ ID NO: 4449

SEQ ID NO: 4560 - DNA, 201 bp, Homo sapiens; identical to SEQ ID NO: 4450

SEQ ID NO: 4561 - DNA, 201 bp, Homo sapiens
gctctgatgtgtctctcacagcttgtaaagtgtgagacagctgccttgtgtgggactgagaggcaagagttgttcctgcccttccctttgtgacttgaagwaccctgactttgtttctgcaaaggcacctgcatgtgtctgtgttcgtgtaggcataatgtgaggaggtggggagaccaccccacccccatgtccaccatg

SEQ ID NO: 4562 - DNA, 201 bp, Homo sapiens; identical to SEQ ID NO: 4452

SEQ ID NO: 4563 - DNA, 201 bp, Homo sapiens; identical to SEQ ID NO: 4453

SEQ ID NO: 4564 - DNA, 201 bp, Homo sapiens
tgcccttccctttgtgacttgaagaaccctgactttgtttctgcaaaggcacctgcatgtgtctgtgttcgtgtaggcataatgtgaggaggtggggagascaccccacccccatgtccaccatgaccctcttcccacgctgacctgtgctccctccccaatcatctttcctgttccagagaggtggggctgaggtgtctc

SEQ ID NO: 4565 - DNA, 201 bp, Homo sapiens; identical to SEQ ID NO: 4454

SEQ ID NO: 4566 - DNA, 201 bp, Homo sapiens; identical to SEQ ID NO: 4455

SEQ ID NO: 4567 - DNA, 113 bp, Homo sapiens
cctgagtataaatttactttctcaaattcttgccatgagaggttgatgagttaattaaaggagaagattcctaaaatttgagagacaaaataaatggaacrcatgagaacctt

SEQ ID NO: 4568 - DNA, 201 bp, Homo sapiens; identical to SEQ ID NO: 4456

SEQ ID NO: 4569 - DNA, 201 bp, Homo sapiens; identical to SEQ ID NO: 4457

SEQ ID NO: 4570 - DNA, 201 bp, Homo sapiens; identical to SEQ ID NO: 4458

SEQ ID NO: 4571 - DNA, 201 bp, Homo sapiens; identical to SEQ ID NO: 4459

SEQ ID NO: 4572 - DNA, 201 bp, Homo sapiens; identical to SEQ ID NO: 4460

SEQ ID NO: 4573 - DNA, 201 bp, Homo sapiens; identical to SEQ ID NO: 4462

SEQ ID NO: 4574 - DNA, 201 bp, Homo sapiens; identical to SEQ ID NO: 4461

SEQ ID NO: 4575 - DNA, 201 bp, Homo sapiens; identical to SEQ ID NO: 4463

SEQ ID NO: 4576 - DNA, 201 bp, Homo sapiens; identical to SEQ ID NO: 4464

SEQ ID NO: 4577 - DNA, 201 bp, Homo sapiens; identical to SEQ ID NO: 4465

SEQ ID NO: 4578 - DNA, 201 bp, Homo sapiens; identical to SEQ ID NO: 4466

SEQ ID NO: 4579 - DNA, 201 bp, Homo sapiens; identical to SEQ ID NO: 4467

SEQ ID NO: 4580 - DNA, 201 bp, Homo sapiens; identical to SEQ ID NO: 4468

SEQ ID NO: 4581 - DNA, 201 bp, Homo sapiens; identical to SEQ ID NO: 4469

SEQ ID NO: 4582 - DNA, 201 bp, Homo sapiens; identical to SEQ ID NO: 4470

SEQ ID NO: 4583 - DNA, 201 bp, Homo sapiens; identical to SEQ ID NO: 4471

SEQ ID NO: 4584 - DNA, 201 bp, Homo sapiens; identical to SEQ ID NO: 4472

SEQ ID NO: 4585 - DNA, 201 bp, Homo sapiens; identical to SEQ ID NO: 4473

SEQ ID NO: 4586 - DNA, 201 bp, Homo sapiens; identical to SEQ ID NO: 4474

SEQ ID NO: 4587 - DNA, 201 bp, Homo sapiens; identical to SEQ ID NO: 4475

SEQ ID NO: 4588 - DNA, 201 bp, Homo sapiens; identical to SEQ ID NO: 4476

SEQ ID NO: 4589 - DNA, 201 bp, Homo sapiens; identical to SEQ ID NO: 4477

SEQ ID NO: 4590 - DNA, 201 bp, Homo sapiens
tccctttgtgacttgaagaaccctgactttgtttctgcaaaggcacctgcatgtgtctgtgttcgtgtaggcataatgtgaggaggtggggagaccacccmacccccatgtccaccatgaccctcttcccacgctgacctgtgctccctccccaatcatctttcctgttccagagaggtggggctgaggtgtctccatctc

SEQ ID NO: 4591 - DNA, 201 bp, Homo sapiens; identical to SEQ ID NO: 4478

SEQ ID NO: 4592 - DNA, 201 bp, Homo sapiens
atgtgtctgtgttcgtgtaggcataatgtgaggaggtggggagaccaccccacccccatgtccaccatgaccctcttcccacgctgacctgtgctccctcyccaatcatctttcctgttccagagaggtggggctgaggtgtctccatctctgtctcaacttcatggtgcactgagctgtaacttcttccttccctattaa

SEQ ID NO: 4593 - DNA, 201 bp, Homo sapiens; identical to SEQ ID NO: 4480

SEQ ID NO: 4594 - DNA, 162 bp, Homo sapiens; identical to SEQ ID NO: 4481

SEQ ID NO: 4595 - DNA, 201 bp, Homo sapiens
ggcataatgtgaggaggtggggagaccaccccacccccatgtccaccatgaccctcttcccacgctgacctgtgctccctccccaatcatctttcctgttscagagaggtggggctgaggtgtctccatctctgtctcaacttcatggtgcactgagctgtaacttcttccttccctattaaaattagaacctgagtataa

SEQ ID NO: 4596 - DNA, 201 bp, Homo sapiens; identical to SEQ ID NO: 4483

SEQ ID NO: 4597 - DNA, 201 bp, Homo sapiens; identical to SEQ ID NO: 4484

SEQ ID NO: 4598 - DNA, 201 bp, Homo sapiens; identical to SEQ ID NO: 4485

SEQ ID NO: 4599 - DNA, 201 bp, Homo sapiens; identical to SEQ ID NO: 4486

SEQ ID NO: 4600 - DNA, 201 bp, Homo sapiens; identical to SEQ ID NO: 4487

SEQ ID NO: 4601 - DNA, 201 bp, Homo sapiens; identical to SEQ ID NO: 4488

SEQ ID NO: 4602 - DNA, 201 bp, Homo sapiens; identical to SEQ ID NO: 4489

SEQ ID NO: 4603 - DNA, 201 bp, Homo sapiens; identical to SEQ ID NO: 4490

SEQ ID NO: 4604 - DNA, 201 bp, Homo sapiens; identical to SEQ ID NO: 4491

SEQ ID NO: 4605 - DNA, 201 bp, Homo sapiens; identical to SEQ ID NO: 4492

SEQ ID NO: 4606 - DNA, 201 bp, Homo sapiens; identical to SEQ ID NO: 4493

SEQ ID NO: 4607 - DNA, 201 bp, Homo sapiens; identical to SEQ ID NO: 4494

SEQ ID NO: 4608 - DNA, 201 bp, Homo sapiens; identical to SEQ ID NO: 4495

SEQ ID NO: 4609 - DNA, 201 bp, Homo sapiens; identical to SEQ ID NO: 4496

SEQ ID NO: 4610 - DNA, 201 bp, Homo sapiens; identical to SEQ ID NO: 4497

SEQ ID NO: 4611 - DNA, 201 bp, Homo sapiens; identical to SEQ ID NO: 4498

SEQ ID NO: 4612 - DNA, 201 bp, Homo sapiens; identical to SEQ ID NO: 4499

SEQ ID NO: 4613 - DNA, 201 bp, Homo sapiens; identical to SEQ ID NO: 4500

SEQ ID NO: 4614 - DNA, 201 bp, Homo sapiens; identical to SEQ ID NO: 4501

SEQ ID NO: 4615 - DNA, 201 bp, Homo sapiens; identical to SEQ ID NO: 4502

SEQ ID NO: 4616 - DNA, 201 bp, Homo sapiens; identical to SEQ ID NO: 4503

SEQ ID NO: 4617 - DNA, 201 bp, Homo sapiens; identical to SEQ ID NO: 4504

SEQ ID NO: 4618 - DNA, 201 bp, Homo sapiens; identical to SEQ ID NO: 4505

SEQ ID NO: 4619 - DNA, 201 bp, Homo sapiens; identical to SEQ ID NO: 4506

SEQ ID NO: 4620 - DNA, 135 bp, Homo sapiens
ctctgatgtgtccctcacagcttgtaaagtgtgawgggcgggctcccactccatgaggtatttcttcacatccgtgtcccggcccggccgcggggagccccgcttcatcgccgtgggctacgtggacgacacgca

SEQ ID NO: 4621 - DNA, 201 bp, Homo sapiens
cgtcatggcgccccgaaccctcctcctgctactctcgggggccctggccctgacccagacctgggcgggctcccactccatgaggtatttcttcacatccrtgtcccggcccggccgcggggagccccgcttcatcgccgtgggctacgtggacgacacgcagttcgtgcggttcgacagcgacgccgcgagccagaggat

SEQ ID NO: 4622 - DNA, 201 bp, Homo sapiens
cgacacgcagttcgtgcggttcgacagcgacgccgcgagccagaggatggagccgcgggcgccgtggatagagcaggaggggccggagtattgggaccagvagacacggaatgtgaaggcccagtcacagactgaccgagtggacctggggaccctgcgcggctactacaaccagagcgaggccggttctcacaccatcca

SEQ ID NO: 4623 - DNA, 201 bp, Homo sapiens
actccatgaggtatttcttcacatccgtgtcccggcccggccgcggggagccccgcttcatcgccgtgggctacgtggacgacacgcagttcgtgcggttygacagcgacgccgcgagccagaggatggagccgcgggcgccgtggatagagcaggaggggccggagtattgggaccaggagacacggaatgtgaaggccc

SEQ ID NO: 4624 - DNA, 201 bp, Homo sapiens
actacaaccagagcgaggccggttctcacaccatccagataatgtatggctgcgacgtggggtcggacgggcgcttcctccgcgggtaccggcaggacgcytacgacggcaaggattacatcgccctgaacgaggacctgcgctcttggaccgcggcggacatggcggctcagatcaccaagcgcaagtgggaggcggccc

SEQ ID NO: 4625 - DNA, 201 bp, Homo sapiens
aagtgggcggctgtggtggtgccttctggagaggagcagagatacacctgccatgtgcagcatgagggtctgcccaagcccctcaccctgagatgggagcygtcttcccagcccaccatccccatcgtgggcatcattgctggcctggttctccttggagctgtgatcactggagctgtggtcgctgccgtgatgtggagg

SEQ ID NO: 4626 - DNA, 201 bp, Homo sapiens
ccatccagataatgtatggctgcgacgtggggtcggacgggcgcttcctccgcgggtaccggcaggacgcctacgacggcaaggattacatcgccctgaamgaggacctgcgctcttggaccgcggcggacatggcggctcagatcaccaagcgcaagtgggaggcggcccatgaggcggagcagttgagagcctacctgg

SEQ ID NO: 4627 - DNA, 105 bp, Homo sapiens
gtgawtcacatccgtgtcccggcccggccgcggggagccccgcttcatcgccgtgggctacgtggacgacacgcagttcgtgcggttcgacagcgacgccgcgag

SEQ ID NO: 4628 - DNA, 201 bp, Homo sapiens
aaccctcctcctgctactctcgggggccctggccctgacccagacctgggcgggctcccactccatgaggtatttcttcacatccgtgtcccggcccggcmgcggggagccccgcttcatcgccgtgggctacgtggacgacacgcagttcgtgcggttcgacagcgacgccgcgagccagaggatggagccgcgggcgcc

SEQ ID NO: 4629 - DNA, 130 bp, Homo sapiens
atgtgtccctcacagcttgtaaagtgtgarggctcccactccatgaggtatttcttcacatccgtgtcccggcccggccgcggggagccccgcttcatcgccgtgggctacgtggacgacacgcagttcg

SEQ ID NO: 4630 - DNA, 124 bp, Homo sapiens
ccctcacagcttgtaaagtgtgaycactccatgaggtatttcttcacatccgtgtcccggcccggccgcggggagccccgcttcatcgccgtgggctacgtggacgacacgcagttcgtgcggt

SEQ ID NO: 4631 - DNA, 201 bp, Homo sapiens
acagactgaccgagtggacctggggaccctgcgcggctactacaaccagagcgaggccggttctcacaccatccagataatgtatggctgcgacgtggggycggacgggcgcttcctccgcgggtaccggcaggacgcctacgacggcaaggattacatcgccctgaacgaggacctgcgctcttggaccgcggcggacat

SEQ ID NO: 4632 - DNA, 104 bp, Homo sapiens
tgahcacatccgtgtcccggcccggccgcggggagccccgcttcatcgccgtgggctacgtggacgacacgcagttcgtgcggttcgacagcgacgccgcgagc

SEQ ID NO: 4633 - DNA, 201 bp, Homo sapiens
tggccgtcatggcgccccgaaccctcctcctgctactctcgggggccctggccctgacccagacctgggcgggctcccactccatgaggtatttcttcacmtccgtgtcccggcccggccgcggggagccccgcttcatcgccgtgggctacgtggacgacacgcagttcgtgcggttcgacagcgacgccgcgagccaga

SEQ ID NO: 4634 - DNA, 201 bp, Homo sapiens
tcctcctgctactctcgggggccctggccctgacccagacctgggcgggctcccactccatgaggtatttcttcacatccgtgtcccggcccggccgcggrgagccccgcttcatcgccgtgggctacgtggacgacacgcagttcgtgcggttcgacagcgacgccgcgagccagaggatggagccgcgggcgccgtgga

SEQ ID NO: 4635 - DNA, 201 bp, Homo sapiens
acacggaatgtgaaggcccagtcacagactgaccgagtggacctggggaccctgcgcggctactacaaccagagcgaggccggttctcacaccatccagakaatgtatggctgcgacgtggggtcggacgggcgcttcctccgcgggtaccggcaggacgcctacgacggcaaggattacatcgccctgaacgaggacctg

SEQ ID NO: 4636 - DNA, 201 bp, Homo sapiens
tgcgcggctactacaaccagagcgaggccggttctcacaccatccagataatgtatggctgcgacgtggggtcggacgggcgcttcctccgcgggtaccgscaggacgcctacgacggcaaggattacatcgccctgaacgaggacctgcgctcttggaccgcggcggacatggcggctcagatcaccaagcgcaagtggg

SEQ ID NO: 4637 - DNA, 201 bp, Homo sapiens
cacggaatgtgaaggcccagtcacagactgaccgagtggacctggggaccctgcgcggctactacaaccagagcgaggccggttctcacaccatccagatratgtatggctgcgacgtggggtcggacgggcgcttcctccgcgggtaccggcaggacgcctacgacggcaaggattacatcgccctgaacgaggacctgc

SEQ ID NO: 4638 - DNA, 201 bp, Homo sapiens
aatgtgaaggcccagtcacagactgaccgagtggacctggggaccctgcgcggctactacaaccagagcgaggccggttctcacaccatccagataatgtwtggctgcgacgtggggtcggacgggcgcttcctccgcgggtaccggcaggacgcctacgacggcaaggattacatcgccctgaacgaggacctgcgctct

SEQ ID NO: 4639 - DNA, 201 bp, Homo sapiens
gaccaggcctgcaggggatggaaccttccagaagtgggcggctgtggtggtgccttctggagaggagcagagatacacctgccatgtgcagcatgagggtytgcccaagcccctcaccctgagatgggagctgtcttcccagcccaccatccccatcgtgggcatcattgctggcctggttctccttggagctgtgatcac

SEQ ID NO: 4640 - DNA, 201 bp, Homo sapiens
gggccctggccctgacccagacctgggcgggctcccactccatgaggtatttcttcacatccgtgtcccggcccggccgcggggagccccgcttcatcgcmgtgggctacgtggacgacacgcagttcgtgcggttcgacagcgacgccgcgagccagaggatggagccgcgggcgccgtggatagagcaggaggggccgg

SEQ ID NO: 4641 - DNA, 201 bp, Homo sapiens
gacgacacgcagttcgtgcggttcgacagcgacgccgcgagccagaggatggagccgcgggcgccgtggatagagcaggaggggccggagtattgggaccrggagacacggaatgtgaaggcccagtcacagactgaccgagtggacctggggaccctgcgcggctactacaaccagagcgaggccggttctcacaccatc

SEQ ID NO: 4642 - DNA, 201 bp, Homo sapiens
cagaggatggagccgcgggcgccgtggatagagcaggaggggccggagtattgggaccaggagacacggaatgtgaaggcccagtcacagactgaccgaghggacctggggaccctgcgcggctactacaaccagagcgaggccggttctcacaccatccagataatgtatggctgcgacgtggggtcggacgggcgcttc

SEQ ID NO: 4643 - DNA, 201 bp, Homo sapiens
gaggatggagccgcgggcgccgtggatagagcaggaggggccggagtattgggaccaggagacacggaatgtgaaggcccagtcacagactgaccgagtgracctggggaccctgcgcggctactacaaccagagcgaggccggttctcacaccatccagataatgtatggctgcgacgtggggtcggacgggcgcttcct

SEQ ID NO: 4644 - DNA, 201 bp, Homo sapiens
ccggagtattgggaccaggagacacggaatgtgaaggcccagtcacagactgaccgagtggacctggggaccctgcgcggctactacaaccagagcgaggmcggttctcacaccatccagataatgtatggctgcgacgtggggtcggacgggcgcttcctccgcgggtaccggcaggacgcctacgacggcaaggattac

SEQ ID NO: 4645 - DNA, 201 bp, Homo sapiens
ccctcctcctgctactctcgggggccctggccctgacccagacctgggcgggctcccactccatgaggtatttcttcacatccgtgtcccggcccggccgyggggagccccgcttcatcgccgtgggctacgtggacgacacgcagttcgtgcggttcgacagcgacgccgcgagccagaggatggagccgcgggcgccgt

SEQ ID NO: 4646 - DNA, 201 bp, Homo sapiens
tgaccgagtggacctggggaccctgcgcggctactacaaccagagcgaggccggttctcacaccatccagataatgtatggctgcgacgtggggtcggackggcgcttcctccgcgggtaccggcaggacgcctacgacggcaaggattacatcgccctgaacgaggacctgcgctcttggaccgcggcggacatggcggc

SEQ ID NO: 4647 - DNA, 201 bp, Homo sapiens
agtggacctggggaccctgcgcggctactacaaccagagcgaggccggttctcacaccatccagataatgtatggctgcgacgtggggtcggacgggcgcytcctccgcgggtaccggcaggacgcctacgacggcaaggattacatcgccctgaacgaggacctgcgctcttggaccgcggcggacatggcggctcagat

SEQ ID NO: 4648 - DNA, 201 bp, Homo sapiens
ctgcgcggctactacaaccagagcgaggccggttctcacaccatccagataatgtatggctgcgacgtggggtcggacgggcgcttcctccgcgggtaccrgcaggacgcctacgacggcaaggattacatcgccctgaacgaggacctgcgctcttggaccgcggcggacatggcggctcagatcaccaagcgcaagtgg

SEQ ID NO: 4649 - DNA, 201 bp, Homo sapiens
tcacaccatccagataatgtatggctgcgacgtggggtcggacgggcgcttcctccgcgggtaccggcaggacgcctacgacggcaaggattacatcgccytgaacgaggacctgcgctcttggaccgcggcggacatggcggctcagatcaccaagcgcaagtgggaggcggcccatgaggcggagcagttgagagccta

SEQ ID NO: 4650 - DNA, 201 bp, Homo sapiens
acgggcgcttcctccgcgggtaccggcaggacgcctacgacggcaaggattacatcgccctgaacgaggacctgcgctcttggaccgcggcggacatggcrgctcagatcaccaagcgcaagtgggaggcggcccatgaggcggagcagttgagagcctacctggatggcacgtgcgtggagtggctccgcagatacctgg

SEQ ID NO: 4651 - DNA, 201 bp, Homo sapiens
ttcctccgcgggtaccggcaggacgcctacgacggcaaggattacatcgccctgaacgaggacctgcgctcttggaccgcggcggacatggcggctcagaycaccaagcgcaagtgggaggcggcccatgaggcggagcagttgagagcctacctggatggcacgtgcgtggagtggctccgcagatacctggagaacggg

SEQ ID NO: 4652 - DNA, 201 bp, Homo sapiens
ccgcgggtaccggcaggacgcctacgacggcaaggattacatcgccctgaacgaggacctgcgctcttggaccgcggcggacatggcggctcagatcaccmagcgcaagtgggaggcggcccatgaggcggagcagttgagagcctacctggatggcacgtgcgtggagtggctccgcagatacctggagaacgggaagga

SEQ ID NO: 4653 - DNA, 201 bp, Homo sapiens
gggtaccggcaggacgcctacgacggcaaggattacatcgccctgaacgaggacctgcgctcttggaccgcggcggacatggcggctcagatcaccaagcrcaagtgggaggcggcccatgaggcggagcagttgagagcctacctggatggcacgtgcgtggagtggctccgcagatacctggagaacgggaaggagacg

SEQ ID NO: 4654 - DNA, 201 bp, Homo sapiens
ggacgcctacgacggcaaggattacatcgccctgaacgaggacctgcgctcttggaccgcggcggacatggcggctcagatcaccaagcgcaagtgggagrcggcccatgaggcggagcagttgagagcctacctggatggcacgtgcgtggagtggctccgcagatacctggagaacgggaaggagacgctgcagcgcac

SEQ ID NO: 4655 - DNA, 201 bp, Homo sapiens
gcctacgacggcaaggattacatcgccctgaacgaggacctgcgctcttggaccgcggcggacatggcggctcagatcaccaagcgcaagtgggaggcggyccatgaggcggagcagttgagagcctacctggatggcacgtgcgtggagtggctccgcagatacctggagaacgggaaggagacgctgcagcgcacggac

SEQ ID NO: 4656 - DNA, 201 bp, Homo sapiens
tacgacggcaaggattacatcgccctgaacgaggacctgcgctcttggaccgcggcggacatggcggctcagatcaccaagcgcaagtgggaggcggcccrtgaggcggagcagttgagagcctacctggatggcacgtgcgtggagtggctccgcagatacctggagaacgggaaggagacgctgcagcgcacggacccc

SEQ ID NO: 4657 - DNA, 201 bp, Homo sapiens
gacggcaaggattacatcgccctgaacgaggacctgcgctcttggaccgcggcggacatggcggctcagatcaccaagcgcaagtgggaggcggcccatghggcggagcagttgagagcctacctggatggcacgtgcgtggagtggctccgcagatacctggagaacgggaaggagacgctgcagcgcacggaccccccc

SEQ ID NO: 4658 - DNA, 201 bp, Homo sapiens
atgaggccaccctgaggtgctgggccctgggcttctaccctgcggagatcacactgacctggcagcgggatggggaggaccagacccaggacacggagctygtggagaccaggcctgcaggggatggaaccttccagaagtgggcggctgtggtggtgccttctggagaggagcagagatacacctgccatgtgcagcatg

SEQ ID NO: 4659 - DNA, 201 bp, Homo sapiens
tgggcttctaccctgcggagatcacactgacctggcagcgggatggggaggaccagacccaggacacggagctcgtggagaccaggcctgcaggggatggraccttccagaagtgggcggctgtggtggtgccttctggagaggagcagagatacacctgccatgtgcagcatgagggtctgcccaagcccctcaccctga

SEQ ID NO: 4660 - DNA, 201 bp, Homo sapiens
gagatcacactgacctggcagcgggatggggaggaccagacccaggacacggagctcgtggagaccaggcctgcaggggatggaaccttccagaagtgggyggctgtggtggtgccttctggagaggagcagagatacacctgccatgtgcagcatgagggtctgcccaagcccctcaccctgagatgggagctgtcttcc

SEQ ID NO: 4661 - DNA, 201 bp, Homo sapiens
gatcacactgacctggcagcgggatggggaggaccagacccaggacacggagctcgtggagaccaggcctgcaggggatggaaccttccagaagtgggcgkctgtggtggtgccttctggagaggagcagagatacacctgccatgtgcagcatgagggtctgcccaagcccctcaccctgagatgggagctgtcttccca

SEQ ID NO: 4662 - DNA, 201 bp, Homo sapiens
cctggcagcgggatggggaggaccagacccaggacacggagctcgtggagaccaggcctgcaggggatggaaccttccagaagtgggcggctgtggtggtrccttctggagaggagcagagatacacctgccatgtgcagcatgagggtctgcccaagcccctcaccctgagatgggagctgtcttcccagcccaccatcc

SEQ ID NO: 4663 - DNA, 201 bp, Homo sapiens
ggatggggaggaccagacccaggacacggagctcgtggagaccaggcctgcaggggatggaaccttccagaagtgggcggctgtggtggtgccttctggavaggagcagagatacacctgccatgtgcagcatgagggtctgcccaagcccctcaccctgagatgggagctgtcttcccagcccaccatccccatcgtggg

SEQ ID NO: 4664 - DNA, 201 bp, Homo sapiens
ggaggaccagacccaggacacggagctcgtggagaccaggcctgcaggggatggaaccttccagaagtgggcggctgtggtggtgccttctggagaggagmagagatacacctgccatgtgcagcatgagggtctgcccaagcccctcaccctgagatgggagctgtcttcccagcccaccatccccatcgtgggcatcat

SEQ ID NO: 4665 - DNA, 201 bp, Homo sapiens
cggctactacaaccagagcgaggccggttctcacaccatccagataatgtatggctgcgacgtggggtcggacgggcgcttcctccgcgggtaccggcagkacgcctacgacggcaaggattacatcgccctgaacgaggacctgcgctcttggaccgcggcggacatggcggctcagatcaccaagcgcaagtgggaggc

SEQ ID NO: 4666 - DNA, 201 bp, Homo sapiens
ctgacacgccgaccgcctgctgcttcagctacacctcccggcagattccacagaatttcatagctgactactttgagacgagcagccagtgctccaagccyggtgtcatcttcctaaccaagcgaagccggcaggtctgtgctgaccccagtgaggagtgggtccagaaatatgtcagcgacctggagctgagtgcctgag

SEQ ID NO: 4667 - DNA, 201 bp, Homo sapiens
gccagtgctccaagcccggtgtcatcttcctaaccaagcgaagccggcaggtctgtgctgaccccagtgaggagtgggtccagaaatatgtcagcgacctrgagctgagtgcctgaggggtccagaagcttcgaggcccagcgacctcggtgggcccagtggggaggagcaggagcctgagccttgggaacatgcgtgtga

SEQ ID NO: 4668 - DNA, 201 bp, Homo sapiens
ttgagacgagcagccagtgctccaagcccggtgtcatcttcctaaccaagcgaagccggcaggtctgtgctgaccccagtgaggagtgggtccagaaataygtcagcgacctggagctgagtgcctgaggggtccagaagcttcgaggcccagcgacctcggtgggcccagtggggaggagcaggagcctgagccttggga

SEQ ID NO: 4669 - DNA, 201 bp, Homo sapiens
gaggcccagcgacctcggtgggcccagtggggaggagcaggagcctgagccttgggaacatgcgtgtgacctccacagctacctcttctatggactggttrttgccaaacagccacactgtgggactcttcttaacttaaattttaatttatttatactatttagtttttgtaatttattttcgatttcacagtgtgtttg

SEQ ID NO: 4670 - DNA, 201 bp, Homo sapiens
ctccacagctacctcttctatggactggttgttgccaaacagccacactgtgggactcttcttaacttaaattttaatttatttatactatttagtttttrtaatttattttcgatttcacagtgtgtttgtgattgtttgctctgagagttcccctgtcccctcccccttccctcacaccgcgtctggtgacaaccgagt

SEQ ID NO: 4671 - DNA, 201 bp, Homo sapiens
ttaaattttaatttatttatactatttagtttttgtaatttattttcgatttcacagtgtgtttgtgattgtttgctctgagagttcccctgtcccctccmccttccctcacaccgcgtctggtgacaaccgagtggctgtcatcagcctgtgtaggcagtcatggcaccaaagccaccagactgacaaatgtgtatcgga

SEQ ID NO: 4672 - DNA, 201 bp, Homo sapiens
aaattttaatttatttatactatttagtttttgtaatttattttcgatttcacagtgtgtttgtgattgtttgctctgagagttcccctgtcccctccccsttccctcacaccgcgtctggtgacaaccgagtggctgtcatcagcctgtgtaggcagtcatggcaccaaagccaccagactgacaaatgtgtatcggatg

SEQ ID NO: 4673 - DNA, 201 bp, Homo sapiens
atttatactatttagtttttgtaatttattttcgatttcacagtgtgtttgtgattgtttgctctgagagttcccctgtcccctcccccttccctcacacygcgtctggtgacaaccgagtggctgtcatcagcctgtgtaggcagtcatggcaccaaagccaccagactgacaaatgtgtatcggatgcttttgttcagg

SEQ ID NO: 4674 - DNA, 201 bp, Homo sapiens
ttatactatttagtttttgtaatttattttcgatttcacagtgtgtttgtgattgtttgctctgagagttcccctgtcccctcccccttccctcacaccgygtctggtgacaaccgagtggctgtcatcagcctgtgtaggcagtcatggcaccaaagccaccagactgacaaatgtgtatcggatgcttttgttcagggc

SEQ ID NO: 4675 - DNA, 201 bp, Homo sapiens
ctttaagacttttatttttatctctagaaggggtcttagccccctagtctccagttgctgctgacacgccgaccgcctgctgcttcagctacacctcccgrcagattccacagaatttcatagctgactactttgagacgagcagccagtgctccaagcccggtgtcatcttcctaaccaagcgaagccggcaggtctgtg

SEQ ID NO: 4676 - DNA, 201 bp, Homo sapiens
cgagcagccagtgctccaagcccggtgtcatcttcctaaccaagcgaagccggcaggtctgtgctgaccccagtgaggagtgggtccagaaatatgtcagygacctggagctgagtgcctgaggggtccagaagcttcgaggcccagcgacctcggtgggcccagtggggaggagcaggagcctgagccttgggaacatgc

SEQ ID NO: 4677 - DNA, 201 bp, Homo sapiens
cttcagctacacctcccggcagattccacagaatttcatagctgactactttgagacgagcagccagtgctccaagcccggtgtcatcttcctaaccaagmgaagccggcaggtctgtgctgaccccagtgaggagtgggtccagaaatatgtcagcgacctggagctgagtgcctgaggggtccagaagcttcgaggccc

SEQ ID NO: 4678 - DNA, 201 bp, Homo sapiens
tatttatactatttagtttttgtaatttattttcgatttcacagtgtgtttgtgattgtttgctctgagagttcccctgtcccctcccccttccctcacascgcgtctggtgacaaccgagtggctgtcatcagcctgtgtaggcagtcatggcaccaaagccaccagactgacaaatgtgtatcggatgcttttgttcag

SEQ ID NO: 4679 - DNA, 201 bp, Homo sapiens
ctcttctatggactggttgttgccaaacagccacactgtgggactcttcttaacttaaattttaatttatttatactatttagtttttgtaatttattttygatttcacagtgtgtttgtgattgtttgctctgagagttcccctgtcccctcccccttccctcacaccgcgtctggtgacaaccgagtggctgtcatcag

SEQ ID NO: 4680 - DNA, 201 bp, Homo sapiens
tcgatttcacagtgtgtttgtgattgtttgctctgagagttcccctgtcccctcccccttccctcacaccgcgtctggtgacaaccgagtggctgtcatcrgcctgtgtaggcagtcatggcaccaaagccaccagactgacaaatgtgtatcggatgcttttgttcagggctgtgatcggcctggggaaataataaagat

SEQ ID NO: 4681 - DNA, 166 bp, Homo sapiens
  misc_feature (1)...(166): n = A,T,C or G, or insertion/deletion polymorphism (see Tables 1-2)
cccccttccctcacaccgcgtctggtgacaaccgagtggctgtcatcagcctgtgtaggcagtcatggcaccaaagccaccagactgacaaatgtgtatcngatgcttttgttcagggctgtgatcggcctggggaaataataaagatgctcttttaaaaggtaaa

SEQ ID NO: 4682 - DNA, 199 bp, Homo sapiens
cagcagacagtggtcagtcctttcttggctctgctgacactcgagcccacattccgtcacctgctcagaatcatgcaggtctccactgctgcccttgcygtcctcctctgcaccatggctctctgcaaccagttctctgcatcacgtgagtctgagtttcgttgtgggtatcaccactctctggccatggttagaccac

SEQ ID NO: 4683 - DNA, 201 bp, Homo sapiens
tgagtgcctgaggggtccagaagcttcgaggcccagcgacctcggtgggcccagtggggaggagcaggagcctgagccttgggaacatgcgtgtgacctcyacagctacctcttctatggactggttgttgccaaacagccacactgtgggactcttcttaacttaaattttaatttatttatactatttagtttttgtaa

SEQ ID NO: 4684 - DNA, 117 bp, Homo sapiens
cctgtgtaggcagtcatggcaccaaagccaccagactgacaaatgtgtatcggatgcttttgttcagggctgtgatcggcctggggaaataataaagatgytcttttaaaaggtaaa

SEQ ID NO: 4685 - DNA, 201 bp, Homo sapiens; identical to SEQ ID NO: 4666

SEQ ID NO: 4686 - DNA, 201 bp, Homo sapiens; identical to SEQ ID NO: 4667

SEQ ID NO: 4687 - DNA, 201 bp, Homo sapiens; identical to SEQ ID NO: 4668

SEQ ID NO: 4688 - DNA, 201 bp, Homo sapiens; identical to SEQ ID NO: 4669

SEQ ID NO: 4689 - DNA, 201 bp, Homo sapiens; identical to SEQ ID NO: 4670

SEQ ID NO: 4690 - DNA, 201 bp, Homo sapiens; identical to SEQ ID NO: 4671

SEQ ID NO: 4691 - DNA, 201 bp, Homo sapiens; identical to SEQ ID NO: 4672

SEQ ID NO: 4692 - DNA, 201 bp, Homo sapiens; identical to SEQ ID NO: 4673

SEQ ID NO: 4693 - DNA, 201 bp, Homo sapiens; identical to SEQ ID NO: 4674

SEQ ID NO: 4694 - DNA, 201 bp, Homo sapiens
cccttgctgtcctcctctgcaccatggctctctgcaaccagttctctgcatcacttgctgctgacacgccgaccgcctgctgcttcagctacacctcccgrcagattccacagaatttcatagctgactactttgagacgagcagccagtgctccaagcccggtgtcatcttcctaaccaagcgaagccggcaggtctgtg

SEQ ID NO: 4695 - DNA, 201 bp, Homo sapiens; identical to SEQ ID NO: 4677

SEQ ID NO: 4696 - DNA, 201 bp, Homo sapiens; identical to SEQ ID NO: 4676

SEQ ID NO: 4697 - DNA, 201 bp, Homo sapiens; identical to SEQ ID NO: 4678

SEQ ID NO: 4698 - DNA, 201 bp, Homo sapiens; identical to SEQ ID NO: 4679

SEQ ID NO: 4699 - DNA, 201 bp, Homo sapiens; identical to SEQ ID NO: 4680

SEQ ID NO: 4700 - DNA, 166 bp, Homo sapiens; identical to SEQ ID NO: 4681
  misc_feature (1)...(166): n = A,T,C or G, or insertion/deletion polymorphism (see Tables 1-2)

SEQ ID NO: 4701 - DNA, 201 bp, Homo sapiens
ggcagcagacagtggtcagtcctttcttggctctgctgacactcgagcccacattccgtcacctgctcagaatcatgcaggtctccactgctgcccttgcygtcctcctctgcaccatggctctctgcaaccagttctctgcatcacttgctgctgacacgccgaccgcctgctgcttcagctacacctcccggcagattc

SEQ ID NO: 4702 - DNA, 201 bp, Homo sapiens; identical to SEQ ID NO: 4683

SEQ ID NO: 4703 - DNA, 117 bp, Homo sapiens; identical to SEQ ID NO: 4684

SEQ ID NO: 4704 - DNA, 150 bp, Homo sapiens
ccccgaaccactcagggtcctgtggacagctcacctagctgcaatggctrcaggtaagcgcccctaaaatccctttgggcacaatgtgtcctgaggggagaggcagcgacctgtagatgggacgggggcactaaccctcaggtttggggc

SEQ ID NO: 4705 - DNA, 140 bp, Homo sapiens
ccccgaaccactcagggtcctgtggacagctcacctagckgcaatggctacaggtaagcgcccctaaaatccctttgggcacaatgtgtcctgaggggagaggcagcgacctgtagatgggacgggggcactaaccctca

SEQ ID NO: 4706 - DNA, 201 bp, Homo sapiens
gtttgaagaagcctatatcctgaaggagcagaagtattcattcctgcagaacccccagacctccctctgcttctcagagtctattccaacaccttccaacwgggtgaaaacgcagcagaaatctaacctagagctgctccgcatctccctgctgctcatccagtcatggctggagcccgtgcagctcctcaggagcgtctt

SEQ ID NO: 4707 - DNA, 201 bp, Homo sapiens
ctgccctggcttcaagagggcagtgccttcccaaccattcccttatccaggctttttgacaacgctatgctccgcgcccatcgtctgcaccagctggcctwtgacacctaccaggagtttgaagaagcctatatcctgaaggagcagaagtattcattcctgcagaacccccagacctccctctgcttctcagagtctatt

SEQ ID NO: 4708 - DNA, 201 bp, Homo sapiens
gcctgccctggcttcaagagggcagtgccttcccaaccattcccttatccaggctttttgacaacgctatgctccgcgcccatcgtctgcaccagctggcmtttgacacctaccaggagtttgaagaagcctatatcctgaaggagcagaagtattcattcctgcagaacccccagacctccctctgcttctcagagtcta

SEQ ID NO: 4709 - DNA, 201 bp, Homo sapiens
agtatcgccatgtaagcccagtatttggccaatctcagaaagctcctggtccctggagggatggagagagaaaaacaaacagctcctggagcagggagagygctggcctcttgctctccggctccctctgttgccctctggtttctccccaggctcccggacgtccctgctcctggcttttggcctgctctgcctgccctg

SEQ ID NO: 4710 - DNA, 106 bp, Homo sapiens
ccccgmaccactcagggtcctgtggacagctcacctagctgcaatggctacaggtaagcgcccctaaaatccctttgggcacaatgtgtcctgaggggagaggcag

SEQ ID NO: 4711 - DNA, 201 bp, Homo sapiens
tcctgaggggagaggcagcgacctgtagatgggacgggggcactaaccctcaggtttggggcttctgaatgtgagtatcgccatgtaagcccagtatttgkccaatctcagaaagctcctggtccctggagggatggagagagaaaaacaaacagctcctggagcagggagagtgctggcctcttgctctccggctccctc

SEQ ID NO: 4712 - DNA, 201 bp, Homo sapiens
ctttgggcacaatgtgtcctgaggggagaggcagcgacctgtagatgggacgggggcactaaccctcaggtttggggcttctgaatgtgagtatcgccatstaagcccagtatttggccaatctcagaaagctcctggtccctggagggatggagagagaaaaacaaacagctcctggagcagggagagtgctggcctctt

SEQ ID NO: 4713 - DNA, 201 bp, Homo sapiens
cctctgttgccctctggtttctccccaggctcccggacgtccctgctcctggcttttggcctgctctgcctgccctggcttcaagagggcagtgccttccmaaccattcccttatccaggctttttgacaacgctatgctccgcgcccatcgtctgcaccagctggcctttgacacctaccaggagtttgaagaagcctat

SEQ ID NO: 4714 - DNA, 201 bp, Homo sapiens
accatgacgcactgctcaagaactacgggctgctctactgcttcaggaaggacatggacaaggtcgagacattcctgcgcatggtgcagtgccgctctgtrgagggcagctgtggcttctaggtgcccgagtagcatcctgtgacccctccccagtgcctctcctggccctgaaggtgccactccagtgcccaccagctgc

SEQ ID NO: 4715 - DNA, 201 bp, Homo sapiens
tgctccacatctccctgctgctcatcgagtcgcggctggagcccgtgcggttcctcaggagtaccttcaccaacaacctggtgtatgacacctcggacagygatgactatcacctcctaaaggacctagaggaaggcatccaaatgctgatggggaggctggaagacggcagccacctgactgggcagaccctcaagcaga

SEQ ID NO: 4716 - DNA, 201 bp, Homo sapiens
acgcactgctcaagaactacgggctgctctactgcttcaggaaggacatggacaaggtcgagacattcctgcgcatggtgcagtgccgctctgtggagggyagctgtggcttctaggtgcccgagtagcatcctgtgacccctccccagtgcctctcctggccctgaaggtgccactccagtgcccaccagctgctcatcg

SEQ ID NO: 4717 - DNA, 201 bp, Homo sapiens
ctctactgcttcaggaaggacatggacaaggtcgagacattcctgcgcatggtgcagtgccgctctgtggagggcagctgtggcttctaggtgcccgagtrgcatcctgtgacccctccccagtgcctctcctggccctgaaggtgccactccagtgcccaccagctgctcatcgagtcgtggctggagcccgtgcggttc

SEQ ID NO: 4718 - DNA, 201 bp, Homo sapiens
ctgctctactgcttcaggaaggacatggacaaggtcgagacattcctgcgcatggtgcagtgccgctctgtggagggcagctgtggcttctaggtgcccgmgtagcatcctgtgacccctccccagtgcctctcctggccctgaaggtgccactccagtgcccaccagctgctcatcgagtcgtggctggagcccgtgcgg

SEQ ID NO: 4719 - DNA, 201 bp, Homo sapiens
gaaggacatggacaaggtcgagacattcctgcgcatggtgcagtgccgctctgtggagggcagctgtggcttctaggggcccgcgtggcatcctgtgaccyctccccagtgcctctcctgcccgtgcggttcctcaggagtatgttcgccaacaacctggtgtatgacacctcggacagcgatgactatcacctcctaaag

SEQ ID NO: 4720 - DNA, 201 bp, Homo sapiens
acatctccctgctgctcatcgagtcgcggctggagcccgtgcggttcctcaggagtaccttcaccaacaacctggtgtatgacacctcggacagtgatgamtatcacctcctaaaggacctagaggaaggcatccaaatgctgatggggaggctggaagacggcagccacctgactgggcagaccctcaagcagacctaca

SEQ ID NO: 4721 - DNA, 201 bp, Homo sapiens
ggtataaaaagggcccacaagagaccagctcaaggatcccaaggcccaactccccgaaccactcagggtcctgtggacagctcacctagctgcaatggctrcaggctcccggacgtccctgctcctggcttttggcctgctctgcctgccctggcttcaagagggcagtgccttcccaaccattcccttatccaggctttt

SEQ ID NO: 4722 - DNA, 201 bp, Homo sapiens
cagaacccccagacctccctctgtttctcagagtctattccgacaccctccaacagggaggaaacacaacagaaatccaacctagagctgctccgcatctscctgctgctcatccagtcgtggctggagcccgtgcagttcctcaggagtgtcttcgccaacagcctggtgtacggcgcctctgacagcaacgtctatgac

SEQ ID NO: 4723 - DNA, 201 bp, Homo sapiens
aaggggccagggtataaaaagggcccacaagagaccagctcaaggatcccaaggcccaactccccgaaccactcagggtcctgtggacagctcacctagckgcaatggctacaggctcccggacgtccctgctcctggcttttggcctgctctgcctgccctggcttcaagagggcagtgccttcccaaccattcccttat

SEQ ID NO: 4724 - DNA, 201 bp, Homo sapiens
ctgccctggcttcaagagggcagtgccttcccaaccattcccttatccaggctttttgacaacgctatgctccgcgcccatcgtctgcaccagctggcctwtgacacctaccaggagtttgaagaagcctatatcccaaaggaacagaagtattcattcctgcagaacccccagacctccctctgtttctcagagtctatt

SEQ ID NO: 4725 - DNA, 201 bp, Homo sapiens
gcctgccctggcttcaagagggcagtgccttcccaaccattcccttatccaggctttttgacaacgctatgctccgcgcccatcgtctgcaccagctggcmtttgacacctaccaggagtttgaagaagcctatatcccaaaggaacagaagtattcattcctgcagaacccccagacctccctctgtttctcagagtcta

SEQ ID NO: 4726 - DNA, 201 bp, Homo sapiens
gcataaatgtacacagaaacaggtgggggcaacagtgggagagaaggggccagggtataaaaagggcccacaagagaccagctcaaggatcccaaggcccractccccgaaccactcagggtcctgtggacagctcacctagctgcaatggctacaggctcccggacgtccctgctcctggcttttggcctgctctgcctg

SEQ ID NO: 4727 - DNA, 106 bp, Homo sapiens
atgatsccagcatgtgtgggaggagcttctaaattatccattagcacaagcccgtcagtggccccatgcataaatgtacacagaaacaggtgggggcaacagtggg

SEQ ID NO: 4728 - DNA, 201 bp, Homo sapiens
gagtctattccgacaccctccaacagggaggaaacacaacagaaatccaacctagagctgctccgcatctccctgctgctcatccagtcgtggctggagcycgtgcagttcctcaggagtgtcttcgccaacagcctggtgtacggcgcctctgacagcaacgtctatgacctcctaaaggacctagaggaaggcatccaa

SEQ ID NO: 4729 - DNA, 201 bp, Homo sapiens
caagcccgtcagtggccccatgcataaatgtacacagaaacaggtgggggcaacagtgggagagaaggggccagggtataaaaagggcccacaagagaccrgctcaaggatcccaaggcccaactccccgaaccactcagggtcctgtggacagctcacctagctgcaatggctacaggctcccggacgtccctgctcctg

SEQ ID NO: 4730 - DNA, 196 bp, Homo sapiens
atgatcccagcatgtgtgggaggagcttctaaattatccattagcacaagcccgtcagtggccccatgcataaatgtacacagaaacaggtggggkcaacagtgggagagaaggggccagggtataaaaagggcccacaagagaccagctcaaggatcccaaggcccaactccccgaaccactcagggtcctgtgg

SEQ ID NO: 4731 - DNA, 178 bp, Homo sapiens
atgatcccagcatgtgtgggaggagcttctaaattatccattagcacaagcccgtcagtggccccatgcataaatgtrcacagaaacaggtgggggcaacagtgggagagaaggggccagggtataaaaagggcccacaagagaccagctcaaggatcccaaggcccaactccccgaa

SEQ ID NO: 4732 - DNA, 141 bp, Homo sapiens
atgatcccagcatgtgtgggaggagcttctaaattatccaytagcacaagcccgtcagtggccccatgcataaatgtacacagaaacaggtgggggcaacagtgggagagaaggggccagggtataaaaagggcccacaag

SEQ ID NO: 4733 - DNA, 201 bp, Homo sapiens
tccctgctgctcatccagtcgtggctggagcccgtgcagttcctcaggagtgtcttcgccaacagcctggtgtacggcgcctctgacagcaacgtctatgrcctcctaaaggacctagaggaaggcatccaaacgctgatgggggctggaagatggcagcccccggactgggcagatcttcaagcagacctacagcaagtt

SEQ ID NO: 4734 - DNA, 201 bp, Homo sapiens
ggacctagaggaaggcatccaaacgctgatgggggctggaagatggcagcccccggactgggcagatcttcaagcagacctacagcaagttcgacacaaamtcacacaacgatgacgcactactcaagaactacgggctgctctactgcttcaggaaggacatggacaaggtcgagacattcctgcgcatcgtgcagtgcc

SEQ ID NO: 4735 - DNA, 201 bp, Homo sapiens
cctagaggaaggcatccaaacgctgatgggggctggaagatggcagcccccggactgggcagatcttcaagcagacctacagcaagttcgacacaaactcrcacaacgatgacgcactactcaagaactacgggctgctctactgcttcaggaaggacatggacaaggtcgagacattcctgcgcatcgtgcagtgccgct

SEQ ID NO: 4736 - DNA, 201 bp, Homo sapiens
tgcagttcctcaggagtgtcttcgccaacagcctggtgtacggcgcctctgacagcaacgtctatgacctcctaaaggacctagaggaaggcatccaaacrctgatgggggctggaagatggcagcccccggactgggcagatcttcaagcagacctacagcaagttcgacacaaactcacacaacgatgacgcactactc

SEQ ID NO: 4737 - DNA, 201 bp, Homo sapiens
ccgtcagtggccccatgcataaatgtacacagaaacaggtgggggcaacagtgggagagaaggggccagggtataaaaagggcccacaagagaccagctchaggatcccaaggcccaactccccgaaccactcagggtcctgtggacagctcacctagctgcaatggctacaggctcccggacgtccctgctcctggcttt

SEQ ID NO: 4738 - DNA, 201 bp, Homo sapiens
tacacagaaacaggtgggggcaacagtgggagagaaggggccagggtataaaaagggcccacaagagaccagctcaaggatcccaaggcccaactccccgmaccactcagggtcctgtggacagctcacctagctgcaatggctacaggctcccggacgtccctgctcctggcttttggcctgctctgcctgccctggctt

SEQ ID NO: 4739 - DNA, 201 bp, Homo sapiens
ccgcatctccctgctgctcatccagtcgtggctggagcccgtgcagttcctcaggagtgtcttcgccaacagcctggtgtacggcgcctctgacagcaacdtctatgacctcctaaaggacctagaggaaggcatccaaacgctgatgggggctggaagatggcagcccccggactgggcagatcttcaagcagacctaca

SEQ ID NO: 4740 - DNA, 157 bp, Homo sapiens
tccctgtccttctgattttaaaataactataccagcaggaggacgtccagacacagcataggctacctggccatgcccaaccggtgggacatttgagttgyttgcttggcactgtcctctcatgcgttgggtccactcagtagatgcctgttgaatt

SEQ ID NO: 4741 - DNA, 201 bp, Homo sapiens
tcagtggccccatgcataaatgtacacagaaacaggtgggggcaacagtgggagagaaggggccagggtataaaaagggcccacaagagaccagctcaagsatcccaaggcccaactccccgaaccactcagggtcctgtggacagctcacctagctgcaatggctacaggctcccggacgtccctgctcctggcttttgg

SEQ ID NO: 4742 - DNA, 201 bp, Homo sapiens
cctcctaaaggacctagaggaaggcatccaaacgctgatgggggctggaagatggcagcccccggactgggcagatcttcaagcagacctacagcaagttygacacaaactcacacaacgatgacgcactactcaagaactacgggctgctctactgcttcaggaaggacatggacaaggtcgagacattcctgcgcatcg

SEQ ID NO: 4743 - DNA, 201 bp, Homo sapiens
aacgctgatgggggctggaagatggcagcccccggactgggcagatcttcaagcagacctacagcaagttcgacacaaactcacacaacgatgacgcactrctcaagaactacgggctgctctactgcttcaggaaggacatggacaaggtcgagacattcctgcgcatcgtgcagtgccgctctgtggagggcagctgtg

SEQ ID NO: 4744 - DNA, 201 bp, Homo sapiens
acagctcacctagctgcaatggctacaggctcccggacgtccctgctcctggcttttggcctgctctgcctgccctggcttcaagagggcagtgccttccmaaccattcccttatccaggctttttgacaacgctatgctccgcgcccatcgtctgcaccagctggcctttgacacctaccaggagtttgaagaagcctat

SEQ ID NO: 4745 - DNA, 201 bp, Homo sapiens
attcctgcagaacccccagacctccctctgtttctcagagtctattccgacaccctccaacagggaggaaacacaacagaaatccaacctagagctgctcygcatctccctgctgctcatccagtcgtggctggagcccgtgcagttcctcaggagtgtcttcgccaacagcctggtgtacggcgcctctgacagcaacgt

SEQ ID NO: 4746 - DNA, 201 bp, Homo sapiens; identical to SEQ ID NO: 4721

SEQ ID NO: 4747 - DNA, 201 bp, Homo sapiens
tttaacccccagacctccctctgtttctcagagtctattccgacaccctccaacagggaggaaacacaacagaaatccaacctagagctgctccgcatctscctgctgctcatccagtcgtggctggagcccgtgcagttcctcaggagtgtcttcgccaacagcctggtgtacggcgcctctgacagcaacgtctatgac

SEQ ID NO: 4748 - DNA, 201 bp, Homo sapiens; identical to SEQ ID NO: 4723

SEQ ID NO: 4749 - DNA, 201 bp, Homo sapiens
ctgccctggcttcaagagggcagtgccttcccaaccattcccttatccaggctttttgacaacgctatgctccgcgcccatcgtctgcaccagctggcctwtgacacctaccaggagtttaacccccagacctccctctgtttctcagagtctattccgacaccctccaacagggaggaaacacaacagaaatccaaccta

SEQ ID NO: 4750 - DNA, 201 bp, Homo sapiens
gcctgccctggcttcaagagggcagtgccttcccaaccattcccttatccaggctttttgacaacgctatgctccgcgcccatcgtctgcaccagctggcmtttgacacctaccaggagtttaacccccagacctccctctgtttctcagagtctattccgacaccctccaacagggaggaaacacaacagaaatccaacc

SEQ ID NO: 4751 - DNA, 170 bp, Homo sapiens
acagtgggagagaaggggccagggtataaaaagggcccacaagagaccagctcaaggatcccaaggcccractccccgaaccactcagggtcctgtggacagctcacctagctgcaatggctacaggctcccggacgtccctgctcctggcttttggcctgctctgcctg

SEQ ID NO: 4752 - DNA, 201 bp, Homo sapiens; identical to SEQ ID NO: 4728

SEQ ID NO: 4753 - DNA, 149 bp, Homo sapiens
acagtgggagagaaggggccagggtataaaaagggcccacaagagaccrgctcaaggatcccaaggcccaactccccgaaccactcagggtcctgtggacagctcacctagctgcaatggctacaggctcccggacgtccctgctcctg

SEQ ID NO: 4754 - DNA, 201 bp, Homo sapiens
tccctgctgctcatccagtcgtggctggagcccgtgcagttcctcaggagtgtcttcgccaacagcctggtgtacggcgcctctgacagcaacgtctatgrcctcctaaaggacctagaggaaggcatccaaacgctgatggggaggctggaagatggcagcccccggactgggcagatcttcaagcagacctacagcaag

SEQ ID NO: 4755 - DNA, 201 bp, Homo sapiens
tgcagttcctcaggagtgtcttcgccaacagcctggtgtacggcgcctctgacagcaacgtctatgacctcctaaaggacctagaggaaggcatccaaacrctgatggggaggctggaagatggcagcccccggactgggcagatcttcaagcagacctacagcaagttcgacacaaactcacacaacgatgacgcactac

SEQ ID NO: 4756 - DNA, 201 bp, Homo sapiens
tagaggaaggcatccaaacgctgatggggaggctggaagatggcagcccccggactgggcagatcttcaagcagacctacagcaagttcgacacaaactcrcacaacgatgacgcactactcaagaactacgggctgctctactgcttcaggaaggacatggacaaggtcgagacattcctgcgcatcgtgcagtgccgct

SEQ ID NO: 4757 - DNA, 201 bp, Homo sapiens
acctagaggaaggcatccaaacgctgatggggaggctggaagatggcagcccccggactgggcagatcttcaagcagacctacagcaagttcgacacaaamtcacacaacgatgacgcactactcaagaactacgggctgctctactgcttcaggaaggacatggacaaggtcgagacattcctgcgcatcgtgcagtgcc

SEQ ID NO: 4758 - DNA, 154 bp, Homo sapiens
acagtgggagagaaggggccagggtataaaaagggcccacaagagaccagctchaggatcccaaggcccaactccccgaaccactcagggtcctgtggacagctcacctagctgcaatggctacaggctcccggacgtccctgctcctggcttt

SEQ ID NO: 4759 - DNA, 179 bp, Homo sapiens
acagtgggagagaaggggccagggtataaaaagggcccacaagagaccagctcaaggatcccaaggcccaactccccgmaccactcagggtcctgtggacagctcacctagctgcaatggctacaggctcccggacgtccctgctcctggcttttggcctgctctgcctgccctggctt

SEQ ID NO: 4760 - DNA, 157 bp, Homo sapiens; identical to SEQ ID NO: 4740

SEQ ID NO: 4761 - DNA, 201 bp, Homo sapiens
ccgcatctccctgctgctcatccagtcgtggctggagcccgtgcagttcctcaggagtgtcttcgccaacagcctggtgtacggcgcctctgacagcaacdtctatgacctcctaaaggacctagaggaaggcatccaaacgctgatggggaggctggaagatggcagcccccggactgggcagatcttcaagcagaccta

SEQ ID NO: 4762 - DNA, 157 bp, Homo sapiens
acagtgggagagaaggggccagggtataaaaagggcccacaagagaccagctcaagsatcccaaggcccaactccccgaaccactcagggtcctgtggacagctcacctagctgcaatggctacaggctcccggacgtccctgctcctggcttttgg

SEQ ID NO: 4763 - DNA, 201 bp, Homo sapiens
tcctaaaggacctagaggaaggcatccaaacgctgatggggaggctggaagatggcagcccccggactgggcagatcttcaagcagacctacagcaagttygacacaaactcacacaacgatgacgcactactcaagaactacgggctgctctactgcttcaggaaggacatggacaaggtcgagacattcctgcgcatcg

SEQ ID NO: 4764 - DNA, 201 bp, Homo sapiens
cgctgatggggaggctggaagatggcagcccccggactgggcagatcttcaagcagacctacagcaagttcgacacaaactcacacaacgatgacgcactrctcaagaactacgggctgctctactgcttcaggaaggacatggacaaggtcgagacattcctgcgcatcgtgcagtgccgctctgtggagggcagctgtg

SEQ ID NO: 4765 - DNA, 201 bp, Homo sapiens
ccaggagtttaacccccagacctccctctgtttctcagagtctattccgacaccctccaacagggaggaaacacaacagaaatccaacctagagctgctcygcatctccctgctgctcatccagtcgtggctggagcccgtgcagttcctcaggagtgtcttcgccaacagcctggtgtacggcgcctctgacagcaacgt

SEQ ID NO: 4766 - DNA, 201 bp, Homo sapiens
acagctcacctagctgcaatggctacaggctcccggacgtccctgctcctggcttttggcctgctctgcctgccctggcttcaagagggcagtgccttccmaaccattcccttatccaggctttttgacaacgctatgctccgcgcccatcgtctgcaccagctggcctttgacacctaccaggagtttaacccccagacc

SEQ ID NO: 4767 - DNA, 201 bp, Homo sapiens; identical to SEQ ID NO: 4721

SEQ ID NO: 4768 - DNA, 201 bp, Homo sapiens; identical to SEQ ID NO: 4722

SEQ ID NO: 4769 - DNA, 201 bp, Homo sapiens; identical to SEQ ID NO: 4723

SEQ ID NO: 4770 - DNA, 201 bp, Homo sapiens; identical to SEQ ID NO: 4724

SEQ ID NO: 4771 - DNA, 201 bp, Homo sapiens; identical to SEQ ID NO: 4725

SEQ ID NO: 4772 - DNA, 201 bp, Homo sapiens; identical to SEQ ID NO: 4726

SEQ ID NO: 4773 - DNA, 106 bp, Homo sapiens; identical to SEQ ID NO: 4727

SEQ ID NO: 4774 - DNA, 201 bp, Homo sapiens; identical to SEQ ID NO: 4728

SEQ ID NO: 4775 - DNA, 201 bp, Homo sapiens; identical to SEQ ID NO: 4729

SEQ ID NO: 4776 - DNA, 196 bp, Homo sapiens; identical to SEQ ID NO: 4730

SEQ ID NO: 4777 - DNA, 178 bp, Homo sapiens; identical to SEQ ID NO: 4731

SEQ ID NO: 4778 - DNA, 141 bp, Homo sapiens; identical to SEQ ID NO: 4732

SEQ ID NO: 4779 - DNA, 201 bp, Homo sapiens; identical to SEQ ID NO: 4754

SEQ ID NO: 4780 - DNA, 201 bp, Homo sapiens; identical to SEQ ID NO: 4738

SEQ ID NO: 4781 - DNA, 201 bp, Homo sapiens; identical to SEQ ID NO: 4737

SEQ ID NO: 4782 - DNA, 201 bp, Homo sapiens; identical to SEQ ID NO: 4755

SEQ ID NO: 4783 - DNA, 201 bp, Homo sapiens; identical to SEQ ID NO: 4756

SEQ ID NO: 4784 - DNA, 201 bp, Homo sapiens; identical to SEQ ID NO: 4757

SEQ ID NO: 4785 - DNA, 201 bp, Homo sapiens; identical to SEQ ID NO: 4761

SEQ ID NO: 4786 - DNA, 157 bp, Homo sapiens; identical to SEQ ID NO: 4740

SEQ ID NO: 4787 - DNA, 201 bp, Homo sapiens; identical to SEQ ID NO: 4763

SEQ ID NO: 4788 - DNA, 201 bp, Homo sapiens; identical to SEQ ID NO: 4741

SEQ ID NO: 4789 - DNA, 201 bp, Homo sapiens; identical to SEQ ID NO: 4764

SEQ ID NO: 4790 - DNA, 201 bp, Homo sapiens; identical to SEQ ID NO: 4745

SEQ ID NO: 4791 - DNA, 201 bp, Homo sapiens; identical to SEQ ID NO: 4744

SEQ ID NO: 4792 - DNA, 201 bp, Homo sapiens
gcctctccttctcttccttcactttgcagaggctggaagacggcagccgccggactgggcagatcctcaagcagacctacagcaagtttgacacaaactcrcacaaccatgacgcactgctcaagaactacgggctgctctactgcttcaggaaggacatggacaaggtcgagacattcctgcgcatggtgcagtgccgct

SEQ ID NO: 4793 - DNA, 201 bp, Homo sapiens
gctgatgggggtgagggtggcgccaggggtcgccaatcctggaaccccactggcttagagggctgggggagagaaacactgctgccctctttgtagcagtmaggcgctgacccaagagaactcaccttattcttcatttcgcctggtgaatcctccaggcccttctctacaccctgaaggggagggaggaaaatggatgaa

SEQ ID NO: 4794 - DNA, 201 bp, Homo sapiens
gctgggggagagaaacactgctgccctctttgtagcagtcaggcgctgacccaagagaactcaccttattcttcatttcgcctggtgaatcctccaggccyttctctacaccctgaaggggagggaggaaaatggatgaatgagagagggagggaacagtgcccaagcgcttggcctctccttctcttccttcactttgca

SEQ ID NO: 4795 - DNA, 201 bp, Homo sapiens
accatgacgcactgctcaagaactacgggctgctctactgcttcaggaaggacatggacaaggtcgagacattcctgcgcatggtgcagtgccgctctgtrgagggcagctgtggcttctaggtgcccgagtagcatcctgtgacccctccccagtgcctctcctggccctgaaggtgccactccagtgcccaccagcctt

SEQ ID NO: 4796 - DNA, 201 bp, Homo sapiens
acgcactgctcaagaactacgggctgctctactgcttcaggaaggacatggacaaggtcgagacattcctgcgcatggtgcagtgccgctctgtggagggyagctgtggcttctaggtgcccgagtagcatcctgtgacccctccccagtgcctctcctggccctgaaggtgccactccagtgcccaccagccttgtccta

SEQ ID NO: 4797 - DNA, 201 bp, Homo sapiens
ctctactgcttcaggaaggacatggacaaggtcgagacattcctgcgcatggtgcagtgccgctctgtggagggcagctgtggcttctaggtgcccgagtrgcatcctgtgacccctccccagtgcctctcctggccctgaaggtgccactccagtgcccaccagccttgtcctaataaaattaagttgtatcatttcatc

SEQ ID NO: 4798 - DNA, 201 bp, Homo sapiens
ctgctctactgcttcaggaaggacatggacaaggtcgagacattcctgcgcatggtgcagtgccgctctgtggagggcagctgtggcttctaggtgcccgmgtagcatcctgtgacccctccccagtgcctctcctggccctgaaggtgccactccagtgcccaccagccttgtcctaataaaattaagttgtatcatttc

SEQ ID NO: 4799 - DNA, 201 bp, Homo sapiens; identical to SEQ ID NO: 4795

SEQ ID NO: 4800 - DNA, 201 bp, Homo sapiens; identical to SEQ ID NO: 4796

SEQ ID NO: 4801 - DNA, 199 bp, Homo sapiens
ctctactgcttcaggaaggacatggacaaggtcgagacattcctgcgcatggtgcagtgccgctctgtggagggcagctgtggcttctaggtgcccgagtrgcatcctgtgacccctccccagtgcctctcctggccctgaaggtgccactccagtgcccaccagccttgtcctaataaaattaagttgtatcatttca

SEQ ID NO: 4802 - DNA, 201 bp, Homo sapiens
cctggtgtatgacacctcggacagcgatgactatcacctcctaaaggacctagaggaaggcatccaaacgctgatgggggtgagggtggcgccaggggtcrccaatcctggaaccccactggcttcgagggctgggggagagaaatactgctgccctctttttagcagtaaggcgctgacccaagagaactcaccttattc

SEQ ID NO: 4803 - DNA, 201 bp, Homo sapiens; identical to SEQ ID NO: 4798

SEQ ID NO: 4804 - DNA, 201 bp, Homo sapiens
gatgactatcacctcctaaaggacctagaggaaggcatccaaacgctgatgggggtgagggtggcgccaggggtcaccaatcctggaaccccactggcttmgagggctgggggagagaaatactgctgccctctttttagcagtaaggcgctgacccaagagaactcaccttattcttcatttcgcctggtgaatcctcca

SEQ ID NO: 4805 - DNA, 201 bp, Homo sapiens
ggacctagaggaaggcatccaaacgctgatgggggtgagggtggcgccaggggtcaccaatcctggaaccccactggcttcgagggctgggggagagaaayactgctgccctctttttagcagtaaggcgctgacccaagagaactcaccttattcttcatttcgcctggtgaatcctccaggcctttctctacaccctga

SEQ ID NO: 4806 - DNA, 201 bp, Homo sapiens
atccaaacgctgatgggggtgagggtggcgccaggggtcaccaatcctggaaccccactggcttcgagggctgggggagagaaatactgctgccctctttktagcagtaaggcgctgacccaagagaactcaccttattcttcatttcgcctggtgaatcctccaggcctttctctacaccctgaaggggagggaggaaaa

SEQ ID NO: 4807 - DNA, 201 bp, Homo sapiens
gctgatgggggtgagggtggcgccaggggtcaccaatcctggaaccccactggcttcgagggctgggggagagaaatactgctgccctctttttagcagtmaggcgctgacccaagagaactcaccttattcttcatttcgcctggtgaatcctccaggcctttctctacaccctgaaggggagggaggaaaatggataaa

SEQ ID NO: 4808 - DNA, 201 bp, Homo sapiens
gtaaggcgctgacccaagagaactcaccttattcttcatttcgcctggtgaatcctccaggcctttctctacaccctgaaggggagggaggaaaatggatraatgagagagggagggaacagtgcccaagcgcttggcctctccttctcttccttcactttgcagaggctggaagacggcagccgccggactgggcagatc

SEQ ID NO: 4809 - DNA, 201 bp, Homo sapiens; identical to SEQ ID NO: 4714

SEQ ID NO: 4810 - DNA, 201 bp, Homo sapiens; identical to SEQ ID NO: 4715

SEQ ID NO: 4811 - DNA, 201 bp, Homo sapiens; identical to SEQ ID NO: 4716

SEQ ID NO: 4812 - DNA, 201 bp, Homo sapiens; identical to SEQ ID NO: 4717

SEQ ID NO: 4813 - DNA, 201 bp, Homo sapiens; identical to SEQ ID NO: 4718

SEQ ID NO: 4814 - DNA, 201 bp, Homo sapiens; identical to SEQ ID NO: 4719

SEQ ID NO: 4815 - DNA, 201 bp, Homo sapiens; identical to SEQ ID NO: 4720

SEQ ID NO: 4816 - DNA, 201 bp, Homo sapiens
tagaggaaggcatccaaacgctgatggggaggctggaagacggcagccgccggactgggcagatcctcaagcagacctacagcaagtttgacacaaactcrcacaaccatgacgcactgctcaagaactacgggctgctctactgcttcaggaaggacatggacaaggtcgagacattcctgcgcatggtgcagtgccgct

SEQ ID NO: 4817 - DNA, 201 bp, Homo sapiens; identical to SEQ ID NO: 4721

SEQ ID NO: 4818 - DNA, 201 bp, Homo sapiens; identical to SEQ ID NO: 4722

SEQ ID NO: 4819 - DNA, 201 bp, Homo sapiens; identical to SEQ ID NO: 4723

SEQ ID NO: 4820 - DNA, 201 bp, Homo sapiens
cccactgactttgagagctgtgttagagaaacactgctgccctctttttagcagtcaggccctgacccaagagaactcaccttattcttcatttcccctcrtgaatcctccaggcctttctctacaccctgaaggggagggaggaaaatgaatgaatgagaaagggagggaacagtacccaagcgcttggcctctccttct

SEQ ID NO: 4821 - DNA, 201 bp, Homo sapiens
gctgtgttagagaaacactgctgccctctttttagcagtcaggccctgacccaagagaactcaccttattcttcatttcccctcgtgaatcctccaggccwttctctacaccctgaaggggagggaggaaaatgaatgaatgagaaagggagggaacagtacccaagcgcttggcctctccttctcttccttcactttgca

SEQ ID NO: 4822 - DNA, 201 bp, Homo sapiens; identical to SEQ ID NO: 4724

SEQ ID NO: 4823 - DNA, 201 bp, Homo sapiens; identical to SEQ ID NO: 4725

SEQ ID NO: 4824 - DNA, 201 bp, Homo sapiens; identical to SEQ ID NO: 4726

SEQ ID NO: 4825 - DNA, 106 bp, Homo sapiens; identical to SEQ ID NO: 4727

SEQ ID NO: 4826 - DNA, 201 bp, Homo sapiens; identical to SEQ ID NO: 4728

SEQ ID NO: 4827 - DNA, 201 bp, Homo sapiens; identical to SEQ ID NO: 4729

SEQ ID NO: 4828 - DNA, 196 bp, Homo sapiens; identical to SEQ ID NO: 4730

SEQ ID NO: 4829 - DNA, 178 bp, Homo sapiens; identical to SEQ ID NO: 4731

SEQ ID NO: 4830 - DNA, 201 bp, Homo sapiens
cgctgatgggggtgagggtggcgccaggggtccccaatcctggagccccactgactttgagagctgtgttagagaaacactgctgccctctttttagcagwcaggccctgacccaagagaactcaccttattcttcatttcccctcgtgaatcctccaggcctttctctacaccctgaaggggagggaggaaaatgaatga

SEQ ID NO: 4831 - DNA, 141 bp, Homo sapiens; identical to SEQ ID NO: 4732

SEQ ID NO: 4832 - DNA, 201 bp, Homo sapiens
tccctgctgctcatccagtcgtggctggagcccgtgcagttcctcaggagtgtcttcgccaacagcctggtgtacggcgcctctgacagcaacgtctatgrcctcctaaaggacctagaggaaggcatccaaacgctgatgggggtgagggtggcgccaggggtccccaatcctggagccccactgactttgagagctgtg

SEQ ID NO: 4833 - DNA, 201 bp, Homo sapiens
tgcagttcctcaggagtgtcttcgccaacagcctggtgtacggcgcctctgacagcaacgtctatgacctcctaaaggacctagaggaaggcatccaaacrctgatgggggtgagggtggcgccaggggtccccaatcctggagccccactgactttgagagctgtgttagagaaacactgctgccctctttttagcagtc

SEQ ID NO: 4834 - DNA, 201 bp, Homo sapiens; identical to SEQ ID NO: 4737

SEQ ID NO: 4835 - DNA, 201 bp, Homo sapiens; identical to SEQ ID NO: 4738

SEQ ID NO: 4836 - DNA, 201 bp, Homo sapiens
gcctctccttctcttccttcactttgcagaggctggaagatggcagcccccggactgggcagatcttcaagcagacctacagcaagttcgacacaaactcrcacaacgatgacgcactactcaagaactacgggctgctctactgcttcaggaaggacatggacaaggtcgagacattcctgcgcatcgtgcagtgccgct

SEQ ID NO: 4837 - DNA, 201 bp, Homo sapiens
ttggcctctccttctcttccttcactttgcagaggctggaagatggcagcccccggactgggcagatcttcaagcagacctacagcaagttcgacacaaamtcacacaacgatgacgcactactcaagaactacgggctgctctactgcttcaggaaggacatggacaaggtcgagacattcctgcgcatcgtgcagtgcc

SEQ ID NO: 4838 - DNA, 201 bp, Homo sapiens
cagcctggtgtacggcgcctctgacagcaacgtctatgacctcctaaaggacctagaggaaggcatccaaacgctgatgggggtgagggtggcgccagggktccccaatcctggagccccactgactttgagagctgtgttagagaaacactgctgccctctttttagcagtcaggccctgacccaagagaactcacctta

SEQ ID NO: 4839 - DNA, 201 bp, Homo sapiens
ccgcatctccctgctgctcatccagtcgtggctggagcccgtgcagttcctcaggagtgtcttcgccaacagcctggtgtacggcgcctctgacagcaacdtctatgacctcctaaaggacctagaggaaggcatccaaacgctgatgggggtgagggtggcgccaggggtccccaatcctggagccccactgactttgag

SEQ ID NO: 4840 - DNA, 157 bp, Homo sapiens; identical to SEQ ID NO: 4740

SEQ ID NO: 4841 - DNA, 201 bp, Homo sapiens
acctcctaaaggacctagaggaaggcatccaaacgctgatgggggtgagggtggcgccaggggtccccaatcctggagccccactgactttgagagctgtrttagagaaacactgctgccctctttttagcagtcaggccctgacccaagagaactcaccttattcttcatttcccctcgtgaatcctccaggcctttctc

SEQ ID NO: 4842 - DNA, 201 bp, Homo sapiens; identical to SEQ ID NO: 4741

SEQ ID NO: 4843 - DNA, 201 bp, Homo sapiens
cccaagcgcttggcctctccttctcttccttcactttgcagaggctggaagatggcagcccccggactgggcagatcttcaagcagacctacagcaagttygacacaaactcacacaacgatgacgcactactcaagaactacgggctgctctactgcttcaggaaggacatggacaaggtcgagacattcctgcgcatcg

SEQ ID NO: 4844 - DNA, 201 bp, Homo sapiens
tcactttgcagaggctggaagatggcagcccccggactgggcagatcttcaagcagacctacagcaagttcgacacaaactcacacaacgatgacgcactrctcaagaactacgggctgctctactgcttcaggaaggacatggacaaggtcgagacattcctgcgcatcgtgcagtgccgctctgtggagggcagctgtg

SEQ ID NO: 4845 - DNA, 201 bp, Homo sapiens; identical to SEQ ID NO: 4745

SEQ ID NO: 4846 - DNA, 201 bp, Homo sapiens; identical to SEQ ID NO: 4744

SEQ ID NO: 4847 - DNA, 201 bp, Homo sapiens; identical to SEQ ID NO: 4795

SEQ ID NO: 4848 - DNA, 201 bp, Homo sapiens; identical to SEQ ID NO: 4796

SEQ ID NO: 4849 - DNA, 201 bp, Homo sapiens; identical to SEQ ID NO: 4797

SEQ ID NO: 4850 - DNA, 201 bp, Homo sapiens; identical to SEQ ID NO: 4798

SEQ ID NO: 4851 - DNA, 201 bp, Homo sapiens; identical to SEQ ID NO: 4715

SEQ ID NO: 4852 - DNA, 182 bp, Homo sapiens
gaaggacatggacaaggtcgagacattcctgcgcatggtgcagtgccgctctgtggagggcagctgtggcttctaggggcccgcgtggcatcctgtgaccyctccccagtgcctctcctggccctgaaggtgccactccagtgcccaccagccttgtcctaataaaattaagttgtattgtt

SEQ ID NO: 4853 - DNA, 124 bp, Homo sapiens
ggcagctgtggcttctaggggcccgcgtggcatcctgtgacccctccccagtgcctctcctggccctgaaggtgccactccagtgcccaccagccttgtcytaataaaattaagttgtattgtt

SEQ ID NO: 4854 - DNA, 201 bp, Homo sapiens; identical to SEQ ID NO: 4720

SEQ ID NO: 4855 - DNA, 201 bp, Homo sapiens; identical to SEQ ID NO: 4721

SEQ ID NO: 4856 - DNA, 201 bp, Homo sapiens; identical to SEQ ID NO: 4723

SEQ ID NO: 4857 - DNA, 201 bp, Homo sapiens
ctgccctggcttcaagagggcagtgccttcccaaccattcccttatccaggctttttgacaacgctatgctccgcgcccatcgtctgcaccagctggcctwtgacacctaccaggagtttaggctggaagatggcagcccccggactgggcagatcttcaagcagacctacagcaagttcgacacaaactcacacaacgat

SEQ ID NO: 4858 - DNA, 149 bp, Homo sapiens; identical to SEQ ID NO: 4753

SEQ ID NO: 4859 - DNA, 201 bp, Homo sapiens
gcctgccctggcttcaagagggcagtgccttcccaaccattcccttatccaggctttttgacaacgctatgctccgcgcccatcgtctgcaccagctggcmtttgacacctaccaggagtttaggctggaagatggcagcccccggactgggcagatcttcaagcagacctacagcaagttcgacacaaactcacacaacg

SEQ ID NO: 4860 - DNA, 170 bp, Homo sapiens; identical to SEQ ID NO: 4751

SEQ ID NO: 4861 - DNA, 179 bp, Homo sapiens; identical to SEQ ID NO: 4759

SEQ ID NO: 4862 - DNA, 154 bp, Homo sapiens; identical to SEQ ID NO: 4758

SEQ ID NO: 4863 - DNA, 201 bp, Homo sapiens
agctggcctttgacacctaccaggagtttaggctggaagatggcagcccccggactgggcagatcttcaagcagacctacagcaagttcgacacaaactcrcacaacgatgacgcactactcaagaactacgggctgctctactgcttcaggaaggacatggacaaggtcgagacattcctgcgcatcgtgcagtgccgct

SEQ ID NO: 4864 - DNA, 201 bp, Homo sapiens
accagctggcctttgacacctaccaggagtttaggctggaagatggcagcccccggactgggcagatcttcaagcagacctacagcaagttcgacacaaamtcacacaacgatgacgcactactcaagaactacgggctgctctactgcttcaggaaggacatggacaaggtcgagacattcctgcgcatcgtgcagtgcc

SEQ ID NO: 4865 - DNA, 157 bp, Homo sapiens; identical to SEQ ID NO: 4740

SEQ ID NO: 4866 - DNA, 201 bp, Homo sapiens
atcgtctgcaccagctggcctttgacacctaccaggagtttaggctggaagatggcagcccccggactgggcagatcttcaagcagacctacagcaagttygacacaaactcacacaacgatgacgcactactcaagaactacgggctgctctactgcttcaggaaggacatggacaaggtcgagacattcctgcgcatcg

SEQ ID NO: 4867 - DNA, 157 bp, Homo sapiens; identical to SEQ ID NO: 4762

SEQ ID NO: 4868 - DNA, 201 bp, Homo sapiens
accaggagtttaggctggaagatggcagcccccggactgggcagatcttcaagcagacctacagcaagttcgacacaaactcacacaacgatgacgcactrctcaagaactacgggctgctctactgcttcaggaaggacatggacaaggtcgagacattcctgcgcatcgtgcagtgccgctctgtggagggcagctgtg

SEQ ID NO: 4869 - DNA, 201 bp, Homo sapiens
acagctcacctagctgcaatggctacaggctcccggacgtccctgctcctggcttttggcctgctctgcctgccctggcttcaagagggcagtgccttccmaaccattcccttatccaggctttttgacaacgctatgctccgcgcccatcgtctgcaccagctggcctttgacacctaccaggagtttaggctggaagat

SEQ ID NO: 4870 - DNA, 201 bp, Homo sapiens; identical to SEQ ID NO: 4721

SEQ ID NO: 4871 - DNA, 201 bp, Homo sapiens; identical to SEQ ID NO: 4747

SEQ ID NO: 4872 - DNA, 201 bp, Homo sapiens; identical to SEQ ID NO: 4723

SEQ ID NO: 4873 - DNA, 201 bp, Homo sapiens; identical to SEQ ID NO: 4749

SEQ ID NO: 4874 - DNA, 201 bp, Homo sapiens; identical to SEQ ID NO: 4750

SEQ ID NO: 4875 - DNA, 201 bp, Homo sapiens; identical to SEQ ID NO: 4726

SEQ ID NO: 4876 - DNA, 106 bp, Homo sapiens; identical to SEQ ID NO: 4727

SEQ ID NO: 4877 - DNA, 201 bp, Homo sapiens; identical to SEQ ID NO: 4728

SEQ ID NO: 4878 - DNA, 201 bp, Homo sapiens; identical to SEQ ID NO: 4729

SEQ ID NO: 4879 - DNA, 196 bp, Homo sapiens; identical to SEQ ID NO: 4730

SEQ ID NO: 4880 - DNA, 178 bp, Homo sapiens; identical to SEQ ID NO: 4731

SEQ ID NO: 4881 - DNA, 141 bp, Homo sapiens; identical to SEQ ID NO: 4732

SEQ ID NO: 4882 - DNA, 201 bp, Homo sapiens; identical to SEQ ID NO: 4754

SEQ ID NO: 4883 - DNA, 201 bp, Homo sapiens; identical to SEQ ID NO: 4738

SEQ ID NO: 4884 - DNA, 201 bp, Homo sapiens; identical to SEQ ID NO: 4737

SEQ ID NO: 4885 - DNA, 201 bp, Homo sapiens; identical to SEQ ID NO: 4755

SEQ ID NO: 4886 - DNA, 201 bp, Homo sapiens; identical to SEQ ID NO: 4756

SEQ ID NO: 4887 - DNA, 201 bp, Homo sapiens; identical to SEQ ID NO: 4757

SEQ ID NO: 4888 - DNA, 201 bp, Homo sapiens; identical to SEQ ID NO: 4761

SEQ ID NO: 4889 - DNA, 157 bp, Homo sapiens; identical to SEQ ID NO: 4740

SEQ ID NO: 4890 - DNA, 201 bp, Homo sapiens; identical to SEQ ID NO: 4763

SEQ ID NO: 4891 - DNA, 201 bp, Homo sapiens; identical to SEQ ID NO: 4741

SEQ ID NO: 4892 - DNA, 201 bp, Homo sapiens; identical to SEQ ID NO: 4764

SEQ ID NO: 4893 - DNA, 201 bp, Homo sapiens; identical to SEQ ID NO: 4765

SEQ ID NO: 4894 - DNA, 201 bp, Homo sapiens; identical to SEQ ID NO: 4766

SEQ ID NO: 4895 - DNA, 201 bp, Homo sapiens; identical to SEQ ID NO: 4715

SEQ ID NO: 4896 - DNA, 182 bp, Homo sapiens; identical to SEQ ID NO: 4852

SEQ ID NO: 4897 - DNA, 124 bp, Homo sapiens; identical to SEQ ID NO: 4853

SEQ ID NO: 4898 - DNA, 201 bp, Homo sapiens; identical to SEQ ID NO: 4720

SEQ ID NO: 4899 - DNA, 201 bp, Homo sapiens; identical to SEQ ID NO: 4721

SEQ ID NO: 4900 - DNA, 201 bp, Homo sapiens; identical to SEQ ID NO: 4723

SEQ ID NO: 4901 - DNA, 201 bp, Homo sapiens; identical to SEQ ID NO: 4857

SEQ ID NO: 4902 - DNA, 201 bp, Homo sapiens; identical to SEQ ID NO: 4859

SEQ ID NO: 4903 - DNA, 201 bp, Homo sapiens; identical to SEQ ID NO: 4726

SEQ ID NO: 4904 - DNA, 106 bp, Homo sapiens; identical to SEQ ID NO: 4727

SEQ ID NO: 4905 - DNA, 201 bp, Homo sapiens; identical to SEQ ID NO: 4729

SEQ ID NO: 4906 - DNA, 196 bp, Homo sapiens; identical to SEQ ID NO: 4730

SEQ ID NO: 4907 - DNA, 178 bp, Homo sapiens; identical to SEQ ID NO: 4731

SEQ ID NO: 4908 - DNA, 141 bp, Homo sapiens; identical to SEQ ID NO: 4732

SEQ ID NO: 4909 - DNA, 201 bp, Homo sapiens; identical to SEQ ID NO: 4864

SEQ ID NO: 4910 - DNA, 201 bp, Homo sapiens; identical to SEQ ID NO: 4863

SEQ ID NO: 4911 - DNA, 201 bp, Homo sapiens; identical to SEQ ID NO: 4737

SEQ ID NO: 4912 - DNA, 201 bp, Homo sapiens; identical to SEQ ID NO: 4738

SEQ ID NO: 4913 - DNA, 157 bp, Homo sapiens; identical to SEQ ID NO: 4740

SEQ ID NO: 4914 - DNA, 201 bp, Homo sapiens; identical to SEQ ID NO: 4741

SEQ ID NO: 4915 - DNA, 201 bp, Homo sapiens; identical to SEQ ID NO: 4866

SEQ ID NO: 4916 - DNA, 201 bp, Homo sapiens; identical to SEQ ID NO: 4868

SEQ ID NO: 4917 - DNA, 201 bp, Homo sapiens; identical to SEQ ID NO: 4869

SEQ ID NO: 4918 - DNA, 201 bp, Homo sapiens; identical to SEQ ID NO: 4816

SEQ ID NO: 4919 - DNA, 201 bp, Homo sapiens; identical to SEQ ID NO: 4721

SEQ ID NO: 4920 - DNA, 201 bp, Homo sapiens
ttatccaggctttttgacaacgctatgctccgcgcccatcgtctgcaccagctggcctttgacacctaccaggagtttaacctagagctgctccgcatctscctgctgctcatccagtcgtggctggagcccgtgcagttcctcaggagtgtcttcgccaacagcctggtgtacggcgcctctgacagcaacgtctatgac

SEQ ID NO: 4921 - DNA, 201 bp, Homo sapiens; identical to SEQ ID NO: 4723

SEQ ID NO: 4922 - DNA, 201 bp, Homo sapiens
ctgccctggcttcaagagggcagtgccttcccaaccattcccttatccaggctttttgacaacgctatgctccgcgcccatcgtctgcaccagctggcctwtgacacctaccaggagtttaacctagagctgctccgcatctccctgctgctcatccagtcgtggctggagcccgtgcagttcctcaggagtgtcttcgcc

SEQ ID NO: 4923 - DNA, 201 bp, Homo sapiens
gcctgccctggcttcaagagggcagtgccttcccaaccattcccttatccaggctttttgacaacgctatgctccgcgcccatcgtctgcaccagctggcmtttgacacctaccaggagtttaacctagagctgctccgcatctccctgctgctcatccagtcgtggctggagcccgtgcagttcctcaggagtgtcttcg

SEQ ID NO: 4924 - DNA, 201 bp, Homo sapiens; identical to SEQ ID NO: 4726

SEQ ID NO: 4925 - DNA, 106 bp, Homo sapiens; identical to SEQ ID NO: 4727

SEQ ID NO: 4926 - DNA, 201 bp, Homo sapiens
cgcgcccatcgtctgcaccagctggcctttgacacctaccaggagtttaacctagagctgctccgcatctccctgctgctcatccagtcgtggctggagcycgtgcagttcctcaggagtgtcttcgccaacagcctggtgtacggcgcctctgacagcaacgtctatgacctcctaaaggacctagaggaaggcatccaa

SEQ ID NO: 4927 - DNA, 201 bp, Homo sapiens; identical to SEQ ID NO: 4729

SEQ ID NO: 4928 - DNA, 196 bp, Homo sapiens; identical to SEQ ID NO: 4730

SEQ ID NO: 4929 - DNA, 178 bp, Homo sapiens; identical to SEQ ID NO: 4731

SEQ ID NO: 4930 - DNA, 141 bp, Homo sapiens; identical to SEQ ID NO: 4732

SEQ ID NO: 4931 - DNA, 201 bp, Homo sapiens; identical to SEQ ID NO: 4754

SEQ ID NO: 4932 - DNA, 201 bp, Homo sapiens; identical to SEQ ID NO: 4738

SEQ ID NO: 4933 - DNA, 201 bp, Homo sapiens; identical to SEQ ID NO: 4737

SEQ ID NO: 4934 - DNA, 201 bp, Homo sapiens; identical to SEQ ID NO: 4755

SEQ ID NO: 4935 - DNA, 201 bp, Homo sapiens; identical to SEQ ID NO: 4756

SEQ ID NO: 4936 - DNA, 201 bp, Homo sapiens; identical to SEQ ID NO: 4757

SEQ ID NO: 4937 - DNA, 201 bp, Homo sapiens; identical to SEQ ID NO: 4761

SEQ ID NO: 4938 - DNA, 157 bp, Homo sapiens; identical to SEQ ID NO: 4740

SEQ ID NO: 4939 - DNA, 201 bp, Homo sapiens; identical to SEQ ID NO: 4763

SEQ ID NO: 4940 - DNA, 201 bp, Homo sapiens; identical to SEQ ID NO: 4741

SEQ ID NO: 4941 - DNA, 201 bp, Homo sapiens; identical to SEQ ID NO: 4764

SEQ ID NO: 4942 - DNA, 201 bp, Homo sapiens
cattcccttatccaggctttttgacaacgctatgctccgcgcccatcgtctgcaccagctggcctttgacacctaccaggagtttaacctagagctgctcygcatctccctgctgctcatccagtcgtggctggagcccgtgcagttcctcaggagtgtcttcgccaacagcctggtgtacggcgcctctgacagcaacgt

SEQ ID NO: 4943 - DNA, 201 bp, Homo sapiens
acagctcacctagctgcaatggctacaggctcccggacgtccctgctcctggcttttggcctgctctgcctgccctggcttcaagagggcagtgccttccmaaccattcccttatccaggctttttgacaacgctatgctccgcgcccatcgtctgcaccagctggcctttgacacctaccaggagtttaacctagagctg

SEQ ID NO: 4944 - DNA, 201 bp, Homo sapiens; identical to SEQ ID NO: 4795

SEQ ID NO: 4945 - DNA, 201 bp, Homo sapiens; identical to SEQ ID NO: 4796

SEQ ID NO: 4946 - DNA, 199 bp, Homo sapiens; identical to SEQ ID NO: 4801

SEQ ID NO: 4947 - DNA, 201 bp, Homo sapiens; identical to SEQ ID NO: 4802

SEQ ID NO: 4948 - DNA, 201 bp, Homo sapiens; identical to SEQ ID NO: 4798

SEQ ID NO: 4949 - DNA, 201 bp, Homo sapiens; identical to SEQ ID NO: 4804

SEQ ID NO: 4950 - DNA, 201 bp, Homo sapiens; identical to SEQ ID NO: 4805

SEQ ID NO: 4951 - DNA, 201 bp, Homo sapiens; identical to SEQ ID NO: 4806

SEQ ID NO: 4952 - DNA, 201 bp, Homo sapiens; identical to SEQ ID NO: 4807

SEQ ID NO: 4953 - DNA, 201 bp, Homo sapiens; identical to SEQ ID NO: 4808

SEQ ID NO: 4954 - DNA, 177 bp, Homo sapiens
tggacaaggtcgagacattcctgcgcatcgtgcagtgccgctctgtggagggcagctgtggcttctagctgcccgggtggcatccctgtgacccctccccmgtgcctctcctggtcgtggaaggtgctactccagtgcccaccagccttgtcctaataaaattaagttgcatcattt

SEQ ID NO: 4955 - DNA, 201 bp, Homo sapiens; identical to SEQ ID NO: 4706

SEQ ID NO: 4956 - DNA, 176 bp, Homo sapiens
ggacaaggtcgagacattcctgcgcatcgtgcagtgccgctctgtggagggcagctgtggcttctagctgcccgggtggcatccctgtgacccctccccastgcctctcctggtcgtggaaggtgctactccagtgcccaccagccttgtcctaataaaattaagttgcatcattt

SEQ ID NO: 4957 - DNA, 201 bp, Homo sapiens
gcagtgccttcccaaccattcccttatccaggctttttgacaacgctatgctccgcgcccgtcgcctgtaccagctggcatatgacacctatcaggagttrgaagaagcctatatcctgaaggagcagaagtattcattcctgcagaacccccagacctccctctgcttctcagagtctattccaacaccttccaacaggg

SEQ ID NO: 4958 - DNA, 139 bp, Homo sapiens
cgctctgtggagggcagctgtggcttctagctgcccgggtggcatccctgtgacccctccccagtgcctctcctggtcgtggaaggtgctactccagtgcmcaccagccttgtcctaataaaattaagttgcatcattt

SEQ ID NO: 4959 - DNA, 201 bp, Homo sapiens
cactgctgccctctttttagcagtcaggcgctgacccaagagaactcaccgtattcttcatttcccctcgtgaatcctccaggcctttctctacaacctgraggggagggaggaaaatggatgaatgagagagggagggaacagtgcccaagcgcttggcctctccttctcttccttcactttgcagaggctggaagatgg

SEQ ID NO: 4960 - DNA, 201 bp, Homo sapiens
tgccctctttttagcagtcaggcgctgacccaagagaactcaccgtattcttcatttcccctcgtgaatcctccaggcctttctctacaacctggaggggrgggaggaaaatggatgaatgagagagggagggaacagtgcccaagcgcttggcctctccttctcttccttcactttgcagaggctggaagatggcagccc

SEQ ID NO: 4961 - DNA, 201 bp, Homo sapiens
atcctccaggcctttctctacaacctggaggggagggaggaaaatggatgaatgagagagggagggaacagtgcccaagcgcttggcctctccttctcttscttcactttgcagaggctggaagatggcagcccccggactgggcagatcttcaatcagtcctacagcaagtttgacacaaaatcgcacaacgatgacgca

SEQ ID NO: 4962 - DNA, 162 bp, Homo sapiens
cattcctgcgcatcgtgcagtgccgctctgtggagggcagctgtggcttctagctgcccgggtggcatccctgtgacccctccccagtgcctctcctggtsgtggaaggtgctactccagtgcccaccagccttgtcctaataaaattaagttgcatcattt

SEQ ID NO: 4963 - DNA, 195 bp, Homo sapiens
acatgcagagaaacaggtgaggagaagcagcgagagagaaggggccaggtataaaaagggcccacaagagaccagctcaaggatcccaaggcccractccccgaaccactcagggtcctgtggacagctcacctagcggcaatggctgcaggctcccggacgtccctgctcctggcttttggcctgctctgcctg

SEQ ID NO: 4964 - DNA, 182 bp, Homo sapiens; identical to SEQ ID NO: 4852

SEQ ID NO: 4965 - DNA, 124 bp, Homo sapiens; identical to SEQ ID NO: 4853

SEQ ID NO: 4966 - DNA, 201 bp, Homo sapiens; identical to SEQ ID NO: 4721

SEQ ID NO: 4967 - DNA, 201 bp, Homo sapiens; identical to SEQ ID NO: 4722

SEQ ID NO: 4968 - DNA, 201 bp, Homo sapiens; identical to SEQ ID NO: 4723

SEQ ID NO: 4969 - DNA, 201 bp, Homo sapiens; identical to SEQ ID NO: 4724

SEQ ID NO: 4970 - DNA, 201 bp, Homo sapiens; identical to SEQ ID NO: 4725

SEQ ID NO: 4971 - DNA, 201 bp, Homo sapiens; identical to SEQ ID NO: 4726

SEQ ID NO: 4972 - DNA, 106 bp, Homo sapiens; identical to SEQ ID NO: 4727

SEQ ID NO: 4973 - DNA, 201 bp, Homo sapiens; identical to SEQ ID NO: 4728

SEQ ID NO: 4974 - DNA, 201 bp, Homo sapiens; identical to SEQ ID NO: 4729

SEQ ID NO: 4975 - DNA, 196 bp, Homo sapiens; identical to SEQ ID NO: 4730

SEQ ID NO: 4976 - DNA, 178 bp, Homo sapiens; identical to SEQ ID NO: 4731

SEQ ID NO: 4977 - DNA, 141 bp, Homo sapiens; identical to SEQ ID NO: 4732

SEQ ID NO: 4978 - DNA, 201 bp, Homo sapiens; identical to SEQ ID NO: 4754

SEQ ID NO: 4979 - DNA, 201 bp, Homo sapiens; identical to SEQ ID NO: 4738

SEQ ID NO: 4980 - DNA, 201 bp, Homo sapiens; identical to SEQ ID NO: 4737

SEQ ID NO: 4981 - DNA, 201 bp, Homo sapiens; identical to SEQ ID NO: 4755

SEQ ID NO: 4982 - DNA, 201 bp, Homo sapiens; identical to SEQ ID NO: 4756

SEQ ID NO: 4983 - DNA, 201 bp, Homo sapiens; identical to SEQ ID NO: 4757

SEQ ID NO: 4984 - DNA, 201 bp, Homo sapiens; identical to SEQ ID NO: 4761

SEQ ID NO: 4985 - DNA, 157 bp, Homo sapiens; identical to SEQ ID NO: 4740

SEQ ID NO: 4986 - DNA, 201 bp, Homo sapiens; identical to SEQ ID NO: 4763

SEQ ID NO: 4987 - DNA, 201 bp, Homo sapiens; identical to SEQ ID NO: 4741

SEQ ID NO: 4988 - DNA, 201 bp, Homo sapiens; identical to SEQ ID NO: 4764

SEQ ID NO: 4989 - DNA, 201 bp, Homo sapiens; identical to SEQ ID NO: 4745

SEQ ID NO: 4990 - DNA, 201 bp, Homo sapiens; identical to SEQ ID NO: 4744

SEQ ID NO: 4991 - DNA, 201 bp, Homo sapiens; identical to SEQ ID NO: 4715

SEQ ID NO: 4992 - DNA, 182 bp, Homo sapiens; identical to SEQ ID NO: 4852

SEQ ID NO: 4993 - DNA, 124 bp, Homo sapiens; identical to SEQ ID NO: 4853

SEQ ID NO: 4994 - DNA, 201 bp, Homo sapiens; identical to SEQ ID NO: 4720

SEQ ID NO: 4995 - DNA, 201 bp, Homo sapiens
agctggccattgacacctaccaggagtttaggctggaagacggcagccgccggactgggcagatcctcaagcagacctacagcaagtttgacacaaactcrcacaaccatgacgcactgctcaagaactacgggctgctctactgcttcaggaaggacatggacaaggtcgagacattcctgcgcatggtgcagtgccgct

SEQ ID NO: 4996 - DNA, 201 bp, Homo sapiens; identical to SEQ ID NO: 4715

SEQ ID NO: 4997 - DNA, 182 bp, Homo sapiens; identical to SEQ ID NO: 4852

SEQ ID NO: 4998 - DNA, 124 bp, Homo sapiens; identical to SEQ ID NO: 4853

SEQ ID NO: 4999 - DNA, 201 bp, Homo sapiens; identical to SEQ ID NO: 4720

SEQ ID NO: 5000 - DNA, 201 bp, Homo sapiens; identical to SEQ ID NO: 4722

SEQ ID NO: 5001 - DNA, 150 bp, Homo sapiens; identical to SEQ ID NO: 4704

SEQ ID NO: 5002 - DNA, 140 bp, Homo sapiens; identical to SEQ ID NO: 4705

SEQ ID NO: 5003 - DNA, 201 bp, Homo sapiens; identical to SEQ ID NO: 4724

SEQ ID NO: 5004 - DNA, 163 bp, Homo sapiens
ggaaggacatggacaaggtcgagacattcctgcgcatcgtgcagtgccgctctgtggagggcagctgtggcttctagctgcccggtggcatcctgtgaccyctccccagtgcctctcctggccctgaaggtgccactccagtgcccaccagccttgtcctaat

SEQ ID NO: 5005 - DNA, 201 bp, Homo sapiens; identical to SEQ ID NO: 4725

SEQ ID NO: 5006 - DNA, 201 bp, Homo sapiens; identical to SEQ ID NO: 4711

SEQ ID NO: 5007 - DNA, 201 bp, Homo sapiens; identical to SEQ ID NO: 4728

SEQ ID NO: 5008 - DNA, 201 bp, Homo sapiens; identical to SEQ ID NO: 4709

SEQ ID NO: 5009 - DNA, 201 bp, Homo sapiens; identical to SEQ ID NO: 4754

SEQ ID NO: 5010 - DNA, 201 bp, Homo sapiens; identical to SEQ ID NO: 4755

SEQ ID NO: 5011 - DNA, 201 bp, Homo sapiens; identical to SEQ ID NO: 4756

SEQ ID NO: 5012 - DNA, 201 bp, Homo sapiens; identical to SEQ ID NO: 4757

SEQ ID NO: 5013 - DNA, 106 bp, Homo sapiens; identical to SEQ ID NO: 4710

SEQ ID NO: 5014 - DNA, 201 bp, Homo sapiens; identical to SEQ ID NO: 4761

SEQ ID NO: 5015 - DNA, 105 bp, Homo sapiens
gggcagctgtggcttctagctgcccggtggcatcctgtgacccctccccagtgcctctcctggccctgaaggtgccactccagtgcccaccagccttgtcytaat

SEQ ID NO: 5016 - DNA, 201 bp, Homo sapiens; identical to SEQ ID NO: 4763

SEQ ID NO: 5017 - DNA, 201 bp, Homo sapiens; identical to SEQ ID NO: 4764

SEQ ID NO: 5018 - DNA, 201 bp, Homo sapiens; identical to SEQ ID NO: 4712

SEQ ID NO: 5019 - DNA, 201 bp, Homo sapiens; identical to SEQ ID NO: 4713

SEQ ID NO: 5020 - DNA, 201 bp, Homo sapiens; identical to SEQ ID NO: 4745

SEQ ID NO: 5021 - DNA, 201 bp, Homo sapiens
cagaacccccagacctccctctgtttctcagagtctattccgacaccctccaacagggaggaaacacaacagaaatccaacctagagctgctccgcatctscctgctgctcatccagtcgtggctggagcccgtgcacccccggactgggcagatcttcaagcagacctacagcaagttcgacacaaactcacacaacgat

SEQ ID NO: 5022 - DNA, 150 bp, Homo sapiens; identical to SEQ ID NO: 4704

SEQ ID NO: 5023 - DNA, 140 bp, Homo sapiens; identical to SEQ ID NO: 4705

SEQ ID NO: 5024 - DNA, 201 bp, Homo sapiens; identical to SEQ ID NO: 4724

SEQ ID NO: 5025 - DNA, 201 bp, Homo sapiens; identical to SEQ ID NO: 4725

SEQ ID NO: 5026 - DNA, 201 bp, Homo sapiens; identical to SEQ ID NO: 4709

SEQ ID NO: 5027 - DNA, 106 bp, Homo sapiens; identical to SEQ ID NO: 4710

SEQ ID NO: 5028 - DNA, 201 bp, Homo sapiens
tccgcatctccctgctgctcatccagtcgtggctggagcccgtgcacccccggactgggcagatcttcaagcagacctacagcaagttcgacacaaactcrcacaacgatgacgcactactcaagaactacgggctgctctactgcttcaggaaggacatggacaaggtcgagacattcctgcgcatcgtgcagtgccgct

SEQ ID NO: 5029 - DNA, 201 bp, Homo sapiens
tgctccgcatctccctgctgctcatccagtcgtggctggagcccgtgcacccccggactgggcagatcttcaagcagacctacagcaagttcgacacaaamtcacacaacgatgacgcactactcaagaactacgggctgctctactgcttcaggaaggacatggacaaggtcgagacattcctgcgcatcgtgcagtgcc

SEQ ID NO: 5030 - DNA, 201 bp, Homo sapiens
acctagagctgctccgcatctccctgctgctcatccagtcgtggctggagcccgtgcacccccggactgggcagatcttcaagcagacctacagcaagttygacacaaactcacacaacgatgacgcactactcaagaactacgggctgctctactgcttcaggaaggacatggacaaggtcgagacattcctgcgcatcg

SEQ ID NO: 5031 - DNA, 201 bp, Homo sapiens; identical to SEQ ID NO: 4711

SEQ ID NO: 5032 - DNA, 201 bp, Homo sapiens
gagtctattccgacaccctccaacagggaggaaacacaacagaaatccaacctagagctgctccgcatctccctgctgctcatccagtcgtggctggagcycgtgcacccccggactgggcagatcttcaagcagacctacagcaagttcgacacaaactcacacaacgatgacgcactactcaagaactacgggctgctc

SEQ ID NO: 5033 - DNA, 201 bp, Homo sapiens
tcatccagtcgtggctggagcccgtgcacccccggactgggcagatcttcaagcagacctacagcaagttcgacacaaactcacacaacgatgacgcactrctcaagaactacgggctgctctactgcttcaggaaggacatggacaaggtcgagacattcctgcgcatcgtgcagtgccgctctgtggagggcagctgtg

SEQ ID NO: 5034 - DNA, 201 bp, Homo sapiens; identical to SEQ ID NO: 4712

SEQ ID NO: 5035 - DNA, 201 bp, Homo sapiens
attcctgcagaacccccagacctccctctgtttctcagagtctattccgacaccctccaacagggaggaaacacaacagaaatccaacctagagctgctcygcatctccctgctgctcatccagtcgtggctggagcccgtgcacccccggactgggcagatcttcaagcagacctacagcaagttcgacacaaactcaca

SEQ ID NO: 5036 - DNA, 201 bp, Homo sapiens; identical to SEQ ID NO: 4713

SEQ ID NO: 5037 - DNA, 176 bp, Homo sapiens
tggacaaggtcgagacattcctgcgcatcgtgcagtgccgctctgtggagggcagctgtggcttctagctgcccgggtggcatccctgtgacccctccccmgtgcctctcctggtcgtggaaggtgctactccagtgcccaccagccttgtcctaataaaattaagttgcatcatt

SEQ ID NO: 5038 - DNA, 138 bp, Homo sapiens
cgctctgtggagggcagctgtggcttctagctgcccgggtggcatccctgtgacccctccccagtgcctctcctggtcgtggaaggtgctactccagtgcmcaccagccttgtcctaataaaattaagttgcatcatt

SEQ ID NO: 5039 - DNA, 201 bp, Homo sapiens; identical to SEQ ID NO: 4706

SEQ ID NO: 5040 - DNA, 161 bp, Homo sapiens
cattcctgcgcatcgtgcagtgccgctctgtggagggcagctgtggcttctagctgcccgggtggcatccctgtgacccctccccagtgcctctcctggtsgtggaaggtgctactccagtgcccaccagccttgtcctaataaaattaagttgcatcatt

SEQ ID NO: 5041 - DNA, 175 bp, Homo sapiens
ggacaaggtcgagacattcctgcgcatcgtgcagtgccgctctgtggagggcagctgtggcttctagctgcccgggtggcatccctgtgacccctccccastgcctctcctggtcgtggaaggtgctactccagtgcccaccagccttgtcctaataaaattaagttgcatcatt

SEQ ID NO: 5042 - DNA, 195 bp, Homo sapiens; identical to SEQ ID NO: 4963

SEQ ID NO: 5043 - DNA, 201 bp, Homo sapiens; identical to SEQ ID NO: 4957

SEQ ID NO: 5044 - DNA, 201 bp, Homo sapiens
gacagctcacctagtggcaatggctccagaggctggaagacggcagccgccggactgggcagatcctcaagcagacctacagcaagtttgacacaaactcrcacaaccatgacgcactgctcaagaactacgggctgctctactgcttcaggaaggacatggacaaggtcgagacattcctgcgcatggtgcagtgccgct

SEQ ID NO: 5045 - DNA, 201 bp, Homo sapiens; identical to SEQ ID NO: 4721

SEQ ID NO: 5046 - DNA, 201 bp, Homo sapiens; identical to SEQ ID NO: 4920

SEQ ID NO: 5047 - DNA, 201 bp, Homo sapiens; identical to SEQ ID NO: 4723

SEQ ID NO: 5048 - DNA, 201 bp, Homo sapiens; identical to SEQ ID NO: 4922

SEQ ID NO: 5049 - DNA, 201 bp, Homo sapiens; identical to SEQ ID NO: 4923

SEQ ID NO: 5050 - DNA, 170 bp, Homo sapiens; identical to SEQ ID NO: 4751

SEQ ID NO: 5051 - DNA, 201 bp, Homo sapiens; identical to SEQ ID NO: 4926

SEQ ID NO: 5052 - DNA, 149 bp, Homo sapiens; identical to SEQ ID NO: 4753

SEQ ID NO: 5053 - DNA, 201 bp, Homo sapiens; identical to SEQ ID NO: 4754

SEQ ID NO: 5054 - DNA, 201 bp, Homo sapiens; identical to SEQ ID NO: 4755

SEQ ID NO: 5055 - DNA, 201 bp, Homo sapiens; identical to SEQ ID NO: 4756

SEQ ID NO: 5056 - DNA, 201 bp, Homo sapiens; identical to SEQ ID NO: 4757

SEQ ID NO: 5057 - DNA, 154 bp, Homo sapiens; identical to SEQ ID NO: 4758

SEQ ID NO: 5058 - DNA, 179 bp, Homo sapiens; identical to SEQ ID NO: 4759

SEQ ID NO: 5059 - DNA, 157 bp, Homo sapiens; identical to SEQ ID NO: 4740

SEQ ID NO: 5060 - DNA, 201 bp, Homo sapiens; identical to SEQ ID NO: 4761

SEQ ID NO: 5061 - DNA, 157 bp, Homo sapiens; identical to SEQ ID NO: 4762

SEQ ID NO: 5062 - DNA, 201 bp, Homo sapiens; identical to SEQ ID NO: 4763

SEQ ID NO: 5063 - DNA, 201 bp, Homo sapiens; identical to SEQ ID NO: 4764

SEQ ID NO: 5064 - DNA, 201 bp, Homo sapiens; identical to SEQ ID NO: 4942

SEQ ID NO: 5065 - DNA, 201 bp, Homo sapiens; identical to SEQ ID NO: 4943

SEQ ID NO: 5066 - DNA, 173 bp, Homo sapiens
tggacaaggtcgagacattcctgcgcatcgtgcagtgccgctctgtggagggcagctgtggcttctagctgcccgggtggcatccctgtgacccctccccmgtgcctctcctggtcgtggaaggtgctactccagtgcccaccagccttgtcctaataaaattaagttgcatc

SEQ ID NO: 5067 - DNA, 135 bp, Homo sapiens
cgctctgtggagggcagctgtggcttctagctgcccgggtggcatccctgtgacccctccccagtgcctctcctggtcgtggaaggtgctactccagtgcmcaccagccttgtcctaataaaattaagttgcatc

SEQ ID NO: 5068 - DNA, 201 bp, Homo sapiens; identical to SEQ ID NO: 4706

SEQ ID NO: 5069 - DNA, 158 bp, Homo sapiens
cattcctgcgcatcgtgcagtgccgctctgtggagggcagctgtggcttctagctgcccgggtggcatccctgtgacccctccccagtgcctctcctggtsgtggaaggtgctactccagtgcccaccagccttgtcctaataaaattaagttgcatc

SEQ ID NO: 5070 - DNA, 195 bp, Homo sapiens; identical to SEQ ID NO: 4963

SEQ ID NO: 5071 - DNA, 172 bp, Homo sapiens
ggacaaggtcgagacattcctgcgcatcgtgcagtgccgctctgtggagggcagctgtggcttctagctgcccgggtggcatccctgtgacccctccccastgcctctcctggtcgtggaaggtgctactccagtgcccaccagccttgtcctaataaaattaagttgcatc

SEQ ID NO: 5072 - DNA, 201 bp, Homo sapiens; identical to SEQ ID NO: 4957

SEQ ID NO: 5073 - DNA, 169 bp, Homo sapiens
aggatcccaaggcccaactccccgaaccactcagggtcctgtggacagctcacctagctgcaatggctrcagaggctggaagatggcagcccccggactgggcagatcttcaagcagacctacagcaagttcgacacaaactcacacaacgatgacgcactactcaaga

SEQ ID NO: 5074 - DNA, 159 bp, Homo sapiens
aggatcccaaggcccaactccccgaaccactcagggtcctgtggacagctcacctagckgcaatggctacagaggctggaagatggcagcccccggactgggcagatcttcaagcagacctacagcaagttcgacacaaactcacacaacgatgacgca

SEQ ID NO: 5075 - DNA, 116 bp, Homo sapiens
aggatcccaaggcccractccccgaaccactcagggtcctgtggacagctcacctagctgcaatggctacagaggctggaagatggcagcccccggactgggcagatcttcaagca

SEQ ID NO: 5076 - DNA, 201 bp, Homo sapiens
gacagctcacctagctgcaatggctacagaggctggaagatggcagcccccggactgggcagatcttcaagcagacctacagcaagttcgacacaaactcrcacaacgatgacgcactactcaagaactacgggctgctctactgcttcaggaaggacatggacaaggtcgagacattcctgcgcatcgtgcagtgccgct

SEQ ID NO: 5077 - DNA, 201 bp, Homo sapiens
gtggacagctcacctagctgcaatggctacagaggctggaagatggcagcccccggactgggcagatcttcaagcagacctacagcaagttcgacacaaamtcacacaacgatgacgcactactcaagaactacgggctgctctactgcttcaggaaggacatggacaaggtcgagacattcctgcgcatcgtgcagtgcc

SEQ ID NO: 5078 - DNA, 125 bp, Homo sapiens
aggatcccaaggcccaactccccgmaccactcagggtcctgtggacagctcacctagctgcaatggctacagaggctggaagatggcagcccccggactgggcagatcttcaagcagacctacag

SEQ ID NO: 5079 - DNA, 157 bp, Homo sapiens; identical to SEQ ID NO: 4740

SEQ ID NO: 5080 - DNA, 103 bp, Homo sapiens
agsatcccaaggcccaactccccgaaccactcagggtcctgtggacagctcacctagctgcaatggctacagaggctggaagatggcagcccccggactgggc

SEQ ID NO: 5081 - DNA, 201 bp, Homo sapiens
cagggtcctgtggacagctcacctagctgcaatggctacagaggctggaagatggcagcccccggactgggcagatcttcaagcagacctacagcaagttygacacaaactcacacaacgatgacgcactactcaagaactacgggctgctctactgcttcaggaaggacatggacaaggtcgagacattcctgcgcatcg

SEQ ID NO: 5082 - DNA, 201 bp, Homo sapiens
aatggctacagaggctggaagatggcagcccccggactgggcagatcttcaagcagacctacagcaagttcgacacaaactcacacaacgatgacgcactrctcaagaactacgggctgctctactgcttcaggaaggacatggacaaggtcgagacattcctgcgcatcgtgcagtgccgctctgtggagggcagctgtg

SEQ ID NO: 5083 - DNA, 201 bp, Homo sapiens; identical to SEQ ID NO: 4995

SEQ ID NO: 5084 - DNA, 201 bp, Homo sapiens; identical to SEQ ID NO: 4795

SEQ ID NO: 5085 - DNA, 201 bp, Homo sapiens; identical to SEQ ID NO: 4796

SEQ ID NO: 5086 - DNA, 201 bp, Homo sapiens; identical to SEQ ID NO: 4797

SEQ ID NO: 5087 - DNA, 201 bp, Homo sapiens; identical to SEQ ID NO: 4798

SEQ ID NO: 5088 - DNA, 173 bp, Homo sapiens; identical to SEQ ID NO: 5066

SEQ ID NO: 5089 - DNA, 135 bp, Homo sapiens; identical to SEQ ID NO: 5067

SEQ ID NO: 5090 - DNA, 201 bp, Homo sapiens
ccgcgcccgtcgcctgtaccagctggcatatgacacctatcaggagtttaacccccagacctccctctgcttctcagagtctattccaacaccttccaacwgggtgaaaacgcagcagaaatctaacctagagctgctccgcatctccctgctgctcatccagtcatggctggagcccgtgcagctcctcaggagcgtctt

SEQ ID NO: 5091 - DNA, 158 bp, Homo sapiens; identical to SEQ ID NO: 5069

SEQ ID NO: 5092 - DNA, 195 bp, Homo sapiens; identical to SEQ ID NO: 4963

SEQ ID NO: 5093 - DNA, 172 bp, Homo sapiens; identical to SEQ ID NO: 5071

SEQ ID NO: 5094 - DNA, 201 bp, Homo sapiens
gcagtgccttcccaaccattcccttatccaggctttttgacaacgctatgctccgcgcccgtcgcctgtaccagctggcatatgacacctatcaggagttraacccccagacctccctctgcttctcagagtctattccaacaccttccaacagggtgaaaacgcagcagaaatctaacctagagctgctccgcatctccc

SEQ ID NO: 5095 - DNA, 201 bp, Homo sapiens
aatttttatgttgtcaccctgaaagaggaacttggaaactgggcacagtgggtggttgttatgcacccatccaaagttttggaattgcagatgaacaagcrtggcttcagcatggaagtggggcagtatatctttgttaattgcccctcaatctctctcctggaatggcatccttttactttgacctctgctccagaggaa

SEQ ID NO: 5096 - DNA, 201 bp, Homo sapiens
caccacctttttatcttctatatccttggcttagggattcacggcattggtggaattgtccggggtcaaacagaggagagcatgaatgagagtcatcctcrcaagtgtgcagagtcttttgagatgtgggatgatcgtgactcccactgtaggcgccctaagtttgaagggcatccccctgagtcttggaagtggatcctt

SEQ ID NO: 5097 - DNA, 201 bp, Homo sapiens
gcattggtggaattgtccggggtcaaacagaggagagcatgaatgagagtcatcctcgcaagtgtgcagagtcttttgagatgtgggatgatcgtgactcycactgtaggcgccctaagtttgaagggcatccccctgagtcttggaagtggatccttgcaccggtcattctttatatctgtgaaaggatcctccggtttt

SEQ ID NO: 5098 - DNA, 201 bp, Homo sapiens
tgttaattgcccctcaatctctctcctggaatggcatccttttactttgacctctgctccagaggaagatttcttctccattcatatccgagcagcagggractggacagaaaatctcataagggctttcgaacaacaatattcaccaattcccaggattgaagtggatggtccctttggcacagccagtgaggatgtttt

SEQ ID NO: 5099 - DNA, 201 bp, Homo sapiens
ccatctcctgagttttggtttgtaatcttttgtccctcccacccccacagaagatttctaagtagggtgactttttaaataaaaatttattgaataattartgataaaacataataataaacataaataataaacaaaattaccgagaaccccatccccatataacaccaacagtgtacatgtttactgtcacttttgata

SEQ ID NO: 5100 - DNA, 201 bp, Homo sapiens
tgtgaaaggatcctccggttttaccgctcccagcagaaggttgtgattaccaaggttgttatgcacccatccaaagttttggaattgcagatgaacaagcrtggcttcagcatggaagtggggcagtatatctttgttaattgcccctcaatctctctcctggaatggcatccttttactttgacctctgctccagaggaa

SEQ ID NO: 5101 - DNA, 201 bp, Homo sapiens; identical to SEQ ID NO: 5096

SEQ ID NO: 5102 - DNA, 201 bp, Homo sapiens; identical to SEQ ID NO: 5097

SEQ ID NO: 5103 - DNA, 201 bp, Homo sapiens; identical to SEQ ID NO: 5098

SEQ ID NO: 5104 - DNA, 201 bp, Homo sapiens; identical to SEQ ID NO: 5099

SEQ ID NO: 5105 - DNA, 201 bp, Homo sapiens; identical to SEQ ID NO: 5100

SEQ ID NO: 5106 - DNA, 201 bp, Homo sapiens; identical to SEQ ID NO: 5096

SEQ ID NO: 5107 - DNA, 201 bp, Homo sapiens; identical to SEQ ID NO: 5097

SEQ ID NO: 5108 - DNA, 201 bp, Homo sapiens; identical to SEQ ID NO: 5098

SEQ ID NO: 5109 - DNA, 201 bp, Homo sapiens; identical to SEQ ID NO: 5099

SEQ ID NO: 5110 - DNA, 201 bp, Homo sapiens
ggtgaagataactgtgacttgcatgatgtgcattgagtcagactccatggggtctctggttcattctcctgtctgcctattgagcctgccgatgtcacttrggagacagggacttgatatttccttcaggttaatgactgtggttctttgtgtcccctccagatttctctacctcagtccctttttttgtggtctctttat

SEQ ID NO: 5111 - DNA, 201 bp, Homo sapiens
acccagaagccaactatggaggaaatcacagctgctgcagtaaagtctggggcccatagtttcatctctggactccctcagggctatgacacagaggtagrcgaggctgggagccagctgtcagggggtcagcgacaggcagtggcgttggcccgagcattgatccggaaaccgtgtgtacttatcctggatgatgccacc

SEQ ID NO: 5112 - DNA, 201 bp, Homo sapiens
tgtgcattgagtcagactccatggggtctctggttcattctcctgtctgcctattgagcctgccgatgtcacttaggagacagggacttgatatttccttyaggttaatgactgtggttctttgtgtcccctccagatttctctacctcagtccctttttttgtggtctctttatagatttcaggtatgctgctgaaagtg

SEQ ID NO: 5113 - DNA, 201 bp, Homo sapiens
gctgcagtaaagtctggggcccatagtttcatctctggactccctcagggctatgacacagaggtagacgaggctgggagccagctgtcagggggtcagcracaggcagtggcgttggcccgagcattgatccggaaaccgtgtgtacttatcctggatgatgccaccagtgccctggatgcaaacagccagttacaggtg

SEQ ID NO: 5114 - DNA, 201 bp, Homo sapiens
gactccatggggtctctggttcattctcctgtctgcctattgagcctgccgatgtcacttaggagacagggacttgatatttccttcaggttaatgactgyggttctttgtgtcccctccagatttctctacctcagtccctttttttgtggtctctttatagatttcaggtatgctgctgaaagtgggaatcctctacat

SEQ ID NO: 5115 - DNA, 201 bp, Homo sapiens
gctcctgcagatgctccagaatgaaagccttctcagacctgcgcactccatctccctcccttttcttctctctgtggtggagaaccacagctgcagagtakgcagctgcctccaggatgagttacttgaaatttgccttgagtgtgttacctcctttccaagctcctcgtgataatgcagacttcctggagtacaaacaca

SEQ ID NO: 5116 - DNA, 201 bp, Homo sapiens
ttctctctgtggtggagaaccacagctgcagagtaggcagctgcctccaggatgagttacttgaaatttgccttgagtgtgttacctcctttccaagctcytcgtgataatgcagacttcctggagtacaaacacaggatttgtaattccttactgtaacggagtttagagccagggctgatgctttggtgtggccagcac

SEQ ID NO: 5117 - DNA, 201 bp, Homo sapiens
gagttacttgaaatttgccttgagtgtgttacctcctttccaagctcctcgtgataatgcagacttcctggagtacaaacacaggatttgtaattccttastgtaacggagtttagagccagggctgatgctttggtgtggccagcactctgaaactgagaaatgttcagaatgtacggaaagatgatcagctattttcaa

SEQ ID NO: 5118 - DNA, 201 bp, Homo sapiens
agactccatggggtctctggttcattctcctgtctgcctattgagcctgccgatgtcacttaggagacagggacttgatatttccttcaggttaatgactrtggttctttgtgtcccctccagatttctctacctcagtccctttttttgtggtctctttatagatttcaggtatgctgctgaaagtgggaatcctctaca

SEQ ID NO: 5119 - DNA, 201 bp, Homo sapiens
gggaatcctctacattggtgggcagctggtgaccagtggggctgtaagcagtgggaaccttgtcacatttgttctctaccagatgcagttcacccaggctktggaggtactgctctccatctaccccagagtacagaaggctgtgggctcctcagagaaaatatttgagtacctggaccgcacccctcgctgcccacccag

SEQ ID NO: 5120 - DNA, 201 bp, Homo sapiens
cacccctcgctgcccacccagtggtctgttgactcccttacacttggagggccttgtccagttccaagatgtctcctttgcctacccaaaccgcccagatrtcttagtgctacaggggctgacattcaccctacgccctggcgaggtgacggcgctggtgggacccaatgggtctgggaagagcacagtggctgccctgct

SEQ ID NO: 5121 - DNA, 201 bp, Homo sapiens
tccctcagggctatgacacagaggtagacgaggctgggagccagctgtcagggggtcagcgacaggcagtggcgttggcccgagcattgatccggaaaccrtgtgtacttatcctggatgatgccaccagtgccctggatgcaaacagccagttacaggtggagcagctcctgtacgaaagccctgagcggtactcccgct

SEQ ID NO: 5122 - DNA, 201 bp, Homo sapiens
ggaaaccgtgtgtacttatcctggatgatgccaccagtgccctggatgcaaacagccagttacaggtggagcagctcctgtacgaaagccctgagcggtaytcccgctcagtgcttctcatcacccagcacctcagcctggtggagcaggctgaccacatcctctttctggaaggaggcgctatccgggaggggggaaccc

SEQ ID NO: 5123 - DNA, 201 bp, Homo sapiens
ttgctaccaaaatagtctgggcaggccacttttggaagtaggcgttatctagtgagcaggcggccgctttcgatttcgctttcccctaaatggctgagctkctcgccagcgcaggatcagcctgttcctgggactttccgagagccccgccctcgttccctcccccagccgccagtaggggaggactcggcggtacccgga

SEQ ID NO: 5124 - DNA, 201 bp, Homo sapiens
ccggcggtcagggcggctctggaaaccctgtgcgtcggcttctaggctgcctgggctcggagacgcgccgcctctcgctgttcctggtcctggtggtcctstcctctcttggggagatggccattccattctttacgggccgcctcactgactggattctacaagatggctcagccgataccttcactcgaaacttaactc

SEQ ID NO: 5125 - DNA, 201 bp, Homo sapiens
cgggacttgccttgttccgagagctgatctcatggggagcccccgggtccgcggatagcaccaggctactgcactggggaagtcaccctaccgccttcgtygtcagttatgcagcggcactgcccgcagcagccctgtggcacaaactcgggagcctctgggtgcccggcggtcagggcggctctggaaaccctgtgcgtc

SEQ ID NO: 5126 - DNA, 201 bp, Homo sapiens; identical to SEQ ID NO: 5116

SEQ ID NO: 5127 - DNA, 201 bp, Homo sapiens; identical to SEQ ID NO: 5121

SEQ ID NO: 5128 - DNA, 201 bp, Homo sapiens
agagccacaggtatttggaagaagtcttcaactgctgcagtaaagtctggggcccatagtttcatctctggactccctcagggctatgacacagaggtagrcgaggctgggagccagctgtcagggggtcagcgacaggcagtggcgttggcccgagcattgatccggaaaccgtgtgtacttatcctggatgatgccacc

SEQ ID NO: 5129 - DNA, 201 bp, Homo sapiens; identical to SEQ ID NO: 5113

SEQ ID NO: 5130 - DNA, 201 bp, Homo sapiens
ctggattctacaagatggctcagccgataccttcactcgaaacttaactctcatgtccattctcaccatagccagtgcagtgctggagttcgtgggtgacrggatctataacaacaccatgggccacgtgcacagccacttgcagggagaggtgtttggggctgtcctgcgccaggagacggagtttttccaacagaacca

SEQ ID NO: 5131 - DNA, 201 bp, Homo sapiens
ccgataccttcactcgaaacttaactctcatgtccattctcaccatagccagtgcagtgctggagttcgtgggtgacgggatctataacaacaccatgggycacgtgcacagccacttgcagggagaggtgtttggggctgtcctgcgccaggagacggagtttttccaacagaaccagacaggtaacatcatgtctcggg

SEQ ID NO: 5132 - DNA, 201 bp, Homo sapiens; identical to SEQ ID NO: 5117

SEQ ID NO: 5133 - DNA, 201 bp, Homo sapiens
cctcactgactggattctacaagatggctcagccgataccttcactcgaaacttaactctcatgtccattctcaccatagccagtgcagtgctggagttcktgggtgacgggatctataacaacaccatgggccacgtgcacagccacttgcagggagaggtgtttggggctgtcctgcgccaggagacggagtttttcca

SEQ ID NO: 5134 - DNA, 201 bp, Homo sapiens; identical to SEQ ID NO: 5122

SEQ ID NO: 5135 - DNA, 201 bp, Homo sapiens
gagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccagttgctggaagtgcaggtgcgggaatctctggcaaagtccagccaggt

SEQ ID NO: 5136 - DNA, 201 bp, Homo sapiens
cagggcaacggttggctccaagagcgaaaacgcaggtgcccagggctggctggctgctttgaagccattagctgcggcactgggcttggccctgccgggasttgccttgttccgagagctgatctcatggggagcccccgggtccgcggatagcaccaggctactgcactggggaagtcaccctaccgccttcgttgtcag

SEQ ID NO: 5137 - DNA, 201 bp, Homo sapiens
atgggccacgtgcacagccacttgcagggagaggtgtttggggctgtcctgcgccaggagacggagtttttccaacagaaccagacaggtaacatcatgtytcgggtaacagaggacacgtccaccctgagtgattctctgagtgagaatctgagcttatttctgtggtacctggtgcgaggcctatgtctcttggggatc

SEQ ID NO: 5138 - DNA, 201 bp, Homo sapiens
ctgcttttccttctgcccaagaaggtgggaaaatggtaccagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaag

SEQ ID NO: 5139 - DNA, 201 bp, Homo sapiens
gggcgcggagagtcccaggcccggccgggaccgggacggcgtccgagtgccaatggctagctctaggtgtcccgctccccgcgggtgccgctgcctccccsgagcttctctcgcatggctggggacagtactgctacttctcgccgactgggtgctgctccggaccgcgctgccccgcatattctccctgctggtgcccac

SEQ ID NO: 5140 - DNA, 201 bp, Homo sapiens; identical to SEQ ID NO: 5115

SEQ ID NO: 5141 - DNA, 201 bp, Homo sapiens
ccctcgttccctcccccagccgccagtaggggaggactcggcggtacccggagcttcaggccccaccggggcgcggagagtcccaggcccggccgggaccrggacggcgtccgagtgccaatggctagctctaggtgtcccgctccccgcgggtgccgctgcctccccggagcttctctcgcatggctggggacagtactg

SEQ ID NO: 5142 - DNA, 201 bp, Homo sapiens
ttccgagagccccgccctcgttccctcccccagccgccagtaggggaggactcggcggtacccggagcttcaggccccaccggggcgcggagagtcccagrcccggccgggaccgggacggcgtccgagtgccaatggctagctctaggtgtcccgctccccgcgggtgccgctgcctccccggagcttctctcgcatggc

SEQ ID NO: 5143 - DNA, 201 bp, Homo sapiens; identical to SEQ ID NO: 5120

SEQ ID NO: 5144 - DNA, 201 bp, Homo sapiens; identical to SEQ ID NO: 5119

SEQ ID NO: 5145 - DNA, 201 bp, Homo sapiens; identical to SEQ ID NO: 5123

SEQ ID NO: 5146 - DNA, 201 bp, Homo sapiens; identical to SEQ ID NO: 5124

SEQ ID NO: 5147 - DNA, 201 bp, Homo sapiens; identical to SEQ ID NO: 5125

SEQ ID NO: 5148 - DNA, 201 bp, Homo sapiens; identical to SEQ ID NO: 5116

SEQ ID NO: 5149 - DNA, 201 bp, Homo sapiens; identical to SEQ ID NO: 5121

SEQ ID NO: 5150 - DNA, 201 bp, Homo sapiens; identical to SEQ ID NO: 5111

SEQ ID NO: 5151 - DNA, 201 bp, Homo sapiens; identical to SEQ ID NO: 5113

SEQ ID NO: 5152 - DNA, 201 bp, Homo sapiens; identical to SEQ ID NO: 5130

SEQ ID NO: 5153 - DNA, 201 bp, Homo sapiens
ccgataccttcactcgaaacttaactctcatgtccattctcaccatagccagtgcagtgctggagttcgtgggtgacgggatctataacaacaccatgggycacgtgcacagccacttgcagggagaggtgtttggggctgtcctgcgccaggagacggagtttttccaacagaaccagacagttgctggaagtgcaggtg

SEQ ID NO: 5154 - DNA, 201 bp, Homo sapiens; identical to SEQ ID NO: 5117

SEQ ID NO: 5155 - DNA, 201 bp, Homo sapiens; identical to SEQ ID NO: 5133

SEQ ID NO: 5156 - DNA, 201 bp, Homo sapiens; identical to SEQ ID NO: 5122

SEQ ID NO: 5157 - DNA, 201 bp, Homo sapiens; identical to SEQ ID NO: 5136

SEQ ID NO: 5158 - DNA, 201 bp, Homo sapiens
tcctgcgccaggagacggagtttttccaacagaaccagacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaag

SEQ ID NO: 5159 - DNA, 201 bp, Homo sapiens; identical to SEQ ID NO: 5115

SEQ ID NO: 5160 - DNA, 201 bp, Homo sapiens; identical to SEQ ID NO: 5139

SEQ ID NO: 5161 - DNA, 201 bp, Homo sapiens; identical to SEQ ID NO: 5142

SEQ ID NO: 5162 - DNA, 201 bp, Homo sapiens; identical to SEQ ID NO: 5141

SEQ ID NO: 5163 - DNA, 201 bp, Homo sapiens; identical to SEQ ID NO: 5120

SEQ ID NO: 5164 - DNA, 201 bp, Homo sapiens; identical to SEQ ID NO: 5119

SEQ ID NO: 5165 - DNA, 201 bp, Homo sapiens; identical to SEQ ID NO: 5123

SEQ ID NO: 5166 - DNA, 201 bp, Homo sapiens; identical to SEQ ID NO: 5124

SEQ ID NO: 5167 - DNA, 201 bp, Homo sapiens; identical to SEQ ID NO: 5125

SEQ ID NO: 5168 - DNA, 201 bp, Homo sapiens; identical to SEQ ID NO: 5116

SEQ ID NO: 5169 - DNA, 201 bp, Homo sapiens; identical to SEQ ID NO: 5121

SEQ ID NO: 5170 - DNA, 201 bp, Homo sapiens; identical to SEQ ID NO: 5111

SEQ ID NO: 5171 - DNA, 201 bp, Homo sapiens; identical to SEQ ID NO: 5113

SEQ ID NO: 5172 - DNA, 201 bp, Homo sapiens; identical to SEQ ID NO: 5130

SEQ ID NO: 5173 - DNA, 201 bp, Homo sapiens; identical to SEQ ID NO: 5131

SEQ ID NO: 5174 - DNA, 201 bp, Homo sapiens; identical to SEQ ID NO: 5117

SEQ ID NO: 5175 - DNA, 201 bp, Homo sapiens; identical to SEQ ID NO: 5133

SEQ ID NO: 5176 - DNA, 201 bp, Homo sapiens; identical to SEQ ID NO: 5122

SEQ ID NO: 5177 - DNA, 201 bp, Homo sapiens; identical to SEQ ID NO: 5135

SEQ ID NO: 5178 - DNA, 201 bp, Homo sapiens; identical to SEQ ID NO: 5136

SEQ ID NO: 5179 - DNA, 201 bp, Homo sapiens; identical to SEQ ID NO: 5137

SEQ ID NO: 5180 - DNA, 201 bp, Homo sapiens; identical to SEQ ID NO: 5138

SEQ ID NO: 5181 - DNA, 201 bp, Homo sapiens
gggcgcggagagtcccaggcccggccgggaccgggacggcgtccgagtgccaatggctagctctaggtgtcccgctccccgcgggtgccgctgcctccccsgagcttctctcgcatggctggggacagtactgctacttctcgccgactgggtgctgctccggaccgcgctgccccgcatattctccctgctggggtcctc

SEQ ID NO: 5182 - DNA, 201 bp, Homo sapiens; identical to SEQ ID NO: 5115

SEQ ID NO: 5183 - DNA, 201 bp, Homo sapiens; identical to SEQ ID NO: 5142

SEQ ID NO: 5184 - DNA, 201 bp, Homo sapiens; identical to SEQ ID NO: 5120

SEQ ID NO: 5185 - DNA, 201 bp, Homo sapiens; identical to SEQ ID NO: 5119

SEQ ID NO: 5186 - DNA, 201 bp, Homo sapiens; identical to SEQ ID NO: 5141

SEQ ID NO: 5187 - DNA, 201 bp, Homo sapiens; identical to SEQ ID NO: 5123

SEQ ID NO: 5188 - DNA, 201 bp, Homo sapiens; identical to SEQ ID NO: 5124

SEQ ID NO: 5189 - DNA, 201 bp, Homo sapiens; identical to SEQ ID NO: 5125

SEQ ID NO: 5190 - DNA, 201 bp, Homo sapiens; identical to SEQ ID NO: 5116

SEQ ID NO: 5191 - DNA, 201 bp, Homo sapiens; identical to SEQ ID NO: 5121

SEQ ID NO: 5192 - DNA, 201 bp, Homo sapiens; identical to SEQ ID NO: 5111

SEQ ID NO: 5193 - DNA, 201 bp, Homo sapiens; identical to SEQ ID NO: 5113

SEQ ID NO: 5194 - DNA, 201 bp, Homo sapiens; identical to SEQ ID NO: 5130

SEQ ID NO: 5195 - DNA, 201 bp, Homo sapiens; identical to SEQ ID NO: 5131

SEQ ID NO: 5196 - DNA, 201 bp, Homo sapiens; identical to SEQ ID NO: 5117

SEQ ID NO: 5197 - DNA, 201 bp, Homo sapiens; identical to SEQ ID NO: 5133

SEQ ID NO: 5198 - DNA, 201 bp, Homo sapiens; identical to SEQ ID NO: 5122

SEQ ID NO: 5199 - DNA, 201 bp, Homo sapiens; identical to SEQ ID NO: 5135

SEQ ID NO: 5200 - DNA, 201 bp, Homo sapiens; identical to SEQ ID NO: 5136

SEQ ID NO: 5201 - DNA, 201 bp, Homo sapiens; identical to SEQ ID NO: 5137

SEQ ID NO: 5202 - DNA, 201 bp, Homo sapiens; identical to SEQ ID NO: 5138

SEQ ID NO: 5203 - DNA, 201 bp, Homo sapiens; identical to SEQ ID NO: 5139

SEQ ID NO: 5204 - DNA, 201 bp, Homo sapiens; identical to SEQ ID NO: 5115

SEQ ID NO: 5205 - DNA, 201 bp, Homo sapiens; identical to SEQ ID NO: 5119

SEQ ID NO: 5206 - DNA, 201 bp, Homo sapiens; identical to SEQ ID NO: 5120

SEQ ID NO: 5207 - DNA, 201 bp, Homo sapiens; identical to SEQ ID NO: 5142

SEQ ID NO: 5208 - DNA, 201 bp, Homo sapiens; identical to SEQ ID NO: 5141

SEQ ID NO: 5209 - DNA, 201 bp, Homo sapiens; identical to SEQ ID NO: 5123

SEQ ID NO: 5210 - DNA, 201 bp, Homo sapiens; identical to SEQ ID NO: 5124

SEQ ID NO: 5211 - DNA, 201 bp, Homo sapiens; identical to SEQ ID NO: 5125

SEQ ID NO: 5212 - DNA, 201 bp, Homo sapiens; identical to SEQ ID NO: 5116

SEQ ID NO: 5213 - DNA, 201 bp, Homo sapiens; identical to SEQ ID NO: 5121

SEQ ID NO: 5214 - DNA, 201 bp, Homo sapiens; identical to SEQ ID NO: 5111

SEQ ID NO: 5215 - DNA, 201 bp, Homo sapiens; identical to SEQ ID NO: 5113

SEQ ID NO: 5216 - DNA, 201 bp, Homo sapiens; identical to SEQ ID NO: 5130

SEQ ID NO: 5217 - DNA, 201 bp, Homo sapiens; identical to SEQ ID NO: 5131

SEQ ID NO: 5218 - DNA, 201 bp, Homo sapiens; identical to SEQ ID NO: 5117

SEQ ID NO: 5219 - DNA, 201 bp, Homo sapiens; identical to SEQ ID NO: 5133

SEQ ID NO: 5220 - DNA, 201 bp, Homo sapiens; identical to SEQ ID NO: 5122

SEQ ID NO: 5221 - DNA, 201 bp, Homo sapiens; identical to SEQ ID NO: 5135

SEQ ID NO: 5222 - DNA, 201 bp, Homo sapiens; identical to SEQ ID NO: 5136

SEQ ID NO: 5223 - DNA, 201 bp, Homo sapiens; identical to SEQ ID NO: 5137

SEQ ID NO: 5224 - DNA, 201 bp, Homo sapiens; identical to SEQ ID NO: 5138

SEQ ID NO: 5225 - DNA, 201 bp, Homo sapiens; identical to SEQ ID NO: 5139

SEQ ID NO: 5226 - DNA, 201 bp, Homo sapiens; identical to SEQ ID NO: 5115

SEQ ID NO: 5227 - DNA, 201 bp, Homo sapiens; identical to SEQ ID NO: 5119

SEQ ID NO: 5228 - DNA, 201 bp, Homo sapiens; identical to SEQ ID NO: 5142

SEQ ID NO: 5229 - DNA, 201 bp, Homo sapiens; identical to SEQ ID NO: 5141

SEQ ID NO: 5230 - DNA, 201 bp, Homo sapiens
ggaatcggctctcccggttgcgggaagcgggcgtcgctcggacccaggacactacagtttctctatgcgatctccagagctcgctttaccccggggaatgmagcccacagaattcttccagtccctgggtggggacggagaaaggaacgttcagattgagatggcccatggcaccaccacgctcgccttcaagttccagca

SEQ ID NO: 5231 - DNA, 201 bp, Homo sapiens
cccgagggcagcggccggaatcggctctcccggttgcgggaagcgggcgtcgctcggacccaggacactacagtttctctatgcgatctccagagctcgcyttaccccggggaatgcagcccacagaattcttccagtccctgggtggggacggagaaaggaacgttcagattgagatggcccatggcaccaccacgctcg

SEQ ID NO: 5232 - DNA, 188 bp, Homo sapiens
gggcgcgcctcacaactcaccacctcgcccgctggtccttcctggctcgcctggctctgaagctgcacctggaggggaaacctcagarcagtaggcgggattgcctagtaaatatctcccattcagggaggcccaggtcgtgtgacgtcgacagttgctgggtagatgaggccaacacaggttgcaag

SEQ ID NO: 5233 - DNA, 201 bp, Homo sapiens
tcctggctcgcctggctctgaagctgcacctggaggggaaacctcagaacagtaggcgggattgcctagtaaatatctcccattcagggaggcccaggtcrtgtgacgtcgacagttgctgggtagatgaggccaacacaggttgcaagaagaggcggggtttagaggcgtgaaactccgcagtgctcagccaagcaggga

SEQ ID NO: 5234 - DNA, 201 bp, Homo sapiens
cctgatccgtaatggagactggaccttccagatcctggtgatgctggaaatgaccccccagcagggagatgtctacacctgccaagtggagcacaccagcmtggatagtcctgtcaccgtggagtggaaggcacagtctgattctgcccggagtaagacattgacgggagctgggggcttcgtgctggggctcatcatctg

SEQ ID NO: 5235 - DNA, 144 bp, Homo sapiens
agctccctttagcgagtccttcttttcctgactgcagctctttycattttgccatccttttccagctccatgatggttctgcaggtttctgcggccccccggacagtggctctgacggcgttactgatggtgctgctcacatct

SEQ ID NO: 5236 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgagtccagcctagggtgaatgtttccccctc

SEQ ID NO: 5237 - DNA, 201 bp, Homo sapiens
ggacaggatgtgcagacacaactacgagctgggcgggcccatgaccctgcagcgccgagtccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 5238 - DNA, 201 bp, Homo sapiens
tctgcaggtttctgcggccccccggacagtggctctgacggcgttactgatggtgctgctcacatctgtggtccagggcagggccactccagagaattacsttttccagggacggcaggaatgctacgcgtttaatgggacacagcgcttcctggagagatacatctacaaccgggaggagttcgcgcgcttcgacagcga

SEQ ID NO: 5239 - DNA, 201 bp, Homo sapiens
tgcaggtttctgcggccccccggacagtggctctgacggcgttactgatggtgctgctcacatctgtggtccagggcagggccactccagagaattacctkttccagggacggcaggaatgctacgcgtttaatgggacacagcgcttcctggagagatacatctacaaccgggaggagttcgcgcgcttcgacagcgacg

SEQ ID NO: 5240 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgagtccagcctagggtgaatgtttccccctccaagaaggggcccttgcagca

SEQ ID NO: 5241 - DNA, 201 bp, Homo sapiens
caggtttctgcggccccccggacagtggctctgacggcgttactgatggtgctgctcacatctgtggtccagggcagggccactccagagaattacctttwccagggacggcaggaatgctacgcgtttaatgggacacagcgcttcctggagagatacatctacaaccgggaggagttcgcgcgcttcgacagcgacgtg

SEQ ID NO: 5242 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgagtccagcctagggtgaatgtttccccctccaagaaggggcccttgcagcacc

SEQ ID NO: 5243 - DNA, 201 bp, Homo sapiens
ttctgcggccccccggacagtggctctgacggcgttactgatggtgctgctcacatctgtggtccagggcagggccactccagagaattaccttttccagkgacggcaggaatgctacgcgtttaatgggacacagcgcttcctggagagatacatctacaaccgggaggagttcgcgcgcttcgacagcgacgtggggga

SEQ ID NO: 5244 - DNA, 153 bp, Homo sapiens
aatggtgagcagactgcaaatctgcctgataggacccatattcccacagcactaattcaacatataccttactgagagcatgttttatcattaccattaakaagttaaatgaacatcagaatttaaaatcataaatataatctaatacacttt

SEQ ID NO: 5245 - DNA, 201 bp, Homo sapiens
gctcatcatctgtggagtgggcatcttcatgcacaggaggagcaagaaagttcaacgaggatctgcataaacagggttcctgagctcactgaaaagactawtgtgccttaggaaaagcatttgctgtgtttcgttagcatctggctccaggacagaccttcaacttccaaattggatactgctgccaagaagttgctctga

SEQ ID NO: 5246 - DNA, 201 bp, Homo sapiens
gggggcttcgtgctggggctcatcatctgtggagtgggcatcttcatgcacaggaggagcaagaaagttcaacgaggatctgcataaacagggttcctgasctcactgaaaagactattgtgccttaggaaaagcatttgctgtgtttcgttagcatctggctccaggacagaccttcaacttccaaattggatactgctg

SEQ ID NO: 5247 - DNA, 201 bp, Homo sapiens
gggtgaatgtttccccctccaagaaggggcccttgcagcaccacaacctgcttgtctgccacgtgacggatttctacccaggcagcattcaagtccgatgsttcctgaatggacaggaggaaacagctggggtcgtgtccaccaacctgatccgtaatggagactggaccttccagatcctggtgatgctggaaatgaccc

SEQ ID NO: 5248 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgagtccagcctagggtgaatgtttccccctccaagaaggggcccttgcagcaccacaacctgcttgtctgccacgtg

SEQ ID NO: 5249 - DNA, 201 bp, Homo sapiens
agggacggcaggaatgctacgcgtttaatgggacacagcgcttcctggagagatacatctacaaccgggaggagttcgcgcgcttcgacagcgacgtgggrgagttccgggcggtgacggagctggggcggcctgctgcggagtactggaacagccagaaggacatcctggaggagaagcgggcagtgccggacaggatgt

SEQ ID NO: 5250 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgagtccagcctagggtgaatgtttccccctcc

SEQ ID NO: 5251 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgagtccagcctagggtgaatgtttccccctccaagaaggggcccttgcagcaccacaacctgcttgtctgccacgtgacg

SEQ ID NO: 5252 - DNA, 201 bp, Homo sapiens
cagggttcctgagctcactgaaaagactattgtgccttaggaaaagcatttgctgtgtttcgttagcatctggctccaggacagaccttcaacttccaaaktggatactgctgccaagaagttgctctgaagtcagtttctatcattctgctctttgattcaaagcactgtttctctcactgggcctccaaccatgttccc

SEQ ID NO: 5253 - DNA, 201 bp, Homo sapiens
agcattcaagtccgatggttcctgaatggacaggaggaaacagctggggtcgtgtccaccaacctgatccgtaatggagactggaccttccagatcctggwgatgctggaaatgaccccccagcagggagatgtctacacctgccaagtggagcacaccagcctggatagtcctgtcaccgtggagtggaaggcacagtct

SEQ ID NO: 5254 - DNA, 201 bp, Homo sapiens
cacaggaggagcaagaaagttcaacgaggatctgcataaacagggttcctgagctcactgaaaagactattgtgccttaggaaaagcatttgctgtgtttygttagcatctggctccaggacagaccttcaacttccaaattggatactgctgccaagaagttgctctgaagtcagtttctatcattctgctctttgattc

SEQ ID NO: 5255 - DNA, 201 bp, Homo sapiens
agggttcctgagctcactgaaaagactattgtgccttaggaaaagcatttgctgtgtttcgttagcatctggctccaggacagaccttcaacttccaaatwggatactgctgccaagaagttgctctgaagtcagtttctatcattctgctctttgattcaaagcactgtttctctcactgggcctccaaccatgttccct

SEQ ID NO: 5256 - DNA, 201 bp, Homo sapiens
gaggagcaagaaagttcaacgaggatctgcataaacagggttcctgagctcactgaaaagactattgtgccttaggaaaagcatttgctgtgtttcgttarcatctggctccaggacagaccttcaacttccaaattggatactgctgccaagaagttgctctgaagtcagtttctatcattctgctctttgattcaaagc

SEQ ID NO: 5257 - DNA, 201 bp, Homo sapiens
agcatttgctgtgtttcgttagcatctggctccaggacagaccttcaacttccaaattggatactgctgccaagaagttgctctgaagtcagtttctatcrttctgctctttgattcaaagcactgtttctctcactgggcctccaaccatgttcccttcttcttagcaccacaaataatcaaaacccaacatgactgttt

SEQ ID NO: 5258 - DNA, 201 bp, Homo sapiens
cagcgcttcctggagagatacatctacaaccgggaggagttcgcgcgcttcgacagcgacgtgggggagttccgggcggtgacggagctggggcggcctgmtgcggagtactggaacagccagaaggacatcctggaggagaagcgggcagtgccggacaggatgtgcagacacaactacgagctgggcgggcccatgacc

SEQ ID NO: 5259 - DNA, 201 bp, Homo sapiens
gggcagggccactccagagaattaccttttccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 5260 - DNA, 201 bp, Homo sapiens
ttctatcattctgctctttgattcaaagcactgtttctctcactgggcctccaaccatgttcccttcttcttagcaccacaaataatcaaaacccaacatractgtttgttttcctttaaaaatatgcaccaaatcatctctcatcacttttctctgagggttttagtagacagtaggagttaataaagaagttcattttg

SEQ ID NO: 5261 - DNA, 201 bp, Homo sapiens
ctatcattctgctctttgattcaaagcactgtttctctcactgggcctccaaccatgttcccttcttcttagcaccacaaataatcaaaacccaacatgastgtttgttttcctttaaaaatatgcaccaaatcatctctcatcacttttctctgagggttttagtagacagtaggagttaataaagaagttcattttggt

SEQ ID NO: 5262 - DNA, 201 bp, Homo sapiens
tctgctctttgattcaaagcactgtttctctcactgggcctccaaccatgttcccttcttcttagcaccacaaataatcaaaacccaacatgactgtttgytttcctttaaaaatatgcaccaaatcatctctcatcacttttctctgagggttttagtagacagtaggagttaataaagaagttcattttggtttaaaca

SEQ ID NO: 5263 - DNA, 201 bp, Homo sapiens
gagcaagaaagttcaacgaggatctgcataaacagggttcctgagctcactgaaaagactattgtgccttaggaaaagcatttgctgtgtttcgttagcayctggctccaggacagaccttcaacttccaaattggatactgctgccaagaagttgctctgaagtcagtttctatcattctgctctttgattcaaagcact

SEQ ID NO: 5264 - DNA, 201 bp, Homo sapiens
actgtttctctcactgggcctccaaccatgttcccttcttcttagcaccacaaataatcaaaacccaacatgactgtttgttttcctttaaaaatatgcaycaaatcatctctcatcacttttctctgagggttttagtagacagtaggagttaataaagaagttcattttggtttaaacataggaaagaagagaaccatg

SEQ ID NO: 5265 - DNA, 201 bp, Homo sapiens
agaaagttcaacgaggatctgcataaacagggttcctgagctcactgaaaagactattgtgccttaggaaaagcatttgctgtgtttcgttagcatctggytccaggacagaccttcaacttccaaattggatactgctgccaagaagttgctctgaagtcagtttctatcattctgctctttgattcaaagcactgtttc

SEQ ID NO: 5266 - DNA, 201 bp, Homo sapiens
ctctcactgggcctccaaccatgttcccttcttcttagcaccacaaataatcaaaacccaacatgactgtttgttttcctttaaaaatatgcaccaaatcrtctctcatcacttttctctgagggttttagtagacagtaggagttaataaagaagttcattttggtttaaacataggaaagaagagaaccatgaaaatgg

SEQ ID NO: 5267 - DNA, 201 bp, Homo sapiens
ggatctgcataaacagggttcctgagctcactgaaaagactattgtgccttaggaaaagcatttgctgtgtttcgttagcatctggctccaggacagaccytcaacttccaaattggatactgctgccaagaagttgctctgaagtcagtttctatcattctgctctttgattcaaagcactgtttctctcactgggcctc

SEQ ID NO: 5268 - DNA, 201 bp, Homo sapiens
ggcctccaaccatgttcccttcttcttagcaccacaaataatcaaaacccaacatgactgtttgttttcctttaaaaatatgcaccaaatcatctctcatyacttttctctgagggttttagtagacagtaggagttaataaagaagttcattttggtttaaacataggaaagaagagaaccatgaaaatggggatatgtt

SEQ ID NO: 5269 - DNA, 201 bp, Homo sapiens
tctgcggccccccggacagtggctctgacggcgttactgatggtgctgctcacatctgtggtccagggcagggccactccagagaattaccttttccaggkacggcaggaatgctacgcgtttaatgggacacagcgcttcctggagagatacatctacaaccgggaggagttcgcgcgcttcgacagcgacgtgggggag

SEQ ID NO: 5270 - DNA, 201 bp, Homo sapiens
gccactccagagaattaccttttccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 5271 - DNA, 201 bp, Homo sapiens
actccagagaattaccttttccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 5272 - DNA, 201 bp, Homo sapiens
ttcgtgctggggctcatcatctgtggagtgggcatcttcatgcacaggaggagcaagaaagttcaacgaggatctgcataaacagggttcctgagctcacygaaaagactattgtgccttaggaaaagcatttgctgtgtttcgttagcatctggctccaggacagaccttcaacttccaaattggatactgctgccaaga

SEQ ID NO: 5273 - DNA, 201 bp, Homo sapiens
cgcttcctggagagatacatctacaaccgggaggagttcgcgcgcttcgacagcgacgtgggggagttccgggcggtgacggagctggggcggcctgctgmggagtactggaacagccagaaggacatcctggaggagaagcgggcagtgccggacaggatgtgcagacacaactacgagctgggcgggcccatgaccctg

SEQ ID NO: 5274 - DNA, 201 bp, Homo sapiens
ggcccatgaccctgcagcgccgagtccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 5275 - DNA, 201 bp, Homo sapiens
aggaggaaacagctggggtcgtgtccaccaacctgatccgtaatggagactggaccttccagatcctggtgatgctggaaatgaccccccagcagggagaygtctacacctgccaagtggagcacaccagcctggatagtcctgtcaccgtggagtggaaggcacagtctgattctgcccggagtaagacattgacgggag

SEQ ID NO: 5276 - DNA, 201 bp, Homo sapiens
tcctggagagatacatctacaaccgggaggagttcgcgcgcttcgacagcgacgtgggggagttccgggcggtgacggagctggggcggcctgctgcggastactggaacagccagaaggacatcctggaggagaagcgggcagtgccggacaggatgtgcagacacaactacgagctgggcgggcccatgaccctgcagc

SEQ ID NO: 5277 - DNA, 201 bp, Homo sapiens
acagctggggtcgtgtccaccaacctgatccgtaatggagactggaccttccagatcctggtgatgctggaaatgaccccccagcagggagatgtctacayctgccaagtggagcacaccagcctggatagtcctgtcaccgtggagtggaaggcacagtctgattctgcccggagtaagacattgacgggagctgggggc

SEQ ID NO: 5278 - DNA, 201 bp, Homo sapiens
ccgggaggagttcgcgcgcttcgacagcgacgtgggggagttccgggcggtgacggagctggggcggcctgctgcggagtactggaacagccagaaggacmtcctggaggagaagcgggcagtgccggacaggatgtgcagacacaactacgagctgggcgggcccatgaccctgcagcgccgagtccagcctagggtgaa

SEQ ID NO: 5279 - DNA, 201 bp, Homo sapiens
tccgtaatggagactggaccttccagatcctggtgatgctggaaatgaccccccagcagggagatgtctacacctgccaagtggagcacaccagcctggayagtcctgtcaccgtggagtggaaggcacagtctgattctgcccggagtaagacattgacgggagctgggggcttcgtgctggggctcatcatctgtggag

SEQ ID NO: 5280 - DNA, 201 bp, Homo sapiens
aaggacatcctggaggagaagcgggcagtgccggacaggatgtgcagacacaactacgagctgggcgggcccatgaccctgcagcgccgagtccagcctarggtgaatgtttccccctccaagaaggggcccttgcagcaccacaacctgcttgtctgccacgtgacggatttctacccaggcagcattcaagtccgatgg

SEQ ID NO: 5281 - DNA, 201 bp, Homo sapiens
cagcgccgagtccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 5282 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgagtccagcctagggtgaatgtttccccctccaagaaggggcccttgcagcaccacaacctgcttgtctgccacgtgacggatt

SEQ ID NO: 5283 - DNA, 201 bp, Homo sapiens
gagctgggcgggcccatgaccctgcagcgccgagtccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 5284 - DNA, 201 bp, Homo sapiens
ggccactccagagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 5285 - DNA, 201 bp, Homo sapiens
gtgccggacaggatgtgcagacacaactacgagctgggcgggcccatgaccctgcagcgccgagtccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 5286 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgagtccagcctagggtgaatgtttccccctccaagaaggggcccttgcagcaccacaacctgcttgtctgccacgtgacgga

SEQ ID NO: 5287 - DNA, 201 bp, Homo sapiens
ctgcataaacagggttcctgagctcactgaaaagactattgtgccttaggaaaagcatttgctgtgtttcgttagcatctggctccaggacagaccttcarcttccaaattggatactgctgccaagaagttgctctgaagtcagtttctatcattctgctctttgattcaaagcactgtttctctcactgggcctccaac

SEQ ID NO: 5288 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgagtccagcctagggtgaatgtttccccctccaagaaggggcccttgcagcaccacaacctgcttgtctgccacgtgacggattt

SEQ ID NO: 5289 - DNA, 201 bp, Homo sapiens
aaacagggttcctgagctcactgaaaagactattgtgccttaggaaaagcatttgctgtgtttcgttagcatctggctccaggacagaccttcaacttccmaattggatactgctgccaagaagttgctctgaagtcagtttctatcattctgctctttgattcaaagcactgtttctctcactgggcctccaaccatgtt

SEQ ID NO: 5290 - DNA, 201 bp, Homo sapiens
tcctggaggagaagcgggcagtgccggacaggatgtgcagacacaactacgagctgggcgggcccatgaccctgcagcgccgagtccagcctagggtgaaygtttccccctccaagaaggggcccttgcagcaccacaacctgcttgtctgccacgtgacggatttctacccaggcagcattcaagtccgatggttcctga

SEQ ID NO: 5291 - DNA, 201 bp, Homo sapiens; identical to SEQ ID NO: 5234

SEQ ID NO: 5292 - DNA, 144 bp, Homo sapiens; identical to SEQ ID NO: 5235

SEQ ID NO: 5293 - DNA, 201 bp, Homo sapiens; identical to SEQ ID NO: 5236

SEQ ID NO: 5294 - DNA, 201 bp, Homo sapiens; identical to SEQ ID NO: 5237

SEQ ID NO: 5295 - DNA, 201 bp, Homo sapiens; identical to SEQ ID NO: 5238

SEQ ID NO: 5296 - DNA, 201 bp, Homo sapiens; identical to SEQ ID NO: 5239

SEQ ID NO: 5297 - DNA, 201 bp, Homo sapiens; identical to SEQ ID NO: 5240

SEQ ID NO: 5298 - DNA, 201 bp, Homo sapiens; identical to SEQ ID NO: 5241

SEQ ID NO: 5299 - DNA, 201 bp, Homo sapiens; identical to SEQ ID NO: 5242

SEQ ID NO: 5300 - DNA, 201 bp, Homo sapiens; identical to SEQ ID NO: 5243

SEQ ID NO: 5301 - DNA, 201 bp, Homo sapiens
gctcatcatctgtggagtgggcatcttcatgcacaggaggagcaagaaagttcaacgaggatctgcataaacagggttcctgagctcactgaaaagactawtgtgccttaggaaaattggatactgctgccaagaagttgctctgaagtcagtttctatcattctgctctttgattcaaagcactgtttctctcactgggc

SEQ ID NO: 5302 - DNA, 201 bp, Homo sapiens
gggggcttcgtgctggggctcatcatctgtggagtgggcatcttcatgcacaggaggagcaagaaagttcaacgaggatctgcataaacagggttcctgasctcactgaaaagactattgtgccttaggaaaattggatactgctgccaagaagttgctctgaagtcagtttctatcattctgctctttgattcaaagcac

SEQ ID NO: 5303 - DNA, 201 bp, Homo sapiens; identical to SEQ ID NO: 5247

SEQ ID NO: 5304 - DNA, 201 bp, Homo sapiens; identical to SEQ ID NO: 5248

SEQ ID NO: 5305 - DNA, 201 bp, Homo sapiens; identical to SEQ ID NO: 5249

SEQ ID NO: 5306 - DNA, 201 bp, Homo sapiens; identical to SEQ ID NO: 5250

SEQ ID NO: 5307 - DNA, 201 bp, Homo sapiens; identical to SEQ ID NO: 5251

SEQ ID NO: 5308 - DNA, 201 bp, Homo sapiens
gtgggcatcttcatgcacaggaggagcaagaaagttcaacgaggatctgcataaacagggttcctgagctcactgaaaagactattgtgccttaggaaaaktggatactgctgccaagaagttgctctgaagtcagtttctatcattctgctctttgattcaaagcactgtttctctcactgggcctccaaccatgttccc

SEQ ID NO: 5309 - DNA, 201 bp, Homo sapiens; identical to SEQ ID NO: 5253

SEQ ID NO: 5310 - DNA, 201 bp, Homo sapiens
tgggcatcttcatgcacaggaggagcaagaaagttcaacgaggatctgcataaacagggttcctgagctcactgaaaagactattgtgccttaggaaaatwggatactgctgccaagaagttgctctgaagtcagtttctatcattctgctctttgattcaaagcactgtttctctcactgggcctccaaccatgttccct

SEQ ID NO: 5311 - DNA, 194 bp, Homo sapiens
atctgcataaacagggttcctgagctcactgaaaagactattgtgccttaggaaaattggatactgctgccaagaagttgctctgaagtcagtttctatcrttctgctctttgattcaaagcactgtttctctcactgggcctccaaccatgttcccttcttcttagcaccacaaataatcaaaacccaacatg

SEQ ID NO: 5312 - DNA, 201 bp, Homo sapiens; identical to SEQ ID NO: 5258

SEQ ID NO: 5313 - DNA, 201 bp, Homo sapiens; identical to SEQ ID NO: 5259

SEQ ID NO: 5314 - DNA, 101 bp, Homo sapiens
ttctatcattctgctctttgattcaaagcactgtttctctcactgggcctccaaccatgttcccttcttcttagcaccacaaataatcaaaacccaacatr

SEQ ID NO: 5315 - DNA, 201 bp, Homo sapiens; identical to SEQ ID NO: 5269

SEQ ID NO: 5316 - DNA, 201 bp, Homo sapiens; identical to SEQ ID NO: 5270

SEQ ID NO: 5317 - DNA, 201 bp, Homo sapiens
ttcgtgctggggctcatcatctgtggagtgggcatcttcatgcacaggaggagcaagaaagttcaacgaggatctgcataaacagggttcctgagctcacygaaaagactattgtgccttaggaaaattggatactgctgccaagaagttgctctgaagtcagtttctatcattctgctctttgattcaaagcactgtttc

SEQ ID NO: 5318 - DNA, 201 bp, Homo sapiens; identical to SEQ ID NO: 5271

SEQ ID NO: 5319 - DNA, 201 bp, Homo sapiens; identical to SEQ ID NO: 5274

SEQ ID NO: 5320 - DNA, 201 bp, Homo sapiens; identical to SEQ ID NO: 5273

SEQ ID NO: 5321 - DNA, 201 bp, Homo sapiens; identical to SEQ ID NO: 5275

SEQ ID NO: 5322 - DNA, 201 bp, Homo sapiens; identical to SEQ ID NO: 5276

SEQ ID NO: 5323 - DNA, 201 bp, Homo sapiens; identical to SEQ ID NO: 5277

SEQ ID NO: 5324 - DNA, 201 bp, Homo sapiens; identical to SEQ ID NO: 5278

SEQ ID NO: 5325 - DNA, 201 bp, Homo sapiens; identical to SEQ ID NO: 5279

SEQ ID NO: 5326 - DNA, 201 bp, Homo sapiens; identical to SEQ ID NO: 5280

SEQ ID NO: 5327 - DNA, 201 bp, Homo sapiens; identical to SEQ ID NO: 5281

SEQ ID NO: 5328 - DNA, 201 bp, Homo sapiens; identical to SEQ ID NO: 5282

SEQ ID NO: 5329 - DNA, 201 bp, Homo sapiens; identical to SEQ ID NO: 5283

SEQ ID NO: 5330 - DNA, 201 bp, Homo sapiens; identical to SEQ ID NO: 5284

SEQ ID NO: 5331 - DNA, 201 bp, Homo sapiens; identical to SEQ ID NO: 5285

SEQ ID NO: 5332 - DNA, 201 bp, Homo sapiens; identical to SEQ ID NO: 5286

SEQ ID NO: 5333 - DNA, 201 bp, Homo sapiens; identical to SEQ ID NO: 5288

SEQ ID NO: 5334 - DNA, 201 bp, Homo sapiens; identical to SEQ ID NO: 5290

SEQ ID NO: 5335 - DNA, 201 bp, Homo sapiens; identical to SEQ ID NO: 5234

SEQ ID NO: 5336 - DNA, 144 bp, Homo sapiens; identical to SEQ ID NO: 5235

SEQ ID NO: 5337 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgaggctggagtgctgtggcaccatcatggct

SEQ ID NO: 5338 - DNA, 201 bp, Homo sapiens; identical to SEQ ID NO: 5238

SEQ ID NO: 5339 - DNA, 201 bp, Homo sapiens
ggaacttgaaaaaggacgggatttctactactcaagcatgtaggagctcaggatattcttccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 5340 - DNA, 201 bp, Homo sapiens; identical to SEQ ID NO: 5239

SEQ ID NO: 5341 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgaggctggagtgctgtggcaccatcatggctcactgcagcctcaacctcctg

SEQ ID NO: 5342 - DNA, 201 bp, Homo sapiens; identical to SEQ ID NO: 5241

SEQ ID NO: 5343 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggctggagtgctgtggcaccatcatggctcactgcagcctcaacctcctggg

SEQ ID NO: 5344 - DNA, 201 bp, Homo sapiens; identical to SEQ ID NO: 5243

SEQ ID NO: 5345 - DNA, 201 bp, Homo sapiens; identical to SEQ ID NO: 5245

SEQ ID NO: 5346 - DNA, 201 bp, Homo sapiens; identical to SEQ ID NO: 5246

SEQ ID NO: 5347 - DNA, 201 bp, Homo sapiens; identical to SEQ ID NO: 5247

SEQ ID NO: 5348 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgaggctggagtgctgtggcaccatcatggctcactgcagcctcaacctcctgggctcaagtgatcctcctgcctcag

SEQ ID NO: 5349 - DNA, 201 bp, Homo sapiens; identical to SEQ ID NO: 5249

SEQ ID NO: 5350 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgaggctggagtgctgtggcaccatcatggctc

SEQ ID NO: 5351 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgaggctggagtgctgtggcaccatcatggctcactgcagcctcaacctcctgggctcaagtgatcctcctgcctcagcct

SEQ ID NO: 5352 - DNA, 201 bp, Homo sapiens; identical to SEQ ID NO: 5252

SEQ ID NO: 5353 - DNA, 201 bp, Homo sapiens; identical to SEQ ID NO: 5254

SEQ ID NO: 5354 - DNA, 201 bp, Homo sapiens; identical to SEQ ID NO: 5255

SEQ ID NO: 5355 - DNA, 201 bp, Homo sapiens; identical to SEQ ID NO: 5253

SEQ ID NO: 5356 - DNA, 201 bp, Homo sapiens; identical to SEQ ID NO: 5256

SEQ ID NO: 5357 - DNA, 194 bp, Homo sapiens
agcatttgctgtgtttcgttagcatctggctccaggacagaccttcaacttccaaattggatactgctgccaagaagttgctctgaagtcagtttctatcrttctgctctttgattcaaagcactgtttctctcactgggcctccaaccatgttcccttcttcttagcaccacaaataatcaaaacccaacatg

SEQ ID NO: 5358 - DNA, 201 bp, Homo sapiens; identical to SEQ ID NO: 5258

SEQ ID NO: 5359 - DNA, 201 bp, Homo sapiens; identical to SEQ ID NO: 5259

SEQ ID NO: 5360 - DNA, 101 bp, Homo sapiens; identical to SEQ ID NO: 5314

SEQ ID NO: 5361 - DNA, 201 bp, Homo sapiens; identical to SEQ ID NO: 5263

SEQ ID NO: 5362 - DNA, 201 bp, Homo sapiens; identical to SEQ ID NO: 5265

SEQ ID NO: 5363 - DNA, 201 bp, Homo sapiens; identical to SEQ ID NO: 5267

SEQ ID NO: 5364 - DNA, 201 bp, Homo sapiens; identical to SEQ ID NO: 5269

SEQ ID NO: 5365 - DNA, 201 bp, Homo sapiens; identical to SEQ ID NO: 5270

SEQ ID NO: 5366 - DNA, 201 bp, Homo sapiens; identical to SEQ ID NO: 5272

SEQ ID NO: 5367 - DNA, 201 bp, Homo sapiens; identical to SEQ ID NO: 5271

SEQ ID NO: 5368 - DNA, 201 bp, Homo sapiens
gcatgtaggagctcaggatattcttccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 5369 - DNA, 201 bp, Homo sapiens; identical to SEQ ID NO: 5273

SEQ ID NO: 5370 - DNA, 201 bp, Homo sapiens; identical to SEQ ID NO: 5275

SEQ ID NO: 5371 - DNA, 201 bp, Homo sapiens; identical to SEQ ID NO: 5276

SEQ ID NO: 5372 - DNA, 201 bp, Homo sapiens
ccgggaggagttcgcgcgcttcgacagcgacgtgggggagttccgggcggtgacggagctggggcggcctgctgcggagtactggaacagccagaaggacmtcctggaggagaagcgggcagtgccggacaggatgtgcagacacaactacgagctgggcgggcccatgaccctgcagcgccgaggctggagtgctgtggc

SEQ ID NO: 5373 - DNA, 201 bp, Homo sapiens; identical to SEQ ID NO: 5277

SEQ ID NO: 5374 - DNA, 201 bp, Homo sapiens; identical to SEQ ID NO: 5279

SEQ ID NO: 5375 - DNA, 201 bp, Homo sapiens
cttcatgggacctgaagacgcagcacagaggaggaacttgaaaaaggacgggatttctactactcaagcatgtaggagctcaggatattcttccagcctarggtgaatgtttccccctccaagaaggggcccttgcagcaccacaacctgcttgtctgccacgtgacggatttctacccaggcagcattcaagtccgatgg

SEQ ID NO: 5376 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgaggctggagtgctgtggcaccatcatggctcactgcagcctcaacctcctgggctcaagtgatcctcctgcctcagcctccca

SEQ ID NO: 5377 - DNA, 201 bp, Homo sapiens
aggatattcttccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 5378 - DNA, 201 bp, Homo sapiens; identical to SEQ ID NO: 5284

SEQ ID NO: 5379 - DNA, 201 bp, Homo sapiens
tactactcaagcatgtaggagctcaggatattcttccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 5380 - DNA, 201 bp, Homo sapiens
gaggaggaacttgaaaaaggacgggatttctactactcaagcatgtaggagctcaggatattcttccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 5381 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgaggctggagtgctgtggcaccatcatggctcactgcagcctcaacctcctgggctcaagtgatcctcctgcctcagcctcc

SEQ ID NO: 5382 - DNA, 201 bp, Homo sapiens; identical to SEQ ID NO: 5287

SEQ ID NO: 5383 - DNA, 201 bp, Homo sapiens; identical to SEQ ID NO: 5289

SEQ ID NO: 5384 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggctggagtgctgtggcaccatcatggctcactgcagcctcaacctcctgggctcaagtgatcctcctgcctcagcctcccat

SEQ ID NO: 5385 - DNA, 201 bp, Homo sapiens
ggacctgaagacgcagcacagaggaggaacttgaaaaaggacgggatttctactactcaagcatgtaggagctcaggatattcttccagcctagggtgaaygtttccccctccaagaaggggcccttgcagcaccacaacctgcttgtctgccacgtgacggatttctacccaggcagcattcaagtccgatggttcctga

SEQ ID NO: 5386 - DNA, 201 bp, Homo sapiens; identical to SEQ ID NO: 5234

SEQ ID NO: 5387 - DNA, 148 bp, Homo sapiens
caggagctccctttagcgagtccttcttttcctgactgcagctctttycattttgccatccttttccagctccatgatggttctgcaggtttctgcggccccccggacagtggctctgacggcgttactgatggtgctgctcacatct

SEQ ID NO: 5388 - DNA, 201 bp, Homo sapiens; identical to SEQ ID NO: 5236

SEQ ID NO: 5389 - DNA, 201 bp, Homo sapiens; identical to SEQ ID NO: 5237

SEQ ID NO: 5390 - DNA, 201 bp, Homo sapiens; identical to SEQ ID NO: 5240

SEQ ID NO: 5391 - DNA, 201 bp, Homo sapiens
atcttcatgcacaggaggagcaagaaaggtgagaaagcctgcagggtgagcgggacttaccttcccctggcatattcacacttattccacgatgaggggtytgacagaaaagaaatgtcagaaagctctagaggccactgatatcagataatcggggaacaaacatgacctatagcgagagagggatcccaggctgggatc

SEQ ID NO: 5392 - DNA, 201 bp, Homo sapiens
atgatggttctgcaggtttctgcggccccccggacagtggctctgacggcgttactgatggtgctgctcacatctgtggtccagggcagggccactccagkgacggcaggaatgctacgcgtttaatgggacacagcgcttcctggagagatacatctacaaccgggaggagttcgcgcgcttcgacagcgacgtggggga

SEQ ID NO: 5393 - DNA, 201 bp, Homo sapiens; identical to SEQ ID NO: 5242

SEQ ID NO: 5394 - DNA, 201 bp, Homo sapiens
accataatttttctctcctggacttacaggaaggaggctggcaacctgggataacttgtcttttacccccacagggttcctgagctcactgaaaagactawtgtgccttaggaaaagcatttgctgtgtttcgttagcatctggctccaggacagaccttcaacttccaaattggatactgctgccaagaagttgctctga

SEQ ID NO: 5395 - DNA, 201 bp, Homo sapiens
ctgagacgcatcctctcaccataatttttctctcctggacttacaggaaggaggctggcaacctgggataacttgtcttttacccccacagggttcctgasctcactgaaaagactattgtgccttaggaaaagcatttgctgtgtttcgttagcatctggctccaggacagaccttcaacttccaaattggatactgctg

SEQ ID NO: 5396 - DNA, 201 bp, Homo sapiens; identical to SEQ ID NO: 5247

SEQ ID NO: 5397 - DNA, 201 bp, Homo sapiens; identical to SEQ ID NO: 5248

SEQ ID NO: 5398 - DNA, 201 bp, Homo sapiens; identical to SEQ ID NO: 5249

SEQ ID NO: 5399 - DNA, 201 bp, Homo sapiens; identical to SEQ ID NO: 5250

SEQ ID NO: 5400 - DNA, 201 bp, Homo sapiens; identical to SEQ ID NO: 5251

SEQ ID NO: 5401 - DNA, 201 bp, Homo sapiens; identical to SEQ ID NO: 5252

SEQ ID NO: 5402 - DNA, 201 bp, Homo sapiens; identical to SEQ ID NO: 5253

SEQ ID NO: 5403 - DNA, 201 bp, Homo sapiens
aggaggctggcaacctgggataacttgtcttttacccccacagggttcctgagctcactgaaaagactattgtgccttaggaaaagcatttgctgtgtttygttagcatctggctccaggacagaccttcaacttccaaattggatactgctgccaagaagttgctctgaagtcagtttctatcattctgctctttgattc

SEQ ID NO: 5404 - DNA, 201 bp, Homo sapiens; identical to SEQ ID NO: 5255

SEQ ID NO: 5405 - DNA, 201 bp, Homo sapiens
gctggcaacctgggataacttgtcttttacccccacagggttcctgagctcactgaaaagactattgtgccttaggaaaagcatttgctgtgtttcgttarcatctggctccaggacagaccttcaacttccaaattggatactgctgccaagaagttgctctgaagtcagtttctatcattctgctctttgattcaaagc

SEQ ID NO: 5406 - DNA, 194 bp, Homo sapiens; identical to SEQ ID NO: 5357

SEQ ID NO: 5407 - DNA, 201 bp, Homo sapiens; identical to SEQ ID NO: 5258

SEQ ID NO: 5408 - DNA, 201 bp, Homo sapiens
ctcacatctgtggtccagggcagggccactccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 5409 - DNA, 101 bp, Homo sapiens; identical to SEQ ID NO: 5314

SEQ ID NO: 5410 - DNA, 201 bp, Homo sapiens
ggcaacctgggataacttgtcttttacccccacagggttcctgagctcactgaaaagactattgtgccttaggaaaagcatttgctgtgtttcgttagcayctggctccaggacagaccttcaacttccaaattggatactgctgccaagaagttgctctgaagtcagtttctatcattctgctctttgattcaaagcact

SEQ ID NO: 5411 - DNA, 201 bp, Homo sapiens
cctgggataacttgtcttttacccccacagggttcctgagctcactgaaaagactattgtgccttaggaaaagcatttgctgtgtttcgttagcatctggytccaggacagaccttcaacttccaaattggatactgctgccaagaagttgctctgaagtcagtttctatcattctgctctttgattcaaagcactgtttc

SEQ ID NO: 5412 - DNA, 201 bp, Homo sapiens
tcttttacccccacagggttcctgagctcactgaaaagactattgtgccttaggaaaagcatttgctgtgtttcgttagcatctggctccaggacagaccytcaacttccaaattggatactgctgccaagaagttgctctgaagtcagtttctatcattctgctctttgattcaaagcactgtttctctcactgggcctc

SEQ ID NO: 5413 - DNA, 201 bp, Homo sapiens
tgatggttctgcaggtttctgcggccccccggacagtggctctgacggcgttactgatggtgctgctcacatctgtggtccagggcagggccactccaggkacggcaggaatgctacgcgtttaatgggacacagcgcttcctggagagatacatctacaaccgggaggagttcgcgcgcttcgacagcgacgtgggggag

SEQ ID NO: 5414 - DNA, 201 bp, Homo sapiens
cagggtgagcgggacttaccttcccctggcatattcacacttattccacgatgaggggtttgacagaaaagaaatgtcagaaagctctagaggccactgawatcagataatcggggaacaaacatgacctatagcgagagagggatcccaggctgggatcttaatgcagccagatgcatgaggtcccaagtactcaggctc

SEQ ID NO: 5415 - DNA, 201 bp, Homo sapiens
ctgtggtccagggcagggccactccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 5416 - DNA, 201 bp, Homo sapiens
cgcatcctctcaccataatttttctctcctggacttacaggaaggaggctggcaacctgggataacttgtcttttacccccacagggttcctgagctcacygaaaagactattgtgccttaggaaaagcatttgctgtgtttcgttagcatctggctccaggacagaccttcaacttccaaattggatactgctgccaaga

SEQ ID NO: 5417 - DNA, 201 bp, Homo sapiens
tcttcatgcacaggaggagcaagaaaggtgagaaagcctgcagggtgagcgggacttaccttcccctggcatattcacacttattccacgatgaggggttwgacagaaaagaaatgtcagaaagctctagaggccactgatatcagataatcggggaacaaacatgacctatagcgagagagggatcccaggctgggatct

SEQ ID NO: 5418 - DNA, 201 bp, Homo sapiens
tggtccagggcagggccactccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 5419 - DNA, 201 bp, Homo sapiens; identical to SEQ ID NO: 5273

SEQ ID NO: 5420 - DNA, 201 bp, Homo sapiens; identical to SEQ ID NO: 5274

SEQ ID NO: 5421 - DNA, 201 bp, Homo sapiens; identical to SEQ ID NO: 5275

SEQ ID NO: 5422 - DNA, 201 bp, Homo sapiens; identical to SEQ ID NO: 5276

SEQ ID NO: 5423 - DNA, 201 bp, Homo sapiens; identical to SEQ ID NO: 5278

SEQ ID NO: 5424 - DNA, 201 bp, Homo sapiens; identical to SEQ ID NO: 5277

SEQ ID NO: 5425 - DNA, 201 bp, Homo sapiens; identical to SEQ ID NO: 5279

SEQ ID NO: 5426 - DNA, 201 bp, Homo sapiens; identical to SEQ ID NO: 5280

SEQ ID NO: 5427 - DNA, 201 bp, Homo sapiens; identical to SEQ ID NO: 5282

SEQ ID NO: 5428 - DNA, 201 bp, Homo sapiens; identical to SEQ ID NO: 5281

SEQ ID NO: 5429 - DNA, 201 bp, Homo sapiens
ttattccacgatgaggggtttgacagaaaagaaatgtcagaaagctctagaggccactgatatcagataatcggggaacaaacatgacctatagcgagagdgggatcccaggctgggatcttaatgcagccagatgcatgaggtcccaagtactcaggctcctgcggagcgtccattgagtgatgggcaatggaatttggt

SEQ ID NO: 5430 - DNA, 201 bp, Homo sapiens
tctgtggtccagggcagggccactccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 5431 - DNA, 201 bp, Homo sapiens; identical to SEQ ID NO: 5283

SEQ ID NO: 5432 - DNA, 201 bp, Homo sapiens
attcacacttattccacgatgaggggtttgacagaaaagaaatgtcagaaagctctagaggccactgatatcagataatcggggaacaaacatgacctatrgcgagagagggatcccaggctgggatcttaatgcagccagatgcatgaggtcccaagtactcaggctcctgcggagcgtccattgagtgatgggcaatgg

SEQ ID NO: 5433 - DNA, 201 bp, Homo sapiens; identical to SEQ ID NO: 5285

SEQ ID NO: 5434 - DNA, 201 bp, Homo sapiens
cgggacttaccttcccctggcatattcacacttattccacgatgaggggtttgacagaaaagaaatgtcagaaagctctagaggccactgatatcagatartcggggaacaaacatgacctatagcgagagagggatcccaggctgggatcttaatgcagccagatgcatgaggtcccaagtactcaggctcctgcggagc

SEQ ID NO: 5435 - DNA, 201 bp, Homo sapiens; identical to SEQ ID NO: 5286

SEQ ID NO: 5436 - DNA, 201 bp, Homo sapiens
ttacccccacagggttcctgagctcactgaaaagactattgtgccttaggaaaagcatttgctgtgtttcgttagcatctggctccaggacagaccttcarcttccaaattggatactgctgccaagaagttgctctgaagtcagtttctatcattctgctctttgattcaaagcactgtttctctcactgggcctccaac

SEQ ID NO: 5437 - DNA, 201 bp, Homo sapiens; identical to SEQ ID NO: 5288

SEQ ID NO: 5438 - DNA, 201 bp, Homo sapiens
ccacagggttcctgagctcactgaaaagactattgtgccttaggaaaagcatttgctgtgtttcgttagcatctggctccaggacagaccttcaacttccmaattggatactgctgccaagaagttgctctgaagtcagtttctatcattctgctctttgattcaaagcactgtttctctcactgggcctccaaccatgtt

SEQ ID NO: 5439 - DNA, 201 bp, Homo sapiens; identical to SEQ ID NO: 5290

SEQ ID NO: 5440 - DNA, 201 bp, Homo sapiens; identical to SEQ ID NO: 5269

SEQ ID NO: 5441 - DNA, 144 bp, Homo sapiens; identical to SEQ ID NO: 5235

SEQ ID NO: 5442 - DNA, 201 bp, Homo sapiens; identical to SEQ ID NO: 5270

SEQ ID NO: 5443 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgagaggcacagtctgattctgcccggagtaa

SEQ ID NO: 5444 - DNA, 201 bp, Homo sapiens; identical to SEQ ID NO: 5271

SEQ ID NO: 5445 - DNA, 201 bp, Homo sapiens; identical to SEQ ID NO: 5238

SEQ ID NO: 5446 - DNA, 201 bp, Homo sapiens; identical to SEQ ID NO: 5317

SEQ ID NO: 5447 - DNA, 201 bp, Homo sapiens; identical to SEQ ID NO: 5239

SEQ ID NO: 5448 - DNA, 201 bp, Homo sapiens; identical to SEQ ID NO: 5273

SEQ ID NO: 5449 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgagaggcacagtctgattctgcccggagtaagacattgacgggagctggggg

SEQ ID NO: 5450 - DNA, 201 bp, Homo sapiens; identical to SEQ ID NO: 5241

SEQ ID NO: 5451 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgagaggcacagtctgattctgcccggagtaagacattgacgggagctgggggct

SEQ ID NO: 5452 - DNA, 201 bp, Homo sapiens; identical to SEQ ID NO: 5243

SEQ ID NO: 5453 - DNA, 201 bp, Homo sapiens; identical to SEQ ID NO: 5276

SEQ ID NO: 5454 - DNA, 201 bp, Homo sapiens
ccgggaggagttcgcgcgcttcgacagcgacgtgggggagttccgggcggtgacggagctggggcggcctgctgcggagtactggaacagccagaaggacmtcctggaggagaagcgggcagtgccggacaggatgtgcagacacaactacgagctgggcgggcccatgaccctgcagcgccgagaggcacagtctgattc

SEQ ID NO: 5455 - DNA, 201 bp, Homo sapiens; identical to SEQ ID NO: 5301

SEQ ID NO: 5456 - DNA, 201 bp, Homo sapiens; identical to SEQ ID NO: 5302

SEQ ID NO: 5457 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgagaggcacagtctgattctgcccggagtaagacattgacgggagctgggggcttcgtgctggggctcatcatctgtggagtgg

SEQ ID NO: 5458 - DNA, 201 bp, Homo sapiens; identical to SEQ ID NO: 5284

SEQ ID NO: 5459 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgagaggcacagtctgattctgcccggagtaagacattgacgggagctgggggcttcgtgctggggctcatcatctgt

SEQ ID NO: 5460 - DNA, 201 bp, Homo sapiens; identical to SEQ ID NO: 5249

SEQ ID NO: 5461 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgagaggcacagtctgattctgcccggagtaag

SEQ ID NO: 5462 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgagaggcacagtctgattctgcccggagtaagacattgacgggagctgggggcttcgtgctggggctcatcatctgtgga

SEQ ID NO: 5463 - DNA, 201 bp, Homo sapiens; identical to SEQ ID NO: 5308

SEQ ID NO: 5464 - DNA, 201 bp, Homo sapiens; identical to SEQ ID NO: 5310

SEQ ID NO: 5465 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgagaggcacagtctgattctgcccggagtaagacattgacgggagctgggggcttcgtgctggggctcatcatctgtggagt

SEQ ID NO: 5466 - DNA, 194 bp, Homo sapiens; identical to SEQ ID NO: 5311

SEQ ID NO: 5467 - DNA, 201 bp, Homo sapiens; identical to SEQ ID NO: 5258

SEQ ID NO: 5468 - DNA, 201 bp, Homo sapiens; identical to SEQ ID NO: 5259

SEQ ID NO: 5469 - DNA, 101 bp, Homo sapiens; identical to SEQ ID NO: 5314

SEQ ID NO: 5470 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgagaggcacagtctgattctgcccggagtaagacattgacgggagctgggggcttcgtgctggggctcatcatctgtggagtggg

SEQ ID NO: 5471 - DNA, 168 bp, Homo sapiens
atggtgcccttgagcccagccctaccccatctccactatcctctgccaccagctgtgcaacttctgcwaggggtgaggttaataaactggagaaagaattaccttttccagggacggcaggaatgctacgcgtttaatgggacacagcgcttcctggagagatacatc

SEQ ID NO: 5472 - DNA, 201 bp, Homo sapiens; identical to SEQ ID NO: 5234

SEQ ID NO: 5473 - DNA, 201 bp, Homo sapiens; identical to SEQ ID NO: 5236

SEQ ID NO: 5474 - DNA, 201 bp, Homo sapiens; identical to SEQ ID NO: 5237

SEQ ID NO: 5475 - DNA, 201 bp, Homo sapiens
ggtgcccttgagcccagccctaccccatctccactatcctctgccaccagctgtgcaacttctgctaggggtgaggttaataaactggagaaagaattacsttttccagggacggcaggaatgctacgcgtttaatgggacacagcgcttcctggagagatacatctacaaccgggaggagttcgcgcgcttcgacagcga

SEQ ID NO: 5476 - DNA, 201 bp, Homo sapiens
tgcccttgagcccagccctaccccatctccactatcctctgccaccagctgtgcaacttctgctaggggtgaggttaataaactggagaaagaattacctkttccagggacggcaggaatgctacgcgtttaatgggacacagcgcttcctggagagatacatctacaaccgggaggagttcgcgcgcttcgacagcgacg

SEQ ID NO: 5477 - DNA, 201 bp, Homo sapiens; identical to SEQ ID NO: 5240

SEQ ID NO: 5478 - DNA, 201 bp, Homo sapiens
cccttgagcccagccctaccccatctccactatcctctgccaccagctgtgcaacttctgctaggggtgaggttaataaactggagaaagaattacctttwccagggacggcaggaatgctacgcgtttaatgggacacagcgcttcctggagagatacatctacaaccgggaggagttcgcgcgcttcgacagcgacgtg

SEQ ID NO: 5479 - DNA, 201 bp, Homo sapiens
gagcccagccctaccccatctccactatcctctgccaccagctgtgcaacttctgctaggggtgaggttaataaactggagaaagaattaccttttccagkgacggcaggaatgctacgcgtttaatgggacacagcgcttcctggagagatacatctacaaccgggaggagttcgcgcgcttcgacagcgacgtggggga

SEQ ID NO: 5480 - DNA, 201 bp, Homo sapiens; identical to SEQ ID NO: 5242

SEQ ID NO: 5481 - DNA, 108 bp, Homo sapiens
aatggtgagcagactgcaaatctgcctgataggacccatattcccacagcactaattcaacatataccttactgagagcatgttttatcattaccattaakaagttaa

SEQ ID NO: 5482 - DNA, 201 bp, Homo sapiens; identical to SEQ ID NO: 5245

SEQ ID NO: 5483 - DNA, 201 bp, Homo sapiens; identical to SEQ ID NO: 5246

SEQ ID NO: 5484 - DNA, 201 bp, Homo sapiens; identical to SEQ ID NO: 5247

SEQ ID NO: 5485 - DNA, 201 bp, Homo sapiens; identical to SEQ ID NO: 5248

SEQ ID NO: 5486 - DNA, 201 bp, Homo sapiens; identical to SEQ ID NO: 5249

SEQ ID NO: 5487 - DNA, 201 bp, Homo sapiens; identical to SEQ ID NO: 5250

SEQ ID NO: 5488 - DNA, 201 bp, Homo sapiens; identical to SEQ ID NO: 5251

SEQ ID NO: 5489 - DNA, 201 bp, Homo sapiens; identical to SEQ ID NO: 5252

SEQ ID NO: 5490 - DNA, 201 bp, Homo sapiens; identical to SEQ ID NO: 5253

SEQ ID NO: 5491 - DNA, 201 bp, Homo sapiens; identical to SEQ ID NO: 5254

SEQ ID NO: 5492 - DNA, 201 bp, Homo sapiens; identical to SEQ ID NO: 5255

SEQ ID NO: 5493 - DNA, 201 bp, Homo sapiens; identical to SEQ ID NO: 5256

SEQ ID NO: 5494 - DNA, 201 bp, Homo sapiens; identical to SEQ ID NO: 5257

SEQ ID NO: 5495 - DNA, 201 bp, Homo sapiens; identical to SEQ ID NO: 5258

SEQ ID NO: 5496 - DNA, 201 bp, Homo sapiens
gttaataaactggagaaagaattaccttttccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 5497 - DNA, 201 bp, Homo sapiens; identical to SEQ ID NO: 5260

SEQ ID NO: 5498 - DNA, 201 bp, Homo sapiens; identical to SEQ ID NO: 5261

SEQ ID NO: 5499 - DNA, 201 bp, Homo sapiens; identical to SEQ ID NO: 5262

SEQ ID NO: 5500 - DNA, 201 bp, Homo sapiens; identical to SEQ ID NO: 5263

SEQ ID NO: 5501 - DNA, 201 bp, Homo sapiens; identical to SEQ ID NO: 5264

SEQ ID NO: 5502 - DNA, 201 bp, Homo sapiens; identical to SEQ ID NO: 5265

SEQ ID NO: 5503 - DNA, 201 bp, Homo sapiens; identical to SEQ ID NO: 5266

SEQ ID NO: 5504 - DNA, 201 bp, Homo sapiens; identical to SEQ ID NO: 5267

SEQ ID NO: 5505 - DNA, 201 bp, Homo sapiens; identical to SEQ ID NO: 5268

SEQ ID NO: 5506 - DNA, 201 bp, Homo sapiens
agcccagccctaccccatctccactatcctctgccaccagctgtgcaacttctgctaggggtgaggttaataaactggagaaagaattaccttttccaggkacggcaggaatgctacgcgtttaatgggacacagcgcttcctggagagatacatctacaaccgggaggagttcgcgcgcttcgacagcgacgtgggggag

SEQ ID NO: 5507 - DNA, 201 bp, Homo sapiens
aactggagaaagaattaccttttccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 5508 - DNA, 201 bp, Homo sapiens
tggagaaagaattaccttttccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 5509 - DNA, 201 bp, Homo sapiens; identical to SEQ ID NO: 5272

SEQ ID NO: 5510 - DNA, 201 bp, Homo sapiens; identical to SEQ ID NO: 5273

SEQ ID NO: 5511 - DNA, 201 bp, Homo sapiens; identical to SEQ ID NO: 5274

SEQ ID NO: 5512 - DNA, 201 bp, Homo sapiens; identical to SEQ ID NO: 5275

SEQ ID NO: 5513 - DNA, 201 bp, Homo sapiens; identical to SEQ ID NO: 5276

SEQ ID NO: 5514 - DNA, 201 bp, Homo sapiens; identical to SEQ ID NO: 5277

SEQ ID NO: 5515 - DNA, 201 bp, Homo sapiens; identical to SEQ ID NO: 5278

SEQ ID NO: 5516 - DNA, 201 bp, Homo sapiens; identical to SEQ ID NO: 5279

SEQ ID NO: 5517 - DNA, 201 bp, Homo sapiens; identical to SEQ ID NO: 5280

SEQ ID NO: 5518 - DNA, 201 bp, Homo sapiens; identical to SEQ ID NO: 5281

SEQ ID NO: 5519 - DNA, 201 bp, Homo sapiens; identical to SEQ ID NO: 5282

SEQ ID NO: 5520 - DNA, 201 bp, Homo sapiens; identical to SEQ ID NO: 5283

SEQ ID NO: 5521 - DNA, 201 bp, Homo sapiens
aaactggagaaagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 5522 - DNA, 201 bp, Homo sapiens; identical to SEQ ID NO: 5285

SEQ ID NO: 5523 - DNA, 201 bp, Homo sapiens; identical to SEQ ID NO: 5286

SEQ ID NO: 5524 - DNA, 201 bp, Homo sapiens; identical to SEQ ID NO: 5287

SEQ ID NO: 5525 - DNA, 201 bp, Homo sapiens; identical to SEQ ID NO: 5288

SEQ ID NO: 5526 - DNA, 201 bp, Homo sapiens; identical to SEQ ID NO: 5289

SEQ ID NO: 5527 - DNA, 201 bp, Homo sapiens; identical to SEQ ID NO: 5290

SEQ ID NO: 5528 - DNA, 201 bp, Homo sapiens
ccatgtcatgacctatgacctccatggctcctgggagggctacactggagagaacagccccctctacaaatacccgactgacaccggcagcaacgcctacstcaatgtggattatgtcatgaactactggaaggacaacagggccccagctgagaagctcatgttggattcccagcctatggacactccttccttctgagc

SEQ ID NO: 5529 - DNA, 201 bp, Homo sapiens
gctattggtggctggaactttggcactgctcctttcactgccatggtttccactcctgagaaccaccagactttcatcaactcagtcatcaaattcctgcrccagtatgagtttgacgggctggactttgactgggagtaccccggctctcgtgtgagccctcctcaggacaagcatctcttcactgtcctggtgcaggaa

SEQ ID NO: 5530 - DNA, 201 bp, Homo sapiens
ctgggcctgcagagtacaagttgcaaagctccagcccaacccattgctcccattgccgaggcaaacatcacatgcggtgtcagccacagtggtagctctgrgggccgctctggcaggagctctgggggcagccccagaggtagtggattctgtgctgacagggccagtggcctgtaccctgaccccactgacaagaatgcc

SEQ ID NO: 5531 - DNA, 201 bp, Homo sapiens
ccattgacctggatgatttcacaggcactttctgcaaccaaggaaaattccctctgatcaccaccctgaaggatgctctgggcctgcagagtacaagttgyaaagctccagcccaacccattgctcccattgccgaggcaaacatcacatgcggtgtcagccacagtggtagctctgggggccgctctggcaggagctctg

SEQ ID NO: 5532 - DNA, 201 bp, Homo sapiens
tgaaaaacaaaaatagtcaactgaaaactctcttggctattggtggctggaactttggcactgctcctttcactgccatggtttccactcctgagaaccaycagactttcatcaactcagtcatcaaattcctgcgccagtatgagtttgacgggctggactttgactgggagtaccccggctctcgtgtgagccctcctc

SEQ ID NO: 5533 - DNA, 201 bp, Homo sapiens
gaaggatgctctgggcctgcagagtacaagttgcaaagctccagcccaacccattgctcccattgccgaggcaaacatcacatgcggtgtcagccacagtsgtagctctgggggccgctctggcaggagctctgggggcagccccagaggtagtggattctgtgctgacagggccagtggcctgtaccctgaccccactga

SEQ ID NO: 5534 - DNA, 201 bp, Homo sapiens
agatctgtaccttcctgaagaatggagctactgaagtatgggaggcttctgaggatgttccctatgcctacaaaggaaatgagtggcttggatacgataayaccaagagtttccaaatcaaggtagactattggctaaagaagaacaactttggaggtgccatggtctgggccattgacctggatgatttcacaggcactt

SEQ ID NO: 5535 - DNA, 201 bp, Homo sapiens
tgcgccagtatgagtttgacgggctggactttgactgggagtaccccggctctcgtgtgagccctcctcaggacaagcatctcttcactgtcctggtgcargaaatgcgtgaagcttttgagcaggaggccaagcacattaataagcccaggctgatggtcactgctgcagtagctgctggcatctccaacatccagtctg

SEQ ID NO: 5536 - DNA, 174 bp, Homo sapiens
gggagcttgtctctcaccttctttctctgggtaacaggctctgcctaccagctgacatgttacttcaccaactrggcccagaaccagccaggcctggggtgcttcaagcctgatgacatcgacccctgcctctgtacccacttgatctacgcctttgctggaatgcagaacaac

SEQ ID NO: 5537 - DNA, 201 bp, Homo sapiens
cctgcagagtacaagttgcaaagctccagcccaacccattgctcccattgccgaggcaaacatcacatgcggtgtcagccacagtggtagctctgggggcygctctggcaggagctctgggggcagccccagaggtagtggattctgtgctgacagggccagtggcctgtaccctgaccccactgacaagaatgcctccta

SEQ ID NO: 5538 - DNA, 201 bp, Homo sapiens
actttctgcaaccaaggaaaattccctctgatcaccaccctgaaggatgctctgggcctgcagagtacaagttgcaaagctccagcccaacccattgctcycattgccgaggcaaacatcacatgcggtgtcagccacagtggtagctctgggggccgctctggcaggagctctgggggcagccccagaggtagtggattc

SEQ ID NO: 5539 - DNA, 201 bp, Homo sapiens
gtgaagcttttgagcaggaggccaagcacattaataagcccaggctgatggtcactgctgcagtagctgctggcatctccaacatccagtctggctatgasatcccccaactgtcacagtacccggactacatccatgtcatgacctatgacctccatggctcctgggagggctacactggagagaacagccccctctaca

SEQ ID NO: 5540 - DNA, 201 bp, Homo sapiens
agtacccggactacatccatgtcatgacctatgacctccatggctcctgggagggctacactggagagaacagccccctctacaaatacccgactgacacyggcagcaacgcctacctcaatgtggattatgtcatgaactactggaaggacaacagggccccagctgagaagctcatgttggattcccagcctatggaca

SEQ ID NO: 5541 - DNA, 201 bp, Homo sapiens
tctttctctgggtaacaggctctgcctaccagctgacatgttacttcaccaactgggcccagaaccagccaggcctggggtgcttcaagcctgatgacatygacccctgcctctgtacccacttgatctacgcctttgctggaatgcagaacaacgagatcaccaccatcgaatgggatgacatgactctctaccaagctt

SEQ ID NO: 5542 - DNA, 201 bp, Homo sapiens
ctgaggatgttccctatgcctacaaaggaaatgagtggcttggatacgataacaccaagagtttccaaatcaaggtagactattggctaaagaagaacaastttggaggtgccatggtctgggccattgacctggatgatttcacaggcactttctgcaaccaaggaaaattccctctgatcaccaccctgaaggatgctc

SEQ ID NO: 5543 - DNA, 160 bp, Homo sapiens
ccacacaagaagggtaggagagaaaagccatggccgacaaggtcctgaaggagaagagamagctgtttatccattccatgggtgaaggtacaataaatggcttactggatgaattattacagacaagggtgctgaaccaggaagagatggagaaagtaaa

SEQ ID NO: 5544 - DNA, 201 bp, Homo sapiens
aatggcttactggatgaattattacagacaagggtgctgaaccaggaagagatggagaaagtaaaacgtgaaaatgctacagttatggataagacccgagmtttgattgactccgttattccgaaaggggcacaggcatgccaaatttgcatcacatacatttgtgaagaagacagttacctggcagagacgctgggactc

SEQ ID NO: 5545 - DNA, 201 bp, Homo sapiens
tgaaggagaagagaaagctgtttatccattccatgggtgaaggtacaataaatggcttactggatgaattattacagacaagggtgctgaaccaggaagasatggagaaagtaaaacgtgaaaatgctacagttatggataagacccgagctttgattgactccgttattccgaaaggggcacaggcatgccaaatttgca

SEQ ID NO: 5546 - DNA, 201 bp, Homo sapiens
aggagaagagaaagctgtttatccattccatgggtgaaggtacaataaatggcttactggatgaattattacagacaagggtgctgaaccaggaagagatrgagaaagtaaaacgtgaaaatgctacagttatggataagacccgagctttgattgactccgttattccgaaaggggcacaggcatgccaaatttgcatca

SEQ ID NO: 5547 - DNA, 166 bp, Homo sapiens
ccacacaagaagggtaggagagaaaagccatggccgacaaggtcctgaaggagaagagaaagctgyttatccattccatgggtgaaggtacaataaatggcttactggatgaattattacagacaagggtgctgaaccaggaagagatggagaaagtaaaacgtga

SEQ ID NO: 5548 - DNA, 140 bp, Homo sapiens
ccacacaagaagggtaggagagaaaagccatggccgacawggtcctgaaggagaagagaaagctgtttatccattccatgggtgaaggtacaataaatggcttactggatgaattattacagacaagggtgctgaaccag

SEQ ID NO: 5549 - DNA, 201 bp, Homo sapiens
gataagacccgagctttgattgactccgttattccgaaaggggcacaggcatgccaaatttgcatcacatacatttgtgaagaagacagttacctggcagrgacgctgggactctcagcaggtccgatacctggaaattagcttagtacacaagactcccaattactattttcttccttcccagctcttcaggcagtgcag

SEQ ID NO: 5550 - DNA, 201 bp, Homo sapiens
aagagaaagctgtttatccattccatgggtgaaggtacaataaatggcttactggatgaattattacagacaagggtgctgaaccaggaagagatggagawagtaaaacgtgaaaatgctacagttatggataagacccgagctttgattgactccgttattccgaaaggggcacaggcatgccaaatttgcatcacatac

SEQ ID NO: 5551 - DNA, 201 bp, Homo sapiens
aaggagaagagaaagctgtttatccattccatgggtgaaggtacaataaatggcttactggatgaattattacagacaagggtgctgaaccaggaagagayggagaaagtaaaacgtgaaaatgctacagttatggataagacccgagctttgattgactccgttattccgaaaggggcacaggcatgccaaatttgcatc

SEQ ID NO: 5552 - DNA, 142 bp, Homo sapiens
ccacacaagaagggtaggagagaaaagccatggccgacaagrtcctgaaggagaagagaaagctgtttatccattccatgggtgaaggtacaataaatggcttactggatgaattattacagacaagggtgctgaaccagga

SEQ ID NO: 5553 - DNA, 201 bp, Homo sapiens
ctacagttatggataagacccgagctttgattgactccgttattccgaaaggggcacaggcatgccaaatttgcatcacatacatttgtgaagaagacagktacctggcagagacgctgggactctcagcaggtccgatacctggaaattagcttagtacacaagactcccaattactattttcttccttcccagctcttc

SEQ ID NO: 5554 - DNA, 178 bp, Homo sapiens
ccacacaagaagggtaggagagaaaagccatggccgacaaggtcctgaaggagaagagaaagctgtttatccattccwtgggtgaaggtacaataaatggcttactggatgaattattacagacaagggtgctgaaccaggaagagatggagaaagtaaaacgtgaaaatgctacagt

SEQ ID NO: 5555 - DNA, 200 bp, Homo sapiens
cagaatacaataataaagtggagtgaaagatatacttcaggcagttttgaaatgcagtggctttttcttagaaccaattttattgagcggttctggaggawcatacttctgctccccttgcataaaggatctctatatcctagaatcccaggtttaggtaaagagttgcaaactggaactcataaattatcatagtcttc

SEQ ID NO: 5556 - DNA, 201 bp, Homo sapiens
tacaataaatggcttactggatgaattattacagacaagggtgctgaaccaggaagagatggagaaagtaaaacgtgaaaatgctacagttatggataagrcccgagctttgattgactccgttattccgaaaggggcacaggcatgccaaatttgcatcacatacatttgtgaagaagacagttacctggcagagacgct

SEQ ID NO: 5557 - DNA, 201 bp, Homo sapiens
agagaaaagccatggccgacaaggtcctgaaggagaagagaaagctgtttatccattccatgggtgaaggtacaataaatggcttactggatgaattattrcagacaagggtgctgaaccaggaagagatggagaaagtaaaacgtgaaaatgctacagttatggataagacccgagctttgattgactccgttattccga

SEQ ID NO: 5558 - DNA, 151 bp, Homo sapiens
ccacacaagaagggtaggagagaaaagccatggccgacaaggtcctgaagragaagagaaagctgtttatccattccatgggtgaaggtacaataaatggcttactggatgaattattacagacaagggtgctgaaccaggaagagatgga

SEQ ID NO: 5559 - DNA, 201 bp, Homo sapiens
ccatggccgacaaggtcctgaaggagaagagaaagctgtttatccattccatgggtgaaggtacaataaatggcttactggatgaattattacagacaagkgtgctgaaccaggaagagatggagaaagtaaaacgtgaaaatgctacagttatggataagacccgagctttgattgactccgttattccgaaaggggcac

SEQ ID NO: 5560 - DNA, 201 bp, Homo sapiens
gtgctgaaccaggaagagatggagaaagtaaaacgtgaaaatgctacagttatggataagacccgagctttgattgactccgttattccgaaaggggcacrggcatgccaaatttgcatcacatacatttgtgaagaagacagttacctggcagagacgctgggactctcagcaggtccgatacctggaaattagcttagt

SEQ ID NO: 5561 - DNA, 124 bp, Homo sapiens
acaaggtcctgaaggagaagagamagctgtttatccattccatgggtgaaggtacaataaatggcttactggatgaattattacagacaagggtgctgaaccaggaagagatggagaaagtaaa

SEQ ID NO: 5562 - DNA, 201 bp, Homo sapiens; identical to SEQ ID NO: 5544

SEQ ID NO: 5563 - DNA, 201 bp, Homo sapiens; identical to SEQ ID NO: 5545

SEQ ID NO: 5564 - DNA, 201 bp, Homo sapiens; identical to SEQ ID NO: 5546

SEQ ID NO: 5565 - DNA, 130 bp, Homo sapiens
acaaggtcctgaaggagaagagaaagctgyttatccattccatgggtgaaggtacaataaatggcttactggatgaattattacagacaagggtgctgaaccaggaagagatggagaaagtaaaacgtga

SEQ ID NO: 5566 - DNA, 104 bp, Homo sapiens
acawggtcctgaaggagaagagaaagctgtttatccattccatgggtgaaggtacaataaatggcttactggatgaattattacagacaagggtgctgaaccag

SEQ ID NO: 5567 - DNA, 201 bp, Homo sapiens; identical to SEQ ID NO: 5549

SEQ ID NO: 5568 - DNA, 201 bp, Homo sapiens; identical to SEQ ID NO: 5550

SEQ ID NO: 5569 - DNA, 201 bp, Homo sapiens; identical to SEQ ID NO: 5551

SEQ ID NO: 5570 - DNA, 106 bp, Homo sapiens
acaagrtcctgaaggagaagagaaagctgtttatccattccatgggtgaaggtacaataaatggcttactggatgaattattacagacaagggtgctgaaccagga

SEQ ID NO: 5571 - DNA, 201 bp, Homo sapiens; identical to SEQ ID NO: 5553

SEQ ID NO: 5572 - DNA, 142 bp, Homo sapiens
acaaggtcctgaaggagaagagaaagctgtttatccattccwtgggtgaaggtacaataaatggcttactggatgaattattacagacaagggtgctgaaccaggaagagatggagaaagtaaaacgtgaaaatgctacagt

SEQ ID NO: 5573 - DNA, 200 bp, Homo sapiens; identical to SEQ ID NO: 5555

SEQ ID NO: 5574 - DNA, 115 bp, Homo sapiens
acaaggtcctgaagragaagagaaagctgtttatccattccatgggtgaaggtacaataaatggcttactggatgaattattacagacaagggtgctgaaccaggaagagatgga

SEQ ID NO: 5575 - DNA, 183 bp, Homo sapiens
acaaggtcctgaaggagaagagaaagctgtttatccattccatgggtgaaggtacaataaatggcttactggatgaattattrcagacaagggtgctgaaccaggaagagatggagaaagtaaaacgtgaaaatgctacagttatggataagacccgagctttgattgactccgttattccga

SEQ ID NO: 5576 - DNA, 201 bp, Homo sapiens; identical to SEQ ID NO: 5556

SEQ ID NO: 5577 - DNA, 201 bp, Homo sapiens; identical to SEQ ID NO: 5560

SEQ ID NO: 5578 - DNA, 192 bp, Homo sapiens
acaaggtcctgaaggagaagagaaagctgtttatccattccatgggtgaaggtacaataaatggcttactggatgaattattacagacaagkgtgctgaaccaggaagagatggagaaagtaaaacgtgaaaatgctacagttatggataagacccgagctttgattgactccgttattccgaaaggggcac

SEQ ID NO: 5579 - DNA, 201 bp, Homo sapiens
aaggatcctaaattgcagcaaggctacaatgctatgggattctcccagggaggccaatttctgagggcagtggctcagagatgcccttcacctcccatgaycaatctgatctcggttgggggacaacatcaaggtgtttttggactccctcgatgcccaggagagagctctcacatctgtgacttcatccgaaaaacactg

SEQ ID NO: 5580 - DNA, 201 bp, Homo sapiens
tctcgcgcccgcggtcatgtgacacagcgaagatggcgtcgcccggctgcctgtggctcttggctgtggctctcctgccatggacctgcgcttctcgggcrctgcagcatctggacccgccggcgccgctgccgttggtgatctggcatgggatgggagacagctgttgcaatcccttaagcatgggtgctattaaaaaaa

SEQ ID NO: 5581 - DNA, 201 bp, Homo sapiens
tactcacataaatgctttgttttgctggtgatttaaccagtgcttggaaaaatcttgcttggctatttctgcatcatttcttaaggctgccttcctctctsagtacgttgccctctgtgctatcatcttatcatcaattattagacaaatcccactggcctacagtcttgcttctgcagcacccactttgtctcctcaggt

SEQ ID NO: 5582 - DNA, 201 bp, Homo sapiens
cactggcctacagtcttgcttctgcagcacccactttgtctcctcaggtagtgatgaattagttgctgtcacaaaaggagggaagtagcacccaaattaarttgcttaagagaggaaatgtacatcttgtataacttagggagcgaagaaaatgtaggcgcgaaagtgaaaagtgaggcagctagttcttcctattccatt

SEQ ID NO: 5583 - DNA, 201 bp, Homo sapiens; identical to SEQ ID NO: 5579

SEQ ID NO: 5584 - DNA, 201 bp, Homo sapiens; identical to SEQ ID NO: 5580

SEQ ID NO: 5585 - DNA, 201 bp, Homo sapiens; identical to SEQ ID NO: 5581

SEQ ID NO: 5586 - DNA, 201 bp, Homo sapiens; identical to SEQ ID NO: 5582

SEQ ID NO: 5587 - DNA, 201 bp, Homo sapiens
gggcgagcctcagccccaaggtcctccaagctggacagacgagtgtctcagttctcaggacgaggagcacgaggcagacaagaaggaggacgacctcgaarccatgaacgcagaggaggactcactgaggaacgggggagaggaggaggacgaagatgaggacctggaagaggaggaagaagaggaagaggaggatgacga

SEQ ID NO: 5588 - DNA, 201 bp, Homo sapiens
ttaaaaaataaaaaaatacagtaaagtttaaaaaatacaccacgaatttggtgtggctgtattcagatcgtattaattatctgatcgggataacaaaatcmcaagcaataattaggatctatgcaatttttaaactagtaatgggccaattaaaatatatataaatatatatttttcaaccagcattttactacttgttac

SEQ ID NO: 5589 - DNA, 201 bp, Homo sapiens
cagtaaagtttaaaaaatacaccacgaatttggtgtggctgtattcagatcgtattaattatctgatcgggataacaaaatcacaagcaataattaggatytatgcaatttttaaactagtaatgggccaattaaaatatatataaatatatatttttcaaccagcattttactacttgttacctttcccatgctgaatta

SEQ ID NO: 5590 - DNA, 201 bp, Homo sapiens
ttgtacagaatttttaatgactttttataatgtggatttcctattttaaaaccatgcagcttcatcaatttttatacatatcagaaaagtagaattatatytaatttatacaaaataatttaactaatttaaaccagcagaaaagtgcttagaaagttattgtgttgccttagcacttctttcctctccaattgtaaaaaa

SEQ ID NO: 5591 - DNA, 201 bp, Homo sapiens
gacctggtctccttcgttcagacgctttgcaagggcttatcccaacccaccaccaacctggttgcgggctgcctgcaactcaatcctcggacttttctgcmtgagcagaaccaggacatgcccccccacctgccgacggccagcgcttccttccctgtacacccctactcctaccagtcgcctgggctgcccagtccgcct

SEQ ID NO: 5592 - DNA, 201 bp, Homo sapiens
gatcaaaagcccaagagacgcggccccaaaaagaagaagatgactaaggctcgcctggagcgttttaaattgagacgcatgaaggctaacgcccgggagckgaaccgcatgcacggactgaacgcggcgctagacaacctgcgcaaggtggtgccttgctattctaagacgcagaagctgtccaaaatcgagactctgcgc

SEQ ID NO: 5593 - DNA, 201 bp, Homo sapiens
tgacgatcaaaagcccaagagacgcggccccaaaaagaagaagatgactaaggctcgcctggagcgttttaaattgagacgcatgaaggctaacgcccggragcggaaccgcatgcacggactgaacgcggcgctagacaacctgcgcaaggtggtgccttgctattctaagacgcagaagctgtccaaaatcgagactct

SEQ ID NO: 5594 - DNA, 201 bp, Homo sapiens
ctcagctagcggccccgcccgcgcttagcatcactaactgggctatataacctgagcgcccgcgcggccacgacacgaggaattcgcccacgcaggaggcrcggcgtccggaggccccagggttatgagactatcactgctcaggacctactaacaacaaaggaaatcgaaacatgaccaaatcgtacagcgagagtgggc

SEQ ID NO: 5595 - DNA, 201 bp, Homo sapiens
aaatgtacaaactagaattttaatataaagaaatgtggccatgctttaaacctgtggtccccaccctttttgggaccagtttcatggaagacaatttttcygtggatgggggaatggtttcaggatgaactgttccacctcagatcatcaggcattagattctcttgaggaacatggcactctagatccctcacataccag

SEQ ID NO: 5596 - DNA, 201 bp, Homo sapiens
tcagttcttgaatgtcagcattatggcaattccttgcctgtgttcagtggcacctagaggcttggcacctaataccagattaaataatggaagtatggctsttataattgcccgaaacacttctcggccagaatttataaaacacctgaaaagatatgccagtgtaaaaaatcagttcaattttccatttgttgagactta

SEQ ID NO: 5597 - DNA, 201 bp, Homo sapiens
cagttcaattttccatttgttgagacttacactgttgaggaagtaaaagttcatccaaggaataatactggtggatataatccagaggaggaggaggatgraactgcttcagaaaattgtttcccttggaatgtagatggtgacttaatggaagttgcatcagaggtccatattagattgcatccaagacttatcagtctt

SEQ ID NO: 5598 - DNA, 131 bp, Homo sapiens
tgtggccaaacggatatcctaatagaaattgatgttactaacaattagcctctagggctttaaaagtcaagatgaaatatcaattcaaattctgtttttaratatcaattcaaattcttttttttacaatg

SEQ ID NO: 5599 - DNA, 201 bp, Homo sapiens
aacttggtgagaattaaaattgacctttgggagagggtaggggcaggatgttttatgacactgtagaaaagacaggaggaacccgctgcgatggagattgsggggagctggaagcaagcagccaacaggacagagttccagaactcatgcagatggggaagaggtgacagcccttccccactggcctcccccgtggaggtg

SEQ ID NO: 5600 - DNA, 201 bp, Homo sapiens
catacagagatgtgcaaaacttggtgagaattaaaattgacctttgggagagggtaggggcaggatgttttatgacactgtagaaaagacaggaggaaccygctgcgatggagattggggggagctggaagcaagcagccaacaggacagagttccagaactcatgcagatggggaagaggtgacagcccttccccactgg

SEQ ID NO: 5601 - DNA, 201 bp, Homo sapiens
tcagaccccacggcaggtaaaatcaggactgcctgagaacccgtcaccctctgcctctcaggtcaccccccagctccaggaacctgcctcctgctgtccaytgccaggtcttccttgcaccctgacacctgtgctgaggcgctctggcagctggaggaggctgattgcactccacaaacaggactgtctggaccaagggaa

SEQ ID NO: 5602 - DNA, 201 bp, Homo sapiens
tgtaaacaggcccattcagggctgcctgagcaaatggggacttgccgaggcagctgcaactagacttgggctaagccgtctgggtctactcaagaattcgmgtctgaagatgaccaagcttgagttattcaactgagagtgaggtgtcaaggcggaagcgactgtccccagggaagggctgtgagatggatgggcgtgagt

SEQ ID NO: 5603 - DNA, 201 bp, Homo sapiens
cctccctcggagagcagggtctctcggcatccagcggcgtggtctgcattctgctctacctcatgctctaggccccatgccatcgtctcggccctagaccrtgaaaactgccagtcacccgggacctgctcctaggggctggcctgcacagccggatggcctgtgggcggggtggaagtgcccactcccactccagatggg

SEQ ID NO: 5604 - DNA, 201 bp, Homo sapiens
aggtgtcaaggcggaagcgactgtccccagggaagggctgtgagatggatgggcgtgagtcagcttttccaaaactcaagtacctgggacaggacaactcrctagcagctcagtcacctccgtggcggacacagataaggatgttaagaccagaaaaccagagactagggccccgtcctcagccctcacagcatgacacag

SEQ ID NO: 5605 - DNA, 201 bp, Homo sapiens
tccccactggcctcccccgtggaggtggagtagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgagg

SEQ ID NO: 5606 - DNA, 201 bp, Homo sapiens; identical to SEQ ID NO: 5601

SEQ ID NO: 5607 - DNA, 201 bp, Homo sapiens; identical to SEQ ID NO: 5602

SEQ ID NO: 5608 - DNA, 201 bp, Homo sapiens; identical to SEQ ID NO: 5603

SEQ ID NO: 5609 - DNA, 201 bp, Homo sapiens; identical to SEQ ID NO: 5604

SEQ ID NO: 5610 - DNA, 201 bp, Homo sapiens
gggctgtcctgacagcacagacgcttcagggagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgagg

SEQ ID NO: 5611 - DNA, 201 bp, Homo sapiens
cagaaggcagagtccaggcttagactgcagttcctcgcttacctgtgcagtctaattttgagctgcctctttgtagtcttaaaaggcaggagcttcgtgtwgtgggtctgctaacccgtacgtttccgtgggcaagtcgtgtgtactcctcgccatggctcagctccaaacacgcttctacactgataacaagaaatatgc

SEQ ID NO: 5612 - DNA, 201 bp, Homo sapiens
tgtaaaagatgtggcctgggtgaaaaaagatagtttgtcctgcttattattgagtgcttctatggatcagactattctcttatgggagtggaatgtagagmgaaacaaagtgaaagccctacactgctgtagaggtcatgctggaagtgtagattctatagctgttgatggctcaggaactaaattttgcagtggctcctg

SEQ ID NO: 5613 - DNA, 201 bp, Homo sapiens
aaaggacaaaaatgagttccacaaacatgtggagtttgatttccttattaagggccagtttctgcgaatgcccttggacaaacacatggaaatggagaacrtctcatcagaagaagttgtggaaatagaatacgtggagaagtatactgcaccccagccagagcaatgcatgttccatgatgactggatcagttcaattaa

SEQ ID NO: 5614 - DNA, 201 bp, Homo sapiens
gtagtaactaggagctgtgtttgaactatccaggctcaggacagcctcttgaaaaaaaattttttattaataaagcggatttgagtgggatctttttcctmatcgattacgggcccacacgtatgggaagaattctaacaatgattaaagggacatgctacctttacgactatccttttctaatcgatgactcctaaatct

SEQ ID NO: 5615 - DNA, 201 bp, Homo sapiens; identical to SEQ ID NO: 5611

SEQ ID NO: 5616 - DNA, 201 bp, Homo sapiens
aaaggacaaaaatgagttccacaaacatgtggagtttgatttccttattaagggccagtttctgcgaatgcccttggacaaacacatggaagtggagaacrtctcatcagaagaagttgtggaaatagaatacgtggagaagtgtaccgcaccccagccagagcaatgcatgttccatgatgactggatcagttcaattaa

SEQ ID NO: 5617 - DNA, 201 bp, Homo sapiens; identical to SEQ ID NO: 5612

SEQ ID NO: 5618 - DNA, 201 bp, Homo sapiens
gtgcctatgatgatacaataccacctatggagaaagctctagggaaaatggacattcagatagctcttccttctggatgttacagaagagtagctccatgrtttggattagctgcaaaacactttattgatagatgaagattactgaggaaatgttggtgctgtactgtttaattttggcaaaaaaaagtttaaagtcaga

SEQ ID NO: 5619 - DNA, 201 bp, Homo sapiens
tttgcactactaaaatggacacttaaaaattgttgctctctcctctgctcgcattttcactctgccatgccctgctctgaagagacacccaccgttacccmcagcaaacaggctggtttgcagaggaaggcagcatgcagctccgttttgccccattctctgagcaggccacaaccctgactcagggatccacacaggcca

SEQ ID NO: 5620 - DNA, 201 bp, Homo sapiens
tgcagaggaaggcagcatgcagctccgttttgccccattctctgagcaggccacaaccctgactcagggatccacacaggccacaggctatgacctcaacrgtgcctatgatgatacaataccacctatggagaaagctctagggaaaatggacattcagatagctcttccttctggatgttacagaagagtagctccatg

SEQ ID NO: 5621 - DNA, 201 bp, Homo sapiens
gctgcaaaacactttattgatagatgaagattactgaggaaatgttggtgctgtactgtttaattttggcaaaaaaaagtttaaagtcagaaaaagtgatygtattgcacagctcatttgtgaatgaatttttaatccagaaatagaagttcaagctttggatgatgctgaaaggcattcagaagagttaggttctattag

SEQ ID NO: 5622 - DNA, 148 bp, Homo sapiens
cttcttctctcaagtcctcacacaggtattcaggaataccaggatggygtgcccaagattccaacagcctgtattacggtggaagatgcagaaatgatgtcaagaatggcttctcatgggatcaaaattgtcattcagctaaagatgg

SEQ ID NO: 5623 - DNA, 159 bp, Homo sapiens
aggaatcattctcccctccctcccaccacatagaatcaacatatggtagggattacagtgggggcatttctttatatcacctcttaaaaacattgtttccmctttaaaagtaaacacttaataaatttttggaagatctctgatttttatgtgttcatt

SEQ ID NO: 5624 - DNA, 201 bp, Homo sapiens
ttcaaagcacaactctatttcatgctttctgttattatctttcttgatactttccaaattctctgattctagaaaaaggaatcattctcccctccctcccmccacatagaatcaacatatggtagggattacagtgggggcatttctttatatcacctcttaaaaacattgtttccactttaaaagtaaacacttaataaa

SEQ ID NO: 5625 - DNA, 201 bp, Homo sapiens
gatagccatcctgggtcttggcagcagcattgggactcctccagaaggcattacagcagaagttctggtggtgacctctttcgatgaactgcagagaaggkcctcagaagcaagagggaagattgttgtttataaccaaccttacatcaactactcaaggacggtgcaataccgaacgcagggggcggtggaagctgccaa

SEQ ID NO: 5626 - DNA, 201 bp, Homo sapiens
ttcacataacaatttcatccaattcatcttcaaagcacaactctatttcatgctttctgttattatctttcttgatactttccaaattctctgattctagmaaaaggaatcattctcccctccctcccaccacatagaatcaacatatggtagggattacagtgggggcatttctttatatcacctcttaaaaacattgtt

SEQ ID NO: 5627 - DNA, 201 bp, Homo sapiens
cctagaaacagtaagaaagaaacgttttcatgcttctggccaggaatcctgggtctgcaactttggaaaactcctcttcacataacaatttcatccaattmatcttcaaagcacaactctatttcatgctttctgttattatctttcttgatactttccaaattctctgattctagaaaaaggaatcattctcccctccct

SEQ ID NO: 5628 - DNA, 201 bp, Homo sapiens
ctgtggagatgttgctaaagcaatcatcaacctagctgtttatggtaaagcccagaacagatcctatgagcgattggcacttctggttgatactgttggamccagactgagtggctccaagaacctagaaaaagccatccaaattatgtaccaaaacctgcagcaagatgggctggagaaagttcacctggagccagtgag

SEQ ID NO: 5629 - DNA, 201 bp, Homo sapiens
tggaagctgccaaggtgggggctttggcatctctcattcgatccgtggcctccttctccatctacagtcctcacacaggtattcaggaataccaggatggygtgcccaagattccaacagcctgtattacggtggaagatgcagaaatgatgtcaagaatggcttctcatgggatcaaaattgtcattcagctaaagatgg

SEQ ID NO: 5630 - DNA, 201 bp, Homo sapiens
ctggagccagtgagaataccccactgggagaggggagaagaatcagctgtgatgctggagccaagaattcataagatagccatcctgggtcttggcagcarcattgggactcctccagaaggcattacagcagaagttctggtggtgacctctttcgatgaactgcagagaagggcctcagaagcaagagggaagattgtt

SEQ ID NO: 5631 - DNA, 201 bp, Homo sapiens
cagaagcaagagggaagattgttgtttataaccaaccttacatcaactactcaaggacggtgcaataccgaacgcagggggcggtggaagctgccaaggtkggggctttggcatctctcattcgatccgtggcctccttctccatctacagtcctcacacaggtattcaggaataccaggatggcgtgcccaagattccaa

SEQ ID NO: 5632 - DNA, 201 bp, Homo sapiens
gagccacagcccagaagctgagaagccttccggccgatctgtggccctgaggtcgcccttggagggcgagtgagaaccccccaggcgttccggaggtggcscccagcccgaacccggcgcccgccccggcttcccgagtcaggtctttgccccgcctctcggccccgcggcctggccggcaagcagggctgcagtcacggg

SEQ ID NO: 5633 - DNA, 159 bp, Homo sapiens; identical to SEQ ID NO: 5623

SEQ ID NO: 5634 - DNA, 201 bp, Homo sapiens; identical to SEQ ID NO: 5624

SEQ ID NO: 5635 - DNA, 201 bp, Homo sapiens
gactgagtggctccaagaacctagaaaaagccatccaaattatgtaccaaaacctgcagcaagatgggctggagaaagttcacctggagccagtgagaatmccccactgggagaggggagaagaatcagctgtgatgctggagccaagaattcataagatagccatcctgggtcttggcagcagcattgggactcctccag

SEQ ID NO: 5636 - DNA, 201 bp, Homo sapiens
attccttatcttcgcatttttcggtggtgttcaccttttatccctgtgctctgggaaagctatatgcaagaatggcatctctaagaggacttttgaagaartaaaagaagaaatagccagctgtggagatgttgctaaagcaatcatcaacctagctgtttatggtaaagcccagaacagatcctatgagcgattggcact

SEQ ID NO: 5637 - DNA, 201 bp, Homo sapiens
atactggaaatggttatgggccaaatggatgtgtgcagctcagtaatatttgcctaagtcacccctgtctaaatggacaatgcatcgacactgtctctggytatttttgtaagtgtgactcaggttggacaggtgtcaactgtacagaaaacatcaatgagtgtttgagcaacccctgtttgaatggaggaacttgtgttg

SEQ ID NO: 5638 - DNA, 201 bp, Homo sapiens
  misc_feature (1)...(201): n = A,T,C or G, or insertion/deletion polymorphism (see Tables 1-2)
cagtaatggaggctgccacccagatgcctcatgctcctcaactctaggttccttacctctctgcacgtgtctcccgggttatactggaaatggttatgggncaaatggatgtgtgcagctcagtaatatttgcctaagtcacccctgtctaaatggacaatgcatcgacactgtctctggttatttttgtaagtgtgactc

SEQ ID NO: 5639 - DNA, 201 bp, Homo sapiens
ggttctgtggcacgctgtgtccatggcatctgtgaggatttaatgcgagagcaagctggagagcccaagtacagctgcgtctgtgatgctgggtggatgtyttcacccaacagccctgcctgcacgctggacagagacgagtgcagcttccagcccgggccttgctccacacttgtgcagtgtttcaacactcaaggctct

SEQ ID NO: 5640 - DNA, 201 bp, Homo sapiens
ttaccccagtccttataggagcaacacagactgttcttgggtcattcgggttgacagaaatcatcgtgttctcttgaacttcactgactttgatcttgaaycacaagactcttgtattatggcatacgatggcttaagctccacaatgtcccgccttgccaggacgtgtggaagggagcagctggctaaccccatcgtctc

SEQ ID NO: 5641 - DNA, 201 bp, Homo sapiens
acctatcagattgcagattgcaacagagactatcacaaggcatttggcaacctgagaagccctggatggccagataactacgacaatgacaaggattgcaycgttactctcacagccccccagaaccacaccatttccctcttttttcattcacttggcatcgagaactcagttgaatgcagaaacgatttcttggaggtg

SEQ ID NO: 5642 - DNA, 201 bp, Homo sapiens
ggtcagcaaggacgtggcttcaaggctgaataccggcagacatgtgagaatgtggtaatagtcaatcaaacctatggcatcttagagagtatagggtatcygaatccttattctgaaaatcagcattgcaactggaccatccgggcaacaacaggcaacactgtgaactacacatttttagcatttgacttggaacatcac

SEQ ID NO: 5643 - DNA, 201 bp, Homo sapiens
gcaatgataatattgtgggaactcatgggaaagtcgcctctcctttctggcctgaaaactacccacataactccaattaccaatggacagtaaatgtgaaygcatctcacgttgtccatggtagaatcttggagatggacatagaagaaatacaaaactgctattatgacaaattaaggatctatgatgggcctagcattc

SEQ ID NO: 5644 - DNA, 201 bp, Homo sapiens
ctggtaacttccttacggttcaattcatcagtgacttaacattagagagggaaggatttaatgctacatacaccatcatggacatgccttgtggtggaacrtacaatgcaacttggaccccacaaaatatttcatcacccaattcatcagacccagatgtcccattttccatctgtacttgggtcattgattcccctccgc

SEQ ID NO: 5645 - DNA, 201 bp, Homo sapiens
gttctacatggctgaaggcatcttcaacagccctggctacccagacatttatccccctaatgtggaatgtgtctggaacatcgtcagttcccctggcaacyggctccagctgtcttttatatctttccagttggaagactctcaggactgcagcagagattttgtggagatccgtgaaggaaatgccacgggtcacttggt

SEQ ID NO: 5646 - DNA, 201 bp, Homo sapiens
gaggctcattcaccagccccggctatccaggcacatacccaaacaacacgtactgcgagtgggtccttgttgctcctgctggaaggcttgtcaccatcaasttctacttcatcagcattgacgatccaggagactgtgtccagaactatctcacactctatgatgggcccaacgccagctctccatcctctggaccatact

SEQ ID NO: 5647 - DNA, 201 bp, Homo sapiens
ctttgtagaaattttggatggcggccacgaagacgcgcccctccgaggccgttactgtggcaccgacatgccccatcctatcacatccttcagcagcgccytgacgctgagattcgtctctgattctagcatcagtgctgggggtttccacaccacggtcaccgcatcagtgtcggcttgtggtggaacgttctacatggc

SEQ ID NO: 5648 - DNA, 201 bp, Homo sapiens
cttggtgggacgatactgtggaaactccttccctctcaattattcttccatcgttggacataccctgtgggtcagatttatctcagatggttctggcagcrgcacgggcttccaggccacatttatgaagatatttggcaatgataatattgtgggaactcatgggaaagtcgcctctcctttctggcctgaaaactaccc

SEQ ID NO: 5649 - DNA, 201 bp, Homo sapiens
accattgctgtccattttgaacagcctttccagattccaaatggagattcttcttgcaaccagggggattacttggtgctaagaaatggtcctgatatctrttctccacccttgggaccccctggaggaaatggtcatttttgtggcagtcatgcttcatcaactctgttcacctcggataatcaaatgtttgttcagttt

SEQ ID NO: 5650 - DNA, 201 bp, Homo sapiens
tggaaattctttgacatttcatttttactccgactcttcaatctcagggaagggattccttctggagtggtttgcagtggatgcacctgatggtgttttamctaccattgctccaggtgcttgtggtggcttcctgaggacgggagatgcacccgtgtttctcttctccccgggctggcctgacagttacagtaatagagt

SEQ ID NO: 5651 - DNA, 201 bp, Homo sapiens
gggtatgtgacctcccccaaccaccctcataattatcccccgcacgctgattgcatttggatcttagcggctccaccggaaacacgcatacagctgcaatktgaagatcgattcgatattgaagtaacacccaactgtacttccaactaccttgagttgcgggatggagtggattcggatgcaccaatactttccaaattt

SEQ ID NO: 5652 - DNA, 201 bp, Homo sapiens
tattcctttacagattgtggcggaatacagataggtgacagtggagtgatcacaagccccaactatccaaatgcttatgacagcctgacccactgctcttsgctgttggaggccccacaagggcacaccatcactctcacatttagtgactttgatattgaaccccatacaacttgtgcttgggactctgtcactgtcagg

SEQ ID NO: 5653 - DNA, 201 bp, Homo sapiens
tcaagaccgacttgtccataaatgggagaggcttcaatgcgtcatggcaagcagtcactggaggttgtggtgggattttccaggctcccagtggagagatwcattctccaaattaccccagtccttataggagcaacacagactgttcttgggtcattcgggttgacagaaatcatcgtgttctcttgaacttcactgact

SEQ ID NO: 5654 - DNA, 201 bp, Homo sapiens
acaatgaaagtcatttttttcacggatggatccaggccatatggcggcttcactgcttcctatacctccagtgaagatgcagtgtgtggtgggtctcttcsaaatactcctgaaggaaactttacttctcctggctatgacggagtcaggaattactcaagaaacctgaactgcgaatggactctcagcaatccaaatcag

SEQ ID NO: 5655 - DNA, 201 bp, Homo sapiens
ttctggaaatcagagatggaggctatgaaaaatcaccattgctgggaatattctatggctcaaatctacccccaacaatcatctctcatagtaacaaactrtggttaaaatttaagagtgaccaaatagacacaaggtctggattctcagcttactgggatgggtcatcaacaggttgcgggggtaatctcaccacttcaa

SEQ ID NO: 5656 - DNA, 201 bp, Homo sapiens
gacatcccttggaagatactgtggaaagtcgatcccgccatctctcacaagcagtggtaactcattgatgctggtgtttgtgactgactccgacctcgctyatgaaggcttcttaataaactatgaagcaatcagtgcagcaacagcatgtttgcaagactacacagatgatttggggacattcacttctccaaacttccc

SEQ ID NO: 5657 - DNA, 201 bp, Homo sapiens
agacatcccttggaagatactgtggaaagtcgatcccgccatctctcacaagcagtggtaactcattgatgctggtgtttgtgactgactccgacctcgcytatgaaggcttcttaataaactatgaagcaatcagtgcagcaacagcatgtttgcaagactacacagatgatttggggacattcacttctccaaacttcc

SEQ ID NO: 5658 - DNA, 201 bp, Homo sapiens
gtttcaacactcaaggctctttctactgtggggcctgtccaacaggctggcaaggcaatggatatatttgcgaagatatcaatgaatgtgagataaataayggcggctgttctgtggctccacccgttgagtgtgtgaatacacctgggtcttcccactgccaggcctgtccaccagggtaccagggtgacggaagagtgt

SEQ ID NO: 5659 - DNA, 201 bp, Homo sapiens
gctcgttccgctgtgacgggaagctgtgtcaacgatggcgtgcacattatcagaggttacagcgtcatgtccaccccatttgctactgtgtgtggggatgrgatgccagctcccctcaccatcgctgggccggttctgcttaacttctactccaacgagcaaatcacagacttcggattcaagttttcctataggataatc

SEQ ID NO: 5660 - DNA, 201 bp, Homo sapiens
tcaggtttaaaatagatgcttctgttgaaaaagctagtttcagagctgtttatcaagtcgcttgcggggatgaattaactggagaaggggtcattcgctcrcctttttttcctaacgtgtatcctggagaaagaacctgtaggtggaccatccaccagccccaaagccaagtcattctcctcaacttcactgtctttgaaa

SEQ ID NO: 5661 - DNA, 201 bp, Homo sapiens
agaggctaatcctctgtcagtggtcctcttgacttttgtgtccttccacttagaagctcgttccgctgtgacgggaagctgtgtcaacgatggcgtgcacrttatcagaggttacagcgtcatgtccaccccatttgctactgtgtgtggggatgagatgccagctcccctcaccatcgctgggccggttctgcttaactt

SEQ ID NO: 5662 - DNA, 201 bp, Homo sapiens
taaaatttaagagtgaccaaatagacacaaggtctggattctcagcttactgggatgggtcatcaacaggttgcgggggtaatctcaccacttcaagcggyacgttcatatctcccaactacccgatgccctattaccacagctctgaatgctactggtggttgaaatctagccacggcagcgcatttgaactggaattca

SEQ ID NO: 5663 - DNA, 201 bp, Homo sapiens
cagctttgacaacaacttcctaatccccagcggtgatggacaatgtcagaatagcttcgtgaaggtgtgggcaggaactgaggaggtggacaaagccctgmtagccactggctgtgggaacgtggctccgggtcccgttatcacaccaagtaacacattcactgccgtcttccagtctcaggaggcaccagctcagggctt

SEQ ID NO: 5664 - DNA, 201 bp, Homo sapiens
gcttctttagtcttgagtgtgcatttcattctaatattttgagctgaaatttaaaaaaactttgaaagagttggaaatgattatggcatatgtgacatacrtttttaaaagttaataataatagccaggggcagtggctcatacccataatcccagcacgctgggaggccatgatgggaggattgcttgaacctaggagtt

SEQ ID NO: 5665 - DNA, 201 bp, Homo sapiens
gtgtcaacgatggcgtgcacattatcagaggttacagcgtcatgtccaccccatttgctactgtgtgtggggatgagatgccagctcccctcaccatcgcygggccggttctgcttaacttctactccaacgagcaaatcacagacttcggattcaagttttcctataggataatctcctgtggtggtgtgttcaatttct

SEQ ID NO: 5666 - DNA, 201 bp, Homo sapiens
acgcccgcctaattggagcttactgtggtacccagactgaatctttcagctccactggaaattctttgacatttcatttttactccgactcttcaatctcrgggaagggattccttctggagtggtttgcagtggatgcacctgatggtgttttacctaccattgctccaggtgcttgtggtggcttcctgaggacgggag

SEQ ID NO: 5667 - DNA, 201 bp, Homo sapiens
cctctgcagcacgctggacagcactctgccatcctgatacatgacccctgctgatgccacagagaataagctgaacttgtatggtttttcaccaaaccatrgatagaatcaatatttgtaggccaggcgtggtggctcacccccctgtattctcagcactttgggaggccgaggcaggttgatcacctgaggtcaggagtt

SEQ ID NO: 5668 - DNA, 193 bp, Homo sapiens
actgggactaagtatgacacttgactcagatcaggtttgctatcaagcagggagcaatggccagccccttccctcacagtatatgaatgatctggacagcrccttggtgccagtgatccccggaggggcctgtcagctcagtgagggccctgtcgtcatggaactcatcttttatatcctggaaaacatcgca

SEQ ID NO: 5669 - DNA, 194 bp, Homo sapiens
atggattccttgaggcaggcaatgcgagagataaaggacttcaccatcacctgtgggaagacggacgtggaggatccccaggagcacatccacrtccagtgggtggatgacgacaagaactttagcaaatgtgtcataagtcctataaatgagaagtccatggagactataacaaatgtgaagctattccatgg

SEQ ID NO: 5670 - DNA, 201 bp, Homo sapiens
ccagtgggtggatgacgacaagaactttagcaaatgtgtcataagtcctataaatgagaagtccatggagactataacaaatgtgaagctattccatggaycagaatgtaaagcaaatggaaaagttatcagatggacagagcttctgaaggaagatggaatgaccaaactgggactaagtatgacacttgactcagatca

SEQ ID NO: 5671 - DNA, 201 bp, Homo sapiens
atgtaaagcaaatggaaaagttatcagatggacagagcttctgaaggaagatggaatgaccaaactgggactaagtatgacacttgactcagatcaggttygctatcaagcagggagcaatggccagccccttccctcacagtatatgaatgatctggacagcgccttggtgccagtgatccccggaggggcctgtcagct

SEQ ID NO: 5672 - DNA, 126 bp, Homo sapiens
atggattccttgaggcaggcaatgcsagagataaaggacttcaccatcacctgtgggaagacggacgtggaggatccccaggagcacatccacatccagtgggtggatgacgacaagaactttagc

SEQ ID NO: 5673 - DNA, 201 bp, Homo sapiens
cagaagggggagaccaaggttccagctcaaccaataactattgcacaaccacctgtccctgcctcagttccctcttctgtaacatgaagtcgttgtgaggrttaaaggcagtaacaggtataaagtacttagaaaagcaaagggtgctacgtacatgtgaggcatcattacgcagacgtaactgggatatgtttactataa

SEQ ID NO: 5674 - DNA, 201 bp, Homo sapiens
catgccgcttgctccggagaagcccaggtgtggcctcactcacatcccactctgagtccaaatgttctctccctggaagatatcaatgtttctgtctgttygtgaggactccgtgcccaccacggcctctttcagcgccgacatgctcaatgtcaccttgcaagggcccactcttaacgggacctttgcccagagcaaatg

SEQ ID NO: 5675 - DNA, 201 bp, Homo sapiens
ggactgttcctgtctcagcaaccaagggattgttcctgtcaatcaatggtttattggaaggtggcccagtatgagccctagaagagtgtgaaaaggaatgrcaatggtgttcaccatcggcagtgccagggcagcactcattcacttgataaatgaatatttattagctggttggagagctagaacctggagagctagaac

SEQ ID NO: 5676 - DNA, 201 bp, Homo sapiens
gttccctcttctgtaacatgaagtcgttgtgagggttaaaggcagtaacaggtataaagtacttagaaaagcaaagggtgctacgtacatgtgaggcatcwttacgcagacgtaactgggatatgtttactataaggaaaagacactgaggtctagaaatagctccgtggagcagaatcagtattgggagccggtggcggt

SEQ ID NO: 5677 - DNA, 201 bp, Homo sapiens
agcacttgctgtatatgcagtattgagcactgtaggcaagagggaagaaagagaaggagccatctccatcttgaaggaactcaaagactcaagtgggaacractgggcactgccaccaccagaaagctgttcgacgagacggtcgagcagggtgctgtgggtgatatggacagcagaagggggagaccaaggttccagctc

SEQ ID NO: 5678 - DNA, 201 bp, Homo sapiens
tgaacctggagggctagaacctggagaatgagaaaaatttacatggcaaagagcccataaatcctgaccaatccaactctgaattttaaagcaaaagcgtsaaaaaaaagattccctccttacccccaacccactcttttttcccaccacccactctcctctgcctcagtaagtatctggaggaagaaaacaggtgaaaga

SEQ ID NO: 5679 - DNA, 201 bp, Homo sapiens
tattcatcatctgctggctgcccttccagatcagcaccttcctggatacgctgcatcgcctcggcatcctctccagctgccaggacgagcgcatcatcgaygtaatcacacagatcgcctccttcatggcctacagcaacagctgcctcaacccactggtgtacgtgatcgtgggcaagcgcttccgaaagaagtcttggg

SEQ ID NO: 5680 - DNA, 174 bp, Homo sapiens
cttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaagcccaggtgtggcctcactcacatccc

SEQ ID NO: 5681 - DNA, 201 bp, Homo sapiens
agtggaggaggcctgggggcagggagaggagtgactgagcttccctcccgtgtgttctccgtccctgccccagcaagacaacttagatctccaggagaacygccatccagctttggtgcaatggctgagtgcacaagtgagttgttgccctgggtttctttaatctattcagctagaactttgaaggacaatttcttgcat

SEQ ID NO: 5682 - DNA, 201 bp, Homo sapiens
tgggcttcctgctgcccctgagtgtcatcaccttctgcacgatgcagatcatgcaggtgctgcggaacaacgagatgcagaagttcaaggagatccagacrgagaggagggccacggtgctagtcctggttgtgctgctgctattcatcatctgctggctgcccttccagatcagcaccttcctggatacgctgcatcgcc

SEQ ID NO: 5683 - DNA, 201 bp, Homo sapiens
agctgttcgacgagacggtcgagcagggtgctgtgggtgatatggacagcagaagggggagaccaaggttccagctcaaccaataactattgcacaaccayctgtccctgcctcagttccctcttctgtaacatgaagtcgttgtgagggttaaaggcagtaacaggtataaagtacttagaaaagcaaagggtgctacgt

SEQ ID NO: 5684 - DNA, 201 bp, Homo sapiens
gcctacagcaacagctgcctcaacccactggtgtacgtgatcgtgggcaagcgcttccgaaagaagtcttgggaggtgtaccagggagtgtgccagaaagrgggctgcaggtcagaacccattcagatggagaactccatgggcacactgcggacctccatctccgtggaacgccagattcacaaactgcaggactgggca

SEQ ID NO: 5685 - DNA, 201 bp, Homo sapiens
ggggagaccaaggttccagctcaaccaataactattgcacaaccacctgtccctgcctcagttccctcttctgtaacatgaagtcgttgtgagggttaaargcagtaacaggtataaagtacttagaaaagcaaagggtgctacgtacatgtgaggcatcattacgcagacgtaactgggatatgtttactataaggaaaa

SEQ ID NO: 5686 - DNA, 186 bp, Homo sapiens
gctcaatctgttaacaggcttctggcatgtagatcagtggtctccaagcttttgtgattgtatattcctataggaaaaaaagaattgattatgcatacccrgtatgtatacttattaatctgtatgaagatgtacattctaaaatataatcaaccagtagaaatttaagaaagaagatgtaaaaaa

SEQ ID NO: 5687 - DNA, 201 bp, Homo sapiens
ttgggagccggtggcggtgtgaagcaccagtgtctggcacacagtaggtgctcattggctcccttccacctgtcattcccaccaccctgaggccccaaccrccacacacacaggagcatttggagagaaggccatgtcttcaaagtctgatttgtgatgaggcagaggaagatatttctaatcggtcttgcccagaggatc

SEQ ID NO: 5688 - DNA, 201 bp, Homo sapiens
aaaagcaaagggtgctacgtacatgtgaggcatcattacgcagacgtaactgggatatgtttactataaggaaaagacactgaggtctagaaatagctccrtggagcagaatcagtattgggagccggtggcggtgtgaagcaccagtgtctggcacacagtaggtgctcattggctcccttccacctgtcattcccacca

SEQ ID NO: 5689 - DNA, 201 bp, Homo sapiens
ggtataaagtacttagaaaagcaaagggtgctacgtacatgtgaggcatcattacgcagacgtaactgggatatgtttactataaggaaaagacactgagktctagaaatagctccgtggagcagaatcagtattgggagccggtggcggtgtgaagcaccagtgtctggcacacagtaggtgctcattggctcccttcca

SEQ ID NO: 5690 - DNA, 201 bp, Homo sapiens; identical to SEQ ID NO: 5673

SEQ ID NO: 5691 - DNA, 201 bp, Homo sapiens; identical to SEQ ID NO: 5674

SEQ ID NO: 5692 - DNA, 201 bp, Homo sapiens; identical to SEQ ID NO: 5675

SEQ ID NO: 5693 - DNA, 201 bp, Homo sapiens; identical to SEQ ID NO: 5676

SEQ ID NO: 5694 - DNA, 153 bp, Homo sapiens
cagagctcagctggaggcggagggggaagtgcccaggaggctgatgacatcaytacccagcccttgaaagatgagctgttcccgccgccactccagctctggcttctgggctccgaggaggggtggggacggtggggacggtggggacatcag

SEQ ID NO: 5695 - DNA, 201 bp, Homo sapiens; identical to SEQ ID NO: 5677

SEQ ID NO: 5696 - DNA, 201 bp, Homo sapiens; identical to SEQ ID NO: 5678

SEQ ID NO: 5697 - DNA, 201 bp, Homo sapiens; identical to SEQ ID NO: 5679

SEQ ID NO: 5698 - DNA, 201 bp, Homo sapiens
ggaggctgatgacatcactacccagcccttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaagcccaggtgtggcctcactcacatccc

SEQ ID NO: 5699 - DNA, 201 bp, Homo sapiens; identical to SEQ ID NO: 5681

SEQ ID NO: 5700 - DNA, 201 bp, Homo sapiens; identical to SEQ ID NO: 5682

SEQ ID NO: 5701 - DNA, 201 bp, Homo sapiens; identical to SEQ ID NO: 5683

SEQ ID NO: 5702 - DNA, 133 bp, Homo sapiens
cagagctcagctggaggcggagggggaagtgcycaggaggctgatgacatcactacccagcccttgaaagatgagctgttcccgccgccactccagctctggcttctgggctccgaggaggggtggggacggt

SEQ ID NO: 5703 - DNA, 201 bp, Homo sapiens; identical to SEQ ID NO: 5684

SEQ ID NO: 5704 - DNA, 201 bp, Homo sapiens; identical to SEQ ID NO: 5685

SEQ ID NO: 5705 - DNA, 201 bp, Homo sapiens; identical to SEQ ID NO: 5687

SEQ ID NO: 5706 - DNA, 186 bp, Homo sapiens; identical to SEQ ID NO: 5686

SEQ ID NO: 5707 - DNA, 201 bp, Homo sapiens; identical to SEQ ID NO: 5688

SEQ ID NO: 5708 - DNA, 201 bp, Homo sapiens; identical to SEQ ID NO: 5689

SEQ ID NO: 5709 - DNA, 201 bp, Homo sapiens
tcagagtatgtgtcttgcatgaaggaggcacagaagtccatctgtgacatcattggtgagtgcaaagagcaggtagccaactctgcttttgtggagcaagwgtggaagaagggcttcgaggtaatatatatgagtgagcccattgatgagtactgtgtgcagcagctcaaggaatttgatgggaagagcctgctgtcagtt

SEQ ID NO: 5710 - DNA, 201 bp, Homo sapiens
ctacaagagcctcaccagtgcctgggaagaccacttggcagtcaagcaattccctgtagaaggtcatttggaattcagggcattgctgttcatccctcatsaggctccctttgaccttttttagaacaagaggaaaatgaacaactctgtgtccatcatgtgtggatcatggacagctttgatgatttgatgccagagtat

SEQ ID NO: 5711 - DNA, 201 bp, Homo sapiens
agtgtggagaattctacaagagcctcaccagtgcctgggaagaccacttggcagtcaagcaattccctgtagaaggtcatttggaattcagggcattgctrttcatccctcatcaggctccctttgaccttttttagaacaagaggaaaatgaacaactctgtgtccatcatgtgtggatcatggacagctttgatgattt

SEQ ID NO: 5712 - DNA, 201 bp, Homo sapiens
tctaatgcttctgatgccttagacaagattcgctatgagagcctgacagacccttccaagttggacggtggtaaagaactgaaaattgacatcatccccamccctcgggaatgcatcctgactttggtcaacacaggcattggcatgaccaaggctgatctcataaataatttgggagccattgccaagtctggtactgaa

SEQ ID NO: 5713 - DNA, 201 bp, Homo sapiens
aggctgaggcagacaagaacaacgaggctgtcagtgacccggtggtgctgctgtttgaaaccacactgctctcttctggcttctcccttgaggatcctcaracctatccagctgcatctaccacatgatcaagctaggttagctattgatgaagatgaagtggcaacagaggaactcagtgctgctgttcctgatgtgatg

SEQ ID NO: 5714 - DNA, 201 bp, Homo sapiens
ggaagaagtagattaagagtttatacctgcaaaccttgtgcccttgcatagtgtccccatggctcccactgcagctttgagtggtcctgtcccacctggckctctctgctgatatctagtattttttctcttctgtccttgtgtctaaggcaggaaacaagggcatcaagccccattccctctctactttgacagcagaat

SEQ ID NO: 5715 - DNA, 201 bp, Homo sapiens
ttgaggatcctcagacctatccagctgcatctaccacatgatcaagctaggttagctattgatgaagatgaagtggcaacagaggaactcagtgctgctgytcctgatgtgatgtgttcctgaggatgtgtttcacatggaagaagtagattaagagtttatacctgcaaaccttgtgcccttgcatagtgtccccatggc

SEQ ID NO: 5716 - DNA, 201 bp, Homo sapiens
agctcaaggaatttgatgggaagagcctgctgtcagttaccaaggagggtctggagctacctgaggatgaggaggagaagaagataatggaggagagcaasgtaaagtttgagaacctctgcaggctcatgaaagaaatcttagataagaaggttgagcgggtgacaatctccagtaggcttgtgtcttcaccctgccgca

SEQ ID NO: 5717 - DNA, 201 bp, Homo sapiens
aagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaa

SEQ ID NO: 5718 - DNA, 201 bp, Homo sapiens
gaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaa

SEQ ID NO: 5719 - DNA, 201 bp, Homo sapiens
aggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttac

SEQ ID NO: 5720 - DNA, 201 bp, Homo sapiens
agaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgaga

SEQ ID NO: 5721 - DNA, 188 bp, Homo sapiens
ggttgttaggcaaatctaattctttcaaactacagatctgctcagagaaatctgtaaatctagtgtagaaataagtgaagctttgcgycaattgttaggtctaagcagaagtttgggagagagaagaaaagttactcatttgcctgattccgcacgagagtgtcaatgaagacctcaaagtctggaga

SEQ ID NO: 5722 - DNA, 201 bp, Homo sapiens
ctccaaggtaacaccatgttgttgagagtgttacctgctgtgtatgaaaagcagcctcagccaattaatagacacctgacagaactcctggccttgatgtstcagctggaacagccagaacagtaccatctactacggcttttgcatgtagcagcaaagaaaaaacaactcgaggtagttcagaagtgtattcctttccta

SEQ ID NO: 5723 - DNA, 201 bp, Homo sapiens
tgaaattcctccacagaggcaacaaggaactgtgcaggaatatgtctaactacctgtctctggctgcaattaccaaggcagatctcctggctgatcacacrgaagttatagtaaagagcatactccaaggtaacaccatgttgttgagagtgttacctgctgtgtatgaaaagcagcctcagccaattaatagacacctga

SEQ ID NO: 5724 - DNA, 201 bp, Homo sapiens
cctcactggacagatggcaaggatttatggagctgttgggcatgtggatgaagagagagccaggagctgcctgacatacctggtgagccaactggccaacrtggagcattcgtttcaccatattctcctgctggagattaaaagcatcaccgacaccttctcctcaatcttgggccctcagagcagagacatcttccgcat

SEQ ID NO: 5725 - DNA, 201 bp, Homo sapiens
agtctggagaaaaatgacctttcatggaataagaagtatacctccttctacatgtttttgtcttactgacctctgataactggaacacatgactctgggtmtgtagaaagtcaactgatcaaactcatcctcaccatgcatcaactgttcagactggttttgggacaaaaagatctttcacgagctggggacctcttctcc

SEQ ID NO: 5726 - DNA, 201 bp, Homo sapiens
gcttcagtgaaacagcaggagcatggcaatgcttcatgtgcaacaatcctgagaaagcaactgttgtaaatcaagatggccagcctctcatagaaggaaarcttaaagagaagcaagtcagatggaagttcatcaaaaggtggaaaacacgctattttacactggctggaaatcaacttctgtttcaaaaaggaaagtcta

SEQ ID NO: 5727 - DNA, 201 bp, Homo sapiens
tggccaacatggagcattcgtttcaccatattctcctgctggagattaaaagcatcaccgacaccttctcctcaatcttgggccctcagagcagagacatsttccgcatgagcaacagcttcaccgccattgctaaactccttacccgacaactggaaaataccaaggctggaagtggcaggagaaaaatcagcactgaaa

SEQ ID NO: 5728 - DNA, 201 bp, Homo sapiens
aaatgacaagctgccgtttaagacagacactgagagatcacagctgggggagtcttcagtttcatacccaaatattatacatatagactcagagaatttgycagaaactgttaaagaaaactcccaggaagaaactccagagacaactgcaagtcctatagaataccaagataagctctacttgcacttaaaaaaaaacct

SEQ ID NO: 5729 - DNA, 201 bp, Homo sapiens
aatggcaggattcttagtaaatgtcatactctaacagctttagtattgacttcagaatatatctgatgcccacaaaaataaaataaaataaaaggagctasagagtatgccctcagatagtgtggggccaggaagggaaaagtcactgataaaagaacttctgtagatatgtcatttaaaactgtgagaaaacaacatgaa

SEQ ID NO: 5730 - DNA, 201 bp, Homo sapiens
caactcgaggtagttcagaagtgtattcctttcctaattgggcatttgaaggattcaacccataatgacatcatcctaaacatcctcatagagatagcagkctatgagccagtggctttgaacagttttcttccaatgctgaaagagattggtgagagattcccctacctcactggacagatggcaaggatttatggagct

SEQ ID NO: 5731 - DNA, 201 bp, Homo sapiens
tattcctttcctaattgggcatttgaaggattcaacccataatgacatcatcctaaacatcctcatagagatagcagtctatgagccagtggctttgaacwgttttcttccaatgctgaaagagattggtgagagattcccctacctcactggacagatggcaaggatttatggagctgttgggcatgtggatgaagagag

SEQ ID NO: 5732 - DNA, 201 bp, Homo sapiens
gggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaac

SEQ ID NO: 5733 - DNA, 201 bp, Homo sapiens
agggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaa

SEQ ID NO: 5734 - DNA, 201 bp, Homo sapiens
agctgttgggcatgtggatgaagagagagccaggagctgcctgacatacctggtgagccaactggccaacatggagcattcgtttcaccatattctcctgstggagattaaaagcatcaccgacaccttctcctcaatcttgggccctcagagcagagacatcttccgcatgagcaacagcttcaccgccattgctaaact

SEQ ID NO: 5735 - DNA, 201 bp, Homo sapiens
cgccaccgctcccggccgccgcgctccggtacacacaggatccctgctgggcaccaacagctccaccatggggctggcctggggactaggcgtcctgttcytgatgcatgtgtgtggcaccaaccgcattccagagtctggcggagacaacagcgtgtttgacatctttgaactcaccggggccgcccgcaaggggtctgg

SEQ ID NO: 5736 - DNA, 201 bp, Homo sapiens
aggaacacggggagcagaggccaaagcactaaggggagggcgcatacccgagacgattgtatgaagaaaactattgctggatttcatgatgctgactggcrttagctgattaacccatgtaaataggcacttaaatagaagcaggaaagggagacaaagactggcttctggacttcctccctgatccccacccttactcat

SEQ ID NO: 5737 - DNA, 201 bp, Homo sapiens
ggccactatagcgaccccatgtaccgctgcgagtgcaagcctggctacgctggcaatggcatcatctgcggggaggacacagacctggatggctggcccartgagaacctggtgtgcgtggccaatgcgacttaccactgcaaaaaggataattgccccaaccttcccaactcagggcaggaagactatgacaaggatgga

SEQ ID NO: 5738 - DNA, 201 bp, Homo sapiens
cacctcccgcttcctgcccggccgccgcccattggccggaggaatccccaggaatgcgagcgcccctttaaaagcgcgcggctcctccgccttgccagccrctgcgcccgagctggcctgcgagttcagggctcctgtcgctctccaggagcaacctctactccggacgcacaggcattccccgcgcccctccagccctcg

SEQ ID NO: 5739 - DNA, 201 bp, Homo sapiens
aaacagactcagcattcagcctccaatgaataagacatcttccaagcatataaacaattgctttggtttccttttgaaaaagcatctacttgcttcagttrggaaggtgcccattccactctgcctttgtcacagagcagggtgctattgtgaggccatctctgagcagtggactcaaaagcattttcaggcatgtcagag

SEQ ID NO: 5740 - DNA, 201 bp, Homo sapiens
gcgatggtcgaggtgatgcctgcaaagatgattttgaccatgacagtgtgccagacatcgatgacatctgtcctgagaatgttgacatcagtgagaccgayttccgccgattccagatgattcctctggaccccaaagggacatcccaaaatgaccctaactgggttgtacgccatcagggtaaagaactcgtccagactg

SEQ ID NO: 5741 - DNA, 201 bp, Homo sapiens
ggaggaatccccaggaatgcgagcgcccctttaaaagcgcgcggctcctccgccttgccagccgctgcgcccgagctggcctgcgagttcagggctcctgycgctctccaggagcaacctctactccggacgcacaggcattccccgcgcccctccagccctcgccgccctcgccaccgctcccggccgccgcgctccggt

SEQ ID NO: 5742 - DNA, 201 bp, Homo sapiens
gctggagccactggtccccgtggtcatcttgttctgtgacatgtggtgatggtgtgatcacaaggatccggctctgcaactctcccagcccccagatgaaygggaaaccctgtgaaggcgaagcgcgggagaccaaagcctgcaagaaagacgcctgccccatcaatggaggctggggtccttggtcaccatgggacatct

SEQ ID NO: 5743 - DNA, 201 bp, Homo sapiens
ccccatcaatggaggctggggtccttggtcaccatgggacatctgttctgtcacctgtggaggaggggtacagaaacgtagtcgtctctgcaacaaccccrcaccccagtttggaggcaaggactgcgttggtgatgtaacagaaaaccagatctgcaacaagcaggactgtccaattgatggatgcctgtccaatccctg

SEQ ID NO: 5744 - DNA, 201 bp, Homo sapiens
cctgccccatcaatggaggctggggtccttggtcaccatgggacatctgttctgtcacctgtggaggaggggtacagaaacgtagtcgtctctgcaacaaycccgcaccccagtttggaggcaaggactgcgttggtgatgtaacagaaaaccagatctgcaacaagcaggactgtccaattgatggatgcctgtccaatc

SEQ ID NO: 5745 - DNA, 201 bp, Homo sapiens
atggaattcagcagcgcggccgctcctgcgatagcctcaacaaccgatgtgagggctcctcggtccagacacggacctgccacattcaggagtgtgacaaragatttaaacaggatggtggctggagccactggtccccgtggtcatcttgttctgtgacatgtggtgatggtgtgatcacaaggatccggctctgcaact

SEQ ID NO: 5746 - DNA, 201 bp, Homo sapiens
ggaaagatttcaccgcctacagatggcgtctcagccacaggccaaagacgggtttcattagagtggtgatgtatgaagggaagaaaatcatggctgactcrggacccatctatgataaaacctatgctggtggtagactagggttgtttgtcttctctcaagaaatggtgttcttctctgacctgaaatacgaatgtagag

SEQ ID NO: 5747 - DNA, 201 bp, Homo sapiens
tagagatccctaatcatcaaattgttgattgaaagactgatcataaaccaatgctggtattgcaccttctggaactatgggcttgagaaaacccccaggaycacttctccttggcttccttcttttctgtgcttgcatcagtgtggactcctagaacgtgcgacctgcctcaagaaaatgcagttttcaaaaacagactca

SEQ ID NO: 5748 - DNA, 201 bp, Homo sapiens
aggatccctgctgggcaccaacagctccaccatggggctggcctggggactaggcgtcctgttcctgatgcatgtgtgtggcaccaaccgcattccagagkctggcggagacaacagcgtgtttgacatctttgaactcaccggggccgcccgcaaggggtctgggcgccgactggtgaagggccccgacccttccagccc

SEQ ID NO: 5749 - DNA, 201 bp, Homo sapiens
acaacaacgtggtgaatggttccagccctgccatccgcactaactacattggccacaagacaaaggacttgcaagccatctgcggcatctcctgtgatgarctgtccagcatggtcctggaactcaggggcctgcgcaccattgtgaccacgctgcaggacagcatccgcaaagtgactgaagagaacaaagagttggcca

SEQ ID NO: 5750 - DNA, 201 bp, Homo sapiens
acaaccgatgtgagggctcctcggtccagacacggacctgccacattcaggagtgtgacaagagatttaaacaggatggtggctggagccactggtccccrtggtcatcttgttctgtgacatgtggtgatggtgtgatcacaaggatccggctctgcaactctcccagcccccagatgaacgggaaaccctgtgaaggcg

SEQ ID NO: 5751 - DNA, 201 bp, Homo sapiens
atacgaatgtagagatccctaatcatcaaattgttgattgaaagactgatcataaaccaatgctggtattgcaccttctggaactatgggcttgagaaaayccccaggatcacttctccttggcttccttcttttctgtgcttgcatcagtgtggactcctagaacgtgcgacctgcctcaagaaaatgcagttttcaaaa

SEQ ID NO: 5752 - DNA, 201 bp, Homo sapiens; identical to SEQ ID NO: 5735

SEQ ID NO: 5753 - DNA, 201 bp, Homo sapiens
aataatttatcaggaaatactgcctgtagagttagtatttctatttttatataatgtttgcacactgaattgaagaattgttggttttttcttttttttgktttgtttttttttttttttttttttgcttttgacctcccatttttactatttgccaatacctttttctaggaatgtgcttttttttgtacacatttttat

SEQ ID NO: 5754 - DNA, 201 bp, Homo sapiens
gattgtatgaagaaaatatggaggaactgttacatgttcggtactaagtcattttcaggggattgaaagactattgctggatttcatgatgctgactggcrttagctgattaacccatgtaaataggcacttaaatagaagcaggaaagggagacaaagactggcttctggacttcctccctgatccccacccttactcat

SEQ ID NO: 5755 - DNA, 201 bp, Homo sapiens; identical to SEQ ID NO: 5737

SEQ ID NO: 5756 - DNA, 201 bp, Homo sapiens; identical to SEQ ID NO: 5738

SEQ ID NO: 5757 - DNA, 201 bp, Homo sapiens; identical to SEQ ID NO: 5739

SEQ ID NO: 5758 - DNA, 201 bp, Homo sapiens; identical to SEQ ID NO: 5740

SEQ ID NO: 5759 - DNA, 201 bp, Homo sapiens; identical to SEQ ID NO: 5741

SEQ ID NO: 5760 - DNA, 201 bp, Homo sapiens; identical to SEQ ID NO: 5742

SEQ ID NO: 5761 - DNA, 201 bp, Homo sapiens; identical to SEQ ID NO: 5743

SEQ ID NO: 5762 - DNA, 201 bp, Homo sapiens; identical to SEQ ID NO: 5744

SEQ ID NO: 5763 - DNA, 201 bp, Homo sapiens; identical to SEQ ID NO: 5745

SEQ ID NO: 5764 - DNA, 201 bp, Homo sapiens; identical to SEQ ID NO: 5746

SEQ ID NO: 5765 - DNA, 201 bp, Homo sapiens; identical to SEQ ID NO: 5747

SEQ ID NO: 5766 - DNA, 201 bp, Homo sapiens; identical to SEQ ID NO: 5748

SEQ ID NO: 5767 - DNA, 201 bp, Homo sapiens; identical to SEQ ID NO: 5749

SEQ ID NO: 5768 - DNA, 201 bp, Homo sapiens; identical to SEQ ID NO: 5750

SEQ ID NO: 5769 - DNA, 201 bp, Homo sapiens
agaattgttggttttttcttttttttgttttgtttttttttttttttttttttgcttttgacctcccatttttactatttgccaatacctttttctaggartgtgcttttttttgtacacatttttatccattttacattctaaagcagtgtaagttgtatattactgtttcttatgtacaaggaacaacaataaatcata

SEQ ID NO: 5770 - DNA, 201 bp, Homo sapiens
tttatcaggaaatactgcctgtagagttagtatttctatttttatataatgtttgcacactgaattgaagaattgttggttttttcttttttttgttttgkttttttttttttttttttttgcttttgacctcccatttttactatttgccaatacctttttctaggaatgtgcttttttttgtacacatttttatccatt

SEQ ID NO: 5771 - DNA, 201 bp, Homo sapiens; identical to SEQ ID NO: 5751

SEQ ID NO: 5772 - DNA, 201 bp, Homo sapiens; identical to SEQ ID NO: 5735

SEQ ID NO: 5773 - DNA, 105 bp, Homo sapiens
atggaattcagcagcgcggccgctcctgcgatagcctcaacaaccgatgtgagggctcctcggtccagacacggacctgccacattcaggagtgtgacaaragat

SEQ ID NO: 5774 - DNA, 201 bp, Homo sapiens; identical to SEQ ID NO: 5748

SEQ ID NO: 5775 - DNA, 201 bp, Homo sapiens; identical to SEQ ID NO: 5749

SEQ ID NO: 5776 - DNA, 201 bp, Homo sapiens; identical to SEQ ID NO: 5738

SEQ ID NO: 5777 - DNA, 201 bp, Homo sapiens; identical to SEQ ID NO: 5741

SEQ ID NO: 5778 - DNA, 201 bp, Homo sapiens
tgatctctgaccctcggctcttgtgcttcctgctacaggatccctgctgggcaccaacagctccaccatggggctggcctggggactaggcgtcctgttcytgatgcatgtgtgtggcaccaaccgcattccagagtctggcggagacaacagcgtgtttgacatctttgaactcaccggggccgcccgcaaggggtctgg

SEQ ID NO: 5779 - DNA, 201 bp, Homo sapiens; identical to SEQ ID NO: 5736

SEQ ID NO: 5780 - DNA, 201 bp, Homo sapiens; identical to SEQ ID NO: 5737

SEQ ID NO: 5781 - DNA, 201 bp, Homo sapiens; identical to SEQ ID NO: 5738

SEQ ID NO: 5782 - DNA, 201 bp, Homo sapiens; identical to SEQ ID NO: 5739

SEQ ID NO: 5783 - DNA, 201 bp, Homo sapiens; identical to SEQ ID NO: 5740

SEQ ID NO: 5784 - DNA, 201 bp, Homo sapiens; identical to SEQ ID NO: 5741

SEQ ID NO: 5785 - DNA, 201 bp, Homo sapiens; identical to SEQ ID NO: 5742

SEQ ID NO: 5786 - DNA, 201 bp, Homo sapiens; identical to SEQ ID NO: 5743

SEQ ID NO: 5787 - DNA, 201 bp, Homo sapiens; identical to SEQ ID NO: 5744

SEQ ID NO: 5788 - DNA, 201 bp, Homo sapiens; identical to SEQ ID NO: 5745

SEQ ID NO: 5789 - DNA, 201 bp, Homo sapiens; identical to SEQ ID NO: 5746

SEQ ID NO: 5790 - DNA, 201 bp, Homo sapiens; identical to SEQ ID NO: 5747

SEQ ID NO: 5791 - DNA, 201 bp, Homo sapiens; identical to SEQ ID NO: 5748

SEQ ID NO: 5792 - DNA, 201 bp, Homo sapiens; identical to SEQ ID NO: 5749

SEQ ID NO: 5793 - DNA, 201 bp, Homo sapiens; identical to SEQ ID NO: 5750

SEQ ID NO: 5794 - DNA, 201 bp, Homo sapiens; identical to SEQ ID NO: 5751

SEQ ID NO: 5795 - DNA, 201 bp, Homo sapiens; identical to SEQ ID NO: 5778

SEQ ID NO: 5796 - DNA, 105 bp, Homo sapiens; identical to SEQ ID NO: 5773

SEQ ID NO: 5797 - DNA, 201 bp, Homo sapiens; identical to SEQ ID NO: 5748

SEQ ID NO: 5798 - DNA, 201 bp, Homo sapiens; identical to SEQ ID NO: 5749

SEQ ID NO: 5799 - DNA, 155 bp, Homo sapiens
aagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaa

SEQ ID NO: 5800 - DNA, 201 bp, Homo sapiens
aagaagtttctgagctttgtggcctaccaagggagaaactggctgcagcagagcgagtacttcgttccaacatggacatcctgaagccaatcctggtgagyagacttgctcactggagaaacttcaagcactaatgctttcggaatgtgaggcttttccttggacagcatgactttgttttgtagaaaagtacggctggct

SEQ ID NO: 5801 - DNA, 201 bp, Homo sapiens
tgcgcaaagttctgagaacattacagcagatcaagaaatccagctcaaacttgaagcttcaagatttcctggtggacaatgaaaccttctctgggttcctrtatcacaacctctctctcccaaagtctactgtggacaagatgctgagggctgatgtcattctccacaaggtatttttgcaaggctaccagttacatttga

SEQ ID NO: 5802 - DNA, 201 bp, Homo sapiens
aacagagttcttcatatttaaaaaaaaaaagtcttgaaaccattgatgggaagatggatatctatttatgtttaaaaacccatcataaagatgacattgtrggctgtcacagttggaaggccctggaattagatgagaccacactatttagcttacttagtaataacattgcaaagaaaaattccgacgaagttttttcag

SEQ ID NO: 5803 - DNA, 201 bp, Homo sapiens
  misc_feature (1)...(201): n = A,T,C or G, or insertion/deletion polymorphism (see Tables 1-2)
ggctaccagttacatttgacaagtctgtgcaatggatcaaaatcagaagagatgattcaacttggtgaccaagaagtttctgagctttgtggcctaccaanggagaaactggctgcagcagagcgagtacttcgttccaacatggacatcctgaagccaatcctggtgagtagacttgctcactggagaaacttcaagcac

SEQ ID NO: 5804 - DNA, 124 bp, Homo sapiens
tatccaggattctggttttctactcaccagatagattctcttaaaaccagggaaagattcctggaggaaggatgtatctggaaagagatgttccttattayaataaaatgaaattgtaatactc

SEQ ID NO: 5805 - DNA, 201 bp, Homo sapiens
gacgcaaacacaaaagtggaaaacagttaatgaccagccacggcgtccctgctgtgagctctggccgctgccttccagggctcccgagccacacgctgggsgtgctggctgagggaacatggcttgttggcctcagctgaggttgctgctgtggaagaacctcactttcagaagaagacaaacatgtcagctgctgctgga

SEQ ID NO: 5806 - DNA, 116 bp, Homo sapiens
attctggttttctactcaccagatagattctcttaaaaccagggaaagattcctggaggaaggatgtatctggaaagagatgttccttattataataaaaygaaattgtaatactc

SEQ ID NO: 5807 - DNA, 201 bp, Homo sapiens
atactggtgagcctgagcagtttggtcatcagagtgttttatatagttccagaacaaatatgtctctaggtgttctgagagctctggtgaaattcctctcsctaccccaaacatcatcatttaatatccaggattctggttttctactcaccagatagattctcttaaaaccagggaaagattcctggaggaaggatgtat

SEQ ID NO: 5808 - DNA, 201 bp, Homo sapiens
ggatatctatttatgtttaaaaacccatcataaagatgacattgtgggctgtcacagttggaaggccctggaattagatgagaccacactatttagcttayttagtaataacattgcaaagaaaaattccgacgaagttttttcagcctaggaatcaatagttcagagaagcactctatgagaatacccattcattcttaa

SEQ ID NO: 5809 - DNA, 201 bp, Homo sapiens
agatgacattgtgggctgtcacagttggaaggccctggaattagatgagaccacactatttagcttacttagtaataacattgcaaagaaaaattccgacraagttttttcagcctaggaatcaatagttcagagaagcactctatgagaatacccattcattcttaaccaaaaaatactggtgagcctgagcagtttggt

SEQ ID NO: 5810 - DNA, 201 bp, Homo sapiens
ctatgtggtgctcaccagcgtgaacctcttcattggcattaatggcagcgtggccacctttgtgctggagctgttcaccgacaataagctgaataatatcmatgatatcctgaagtccgtgttcttgatcttcccacatttttgcctgggacgagggctcatcgacatggtgaaaaaccaggcaatggctgatgccctgga

SEQ ID NO: 5811 - DNA, 201 bp, Homo sapiens
gttacgttgatgacatctttctgcgggtgatgagccggtcaatgcccctcttcatgacgctggcctggatttactcagtggctgtgatcatcaagggcatygtgtatgagaaggaggcacggctgaaagagaccatgcggatcatgggcctggacaacagcatcctctggtttagctggttcattagtagcctcattcctc

SEQ ID NO: 5812 - DNA, 201 bp, Homo sapiens
tcgatgtctctgctatctccaacctcatcaggaagcatgtgtctgaagcccggctggtggaagacatagggcatgagctgacctatgtgctgccatatgargctgctaaggagggagcctttgtggaactctttcatgagattgatgaccggctctcagacctgggcatttctagttatggcatctcagagacgaccctgg

SEQ ID NO: 5813 - DNA, 201 bp, Homo sapiens
  misc_feature (1)...(201): n = A,T,C or G, or insertion/deletion polymorphism (see Tables 1-2)
gccatcaaacaaatgaagaaacacctaaagctggccaaggacagttctgcagatcgatttctcaacagcttgggaagatttatgacaggactggacaccanaaataatgtcaaggtgtggttcaataacaagggctggcatgcaatcagctctttcctgaatgtcatcaacaatgccattctccgggccaacctgcaaaag

SEQ ID NO: 5814 - DNA, 201 bp, Homo sapiens
tcagttcctgcagaaacagtagtagcactgtgtcatacctgaaaaaggaggacagtgtttctcagagcagttctgatgctggcctgggcagcgaccatgasagtgacacgctgaccatcgatgtctctgctatctccaacctcatcaggaagcatgtgtctgaagcccggctggtggaagacatagggcatgagctgacct

SEQ ID NO: 5815 - DNA, 201 bp, Homo sapiens; identical to SEQ ID NO: 5801

SEQ ID NO: 5816 - DNA, 201 bp, Homo sapiens
ctatggggtgatgacctggtacattgaggctgtctttccaggccagtacggaattcccaggccctggtattttccttgcaccaagtcctactggtttggcraggaaagtgatgagaagagccaccctggttccaaccagaagagaatatcagaaatctgcatggaggaggaacccacccacttgaagctgggcgtgtccat

SEQ ID NO: 5817 - DNA, 201 bp, Homo sapiens
  misc_feature (1)...(201): n = A,T,C or G, or insertion/deletion polymorphism (see Tables 1-2)
ggctaccagttacatttgacaagtctgtgcaatggatcaaaatcagaagagatgattcaacttggtgaccaagaagtttctgagctttgtggcctaccaanggagaaactggctgcagcagagcgagtacttcgttccaacatggacatcctgaagccaatcctgagaacactaaactctacatctcccttcccgagcaag

SEQ ID NO: 5818 - DNA, 201 bp, Homo sapiens
cctggatttactcagtggctgtgatcatcaagggcatcgtgtatgagaaggaggcacggctgaaagagaccatgcggatcatgggcctggacaacagcatmctctggtttagctggttcattagtagcctcattcctcttcttgtgagcgctggcctgctagtggtcatcctgaagttaggaaacctgctgccctacagtg

SEQ ID NO: 5819 - DNA, 201 bp, Homo sapiens
aggaggtgatgtttctgaccaatgtgaacagctccagctcctccacccaaatctaccaggctgtgtctcgtattgtctgcgggcatcccgagggagggggrctgaagatcaagtctctcaactggtatgaggacaacaactacaaagccctctttggaggcaatggcactgaggaagatgctgaaaccttctatgacaact

SEQ ID NO: 5820 - DNA, 201 bp, Homo sapiens
ggctggtggaagacatagggcatgagctgacctatgtgctgccatatgaagctgctaaggagggagcctttgtggaactctttcatgagattgatgaccgrctctcagacctgggcatttctagttatggcatctcagagacgaccctggaagaaatattcctcaaggtggccgaagagagtggggtggatgctgagacct

SEQ ID NO: 5821 - DNA, 201 bp, Homo sapiens
ccctggttccaaccagaagagaatatcagaaatctgcatggaggaggaacccacccacttgaagctgggcgtgtccattcagaacctggtaaaagtctacygagatgggatgaaggtggctgtcgatggcctggcactgaatttttatgagggccagatcacctccttcctgggccacaatggagcggggaagacgaccac

SEQ ID NO: 5822 - DNA, 201 bp, Homo sapiens
agtatcttatcaaacatccatgaagtacatcagaacatgggctactgccctcagtttgatgccatcacagagctgttgactgggagagaacacgtggagtyctttgcccttttgagaggagtcccagagaaagaagttggcaaggttggtgagtgggcgattcggaaactgggcctcgtgaagtatggagaaaaatatgct

SEQ ID NO: 5823 - DNA, 201 bp, Homo sapiens
atgctgcctgtgtgtcccccaggggcaggggggctgcctcctccacaaagaaaacaaaacactgcagatatccttcaggacctgacaggaagaaacatttyggattatctggtgaagacgtatgtgcagatcatagccaaaagcttaaagaacaagatctgggtgaatgagtttaggtatggcggcttttccctgggtgtc

SEQ ID NO: 5824 - DNA, 201 bp, Homo sapiens
gtgacatgcgacaggaggtgatgtttctgaccaatgtgaacagctccagctcctccacccaaatctaccaggctgtgtctcgtattgtctgcgggcatccygagggaggggggctgaagatcaagtctctcaactggtatgaggacaacaactacaaagccctctttggaggcaatggcactgaggaagatgctgaaacct

SEQ ID NO: 5825 - DNA, 201 bp, Homo sapiens
ccatagcaacagaagtctggctcatcaacaagtccatggagctgctggatgagaggaagttctgggctggtattgtgttcactggaattactccaggcagyattgagctgccccatcatgtcaagtacaagatccgaatggacattgacaatgtggagaggacaaataaaatcaaggatgggtactgggaccctggtcctc

SEQ ID NO: 5826 - DNA, 201 bp, Homo sapiens
atgctcctgaggacacgggaaccctggaactcttaaacgccctcaccaaagaccctggcttcgggacccgctgtatggaaggaaacccaatcccagacacrccctgccaggcaggggaggaagagtggaccactgccccagttccccagaccatcatggacctcttccagaatgggaactggacaatgcagaacccttcac

SEQ ID NO: 5827 - DNA, 201 bp, Homo sapiens
atggtcaatggaaggttcaggtgccttggcagtgtccagcatctaaaaaataggtttggagatggttatacaatagttgtacgaatagcagggtccaaccyggacctgaagcctgtccaggatttctttggacttgcatttcctggaagtgttctaaaagagaaacaccggaacatgctacaataccagcttccatcttca

SEQ ID NO: 5828 - DNA, 201 bp, Homo sapiens
ctccagagccaacctggcagcagcctgtgggggcatcatctacttcacgctgtacctgccctacgtcctgtgtgtggcatggcaggactacgtgggcttcmcactcaagatcttcgctagcctgctgtctcctgtggcttttgggtttggctgtgagtactttgccctttttgaggagcagggcattggagtgcagtggga

SEQ ID NO: 5829 - DNA, 201 bp, Homo sapiens
gccctcattccaagcactttacgctgtctgtaatgggatctatttttgcactggaatatctgagaattgcaaaactagacaaaagtttcacaacagatttytaagttaaatcattttcattaaaaggaaaaaagaaaaaaaattttgtatgtcaataactttatatgaagtattaaaatgcatatttctatgttgtaatat

SEQ ID NO: 5830 - DNA, 201 bp, Homo sapiens
agggctcatcgacatggtgaaaaaccaggcaatggctgatgccctggaaaggtttggggagaatcgctttgtgtcaccattatcttgggacttggtgggaygaaacctcttcgccatggccgtggaaggggtggtgttcttcctcattactgttctgatccagtacagattcttcatcaggcccagacctgtaaatgcaaa

SEQ ID NO: 5831 - DNA, 201 bp, Homo sapiens
ccggcagaacctgggggtctgtccccagcataacgtgctgtttgacatgctgactgtcgaagaacacatctggttctatgcccgcttgaaagggctctctragaagcacgtgaaggcggagatggagcagatggccctggatgttggtttgccatcaagcaagctgaaaagcaaaacaagccagctgtcaggtggaatgca

SEQ ID NO: 5832 - DNA, 201 bp, Homo sapiens
cacactcttctccagagccaacctggcagcagcctgtgggggcatcatctacttcacgctgtacctgccctacgtcctgtgtgtggcatggcaggactacrtgggcttcacactcaagatcttcgctagcctgctgtctcctgtggcttttgggtttggctgtgagtactttgccctttttgaggagcagggcattggagt

SEQ ID NO: 5833 - DNA, 201 bp, Homo sapiens
ttcgcccgttcactgaagatgatgctgctgatccaaatgattctgacatagacccagaatccagagagacagacttgctcagtgggatggatggcaaaggrtcctaccaggtgaaaggctggaaacttacacagcaacagtttgtggcccttttgtggaagagactgctaattgccagacggagtcggaaaggattttttg

SEQ ID NO: 5834 - DNA, 201 bp, Homo sapiens
tggtcaatggaaggttcaggtgccttggcagtgtccagcatctaaaaaataggtttggagatggttatacaatagttgtacgaatagcagggtccaacccrgacctgaagcctgtccaggatttctttggacttgcatttcctggaagtgttctaaaagagaaacaccggaacatgctacaataccagcttccatcttcat

SEQ ID NO: 5835 - DNA, 201 bp, Homo sapiens
tgaatgatgaagatgaagatgtgaggcgggaaagacagagaattcttgatggtggaggccagaatgacatcttagaaatcaaggagttgacgaagatatayagaaggaagcggaagcctgctgttgacaggatttgcgtgggcattcctcctggtgagtgctttgggctcctgggagttaatggggctggaaaatcatcaa

SEQ ID NO: 5836 - DNA, 201 bp, Homo sapiens
acaccacatggatgaagcggacgtcctgggggacaggattgccatcatctcccatgggaagctgtgctgtgtgggctcctccctgtttctgaagaaccagytgggaacaggctactacctgaccttggtcaagaaagatgtggaatcctccctcagttcctgcagaaacagtagtagcactgtgtcatacctgaaaaagga

SEQ ID NO: 5837 - DNA, 201 bp, Homo sapiens
gggaagatttatgacaggactggacaccagaaataatgtcaaggtgtggttcaataacaagggctggcatgcaatcagctctttcctgaatgtcatcaacratgccattctccgggccaacctgcaaaagggagagaaccctagccattatggaattactgctttcaatcatcccctgaatctcaccaagcagcagctctc

SEQ ID NO: 5838 - DNA, 201 bp, Homo sapiens
acctcttccagaatgggaactggacaatgcagaacccttcacctgcatgccagtgtagcagcgacaaaatcaagaagatgctgcctgtgtgtcccccaggkgcaggggggctgcctcctccacaaagaaaacaaaacactgcagatatccttcaggacctgacaggaagaaacatttcggattatctggtgaagacgtatg

SEQ ID NO: 5839 - DNA, 201 bp, Homo sapiens
gttaactgtcttgagagaaaagaaaaatatgagagaactattgtttggggaagttcaagtgatctttcaatatcattactaacttcttccactttttccaraatttgaatattaacgctaaaggtgtaagacttcagatttcaaattaatctttctatattttttaaatttacagaatattatataacccactgctgaaaa

SEQ ID NO: 5840 - DNA, 201 bp, Homo sapiens
gtaatggttctgtgtacacctggagagaagctttcaacgagactaaccaggcaatccggaccatatctcgcttcatggagtgtgtcaacctgaacaagctrgaacccatagcaacagaagtctggctcatcaacaagtccatggagctgctggatgagaggaagttctgggctggtattgtgttcactggaattactccag

SEQ ID NO: 5841 - DNA, 201 bp, Homo sapiens
aagctgggcgtgtccattcagaacctggtaaaagtctaccgagatgggatgaaggtggctgtcgatggcctggcactgaatttttatgagggccagatcayctccttcctgggccacaatggagcggggaagacgaccaccatgtcaatcctgaccgggttgttccccccgacctcgggcaccgcctacatcctgggaaaa

SEQ ID NO: 5842 - DNA, 201 bp, Homo sapiens
taaaagtctaccgagatgggatgaaggtggctgtcgatggcctggcactgaatttttatgagggccagatcacctccttcctgggccacaatggagcgggraagacgaccaccatgtcaatcctgaccgggttgttccccccgacctcgggcaccgcctacatcctgggaaaagacattcgctctgagatgagcaccatcc

SEQ ID NO: 5843 - DNA, 201 bp, Homo sapiens
  misc_feature (1)...(201): n = A,T,C or G, or insertion/deletion polymorphism (see Tables 1-2)
tgagtactttgccctttttgaggagcagggcattggagtgcagtgggacaacctgtttgagagtcctgtggaggaagatggcttcaatctcaccacttcgntctccatgatgctgtttgacaccttcctctatggggtgatgacctggtacattgaggctgtctttccaggccagtacggaattcccaggccctggtattt

SEQ ID NO: 5844 - DNA, 201 bp, Homo sapiens
acggaattcccaggccctggtattttccttgcaccaagtcctactggtttggcgaggaaagtgatgagaagagccaccctggttccaaccagaagagaatrtcagaaatctgcatggaggaggaacccacccacttgaagctgggcgtgtccattcagaacctggtaaaagtctaccgagatgggatgaaggtggctgtcg

SEQ ID NO: 5845 - DNA, 201 bp, Homo sapiens
gtttgccatcaagcaagctgaaaagcaaaacaagccagctgtcaggtggaatgcagagaaagctatctgtggccttggcctttgtcgggggatctaaggtkgtcattctggatgaacccacagctggtgtggacccttactcccgcaggggaatatgggagctgctgctgaaataccgacaaggccgcaccattattctct

SEQ ID NO: 5846 - DNA, 201 bp, Homo sapiens
cgattcggaaactgggcctcgtgaagtatggagaaaaatatgctggtaactatagtggaggcaacaaacgcaagctctctacagccatggctttgatcggygggcctcctgtggtgtttctggatgaacccaccacaggcatggatcccaaagcccggcggttcttgtggaattgtgccctaagtgttgtcaaggagggga

SEQ ID NO: 5847 - DNA, 201 bp, Homo sapiens
actggctgcagcagagcgagtacttcgttccaacatggacatcctgaagccaatcctgagaacactaaactctacatctcccttcccgagcaaggagctgrctgaagccacaaaaacattgctgcatagtcttgggactctggcccaggagctgttcagcatgagaagctggagtgacatgcgacaggaggtgatgtttct

SEQ ID NO: 5848 - DNA, 201 bp, Homo sapiens
tgttcaagatccccagcacagcctatgtggtgctcaccagcgtgaacctcttcattggcattaatggcagcgtggccacctttgtgctggagctgttcacygacaataagctgaataatatcaatgatatcctgaagtccgtgttcttgatcttcccacatttttgcctgggacgagggctcatcgacatggtgaaaaacc

SEQ ID NO: 5849 - DNA, 201 bp, Homo sapiens
ttactcccgcaggggaatatgggagctgctgctgaaataccgacaaggccgcaccattattctctctacacaccacatggatgaagcggacgtcctggggkacaggattgccatcatctcccatgggaagctgtgctgtgtgggctcctccctgtttctgaagaaccagctgggaacaggctactacctgaccttggtcaa

SEQ ID NO: 5850 - DNA, 201 bp, Homo sapiens
tttatgagggccagatcacctccttcctgggccacaatggagcggggaagacgaccaccatgtcaatcctgaccgggttgttccccccgacctcgggcacygcctacatcctgggaaaagacattcgctctgagatgagcaccatccggcagaacctgggggtctgtccccagcataacgtgctgtttgacatgctgactg

SEQ ID NO: 5851 - DNA, 201 bp, Homo sapiens
tgaggagcagggcattggagtgcagtgggacaacctgtttgagagtcctgtggaggaagatggcttcaatctcaccacttcggtctccatgatgctgtttracaccttcctctatggggtgatgacctggtacattgaggctgtctttccaggccagtacggaattcccaggccctggtattttccttgcaccaagtccta

SEQ ID NO: 5852 - DNA, 201 bp, Homo sapiens
cgggccaacctgcaaaagggagagaaccctagccattatggaattactgctttcaatcatcccctgaatctcaccaagcagcagctctcagaggtggctcygatgaccacatcagtggatgtccttgtgtccatctgtgtcatctttgcaatgtccttcgtcccagccagctttgtcgtattcctgatccaggagcgggtc

SEQ ID NO: 5853 - DNA, 201 bp, Homo sapiens
agacaacacttgaccaagtatttgtgaactttgccaaggaccaaagtgatgatgaccacttaaaagacctctcattacacaaaaaccagacagtagtggamgttgcagttctcacatcttttctacaggatgagaaagtgaaagaaagctatgtatgaagaatcctgttcatacggggtggctgaaagtaaagaggaacta

SEQ ID NO: 5854 - DNA, 201 bp, Homo sapiens
cctctttcccgcattatctggaaagctctgaagccgctgctcgttgggaagatcctgtatacacctgacactccagccacaaggcaggtcatggctgaggygaacaagaccttccaggaactggctgtgttccatgatctggaaggcatgtgggaggaactcagccccaagatctggaccttcatggagaacagccaagaa

SEQ ID NO: 5855 - DNA, 201 bp, Homo sapiens
gagaggacaaataaaatcaaggatgggtactgggaccctggtcctcgagctgacccctttgaggacatgcggtacgtctgggggggcttcgcctacttgcrggatgtggtggagcaggcaatcatcagggtgctgacgggcaccgagaagaaaactggtgtctatatgcaacagatgccctatccctgttacgttgatgac

SEQ ID NO: 5856 - DNA, 201 bp, Homo sapiens
cgaatggacattgacaatgtggagaggacaaataaaatcaaggatgggtactgggaccctggtcctcgagctgacccctttgaggacatgcggtacgtctsggggggcttcgcctacttgcaggatgtggtggagcaggcaatcatcagggtgctgacgggcaccgagaagaaaactggtgtctatatgcaacagatgccc

SEQ ID NO: 5857 - DNA, 201 bp, Homo sapiens
aagaacaagatctgggtgaatgagtttaggtatggcggcttttccctgggtgtcagtaatactcaagcacttcctccgagtcaagaagttaatgatgccaycaaacaaatgaagaaacacctaaagctggccaaggacagttctgcagatcgatttctcaacagcttgggaagatttatgacaggactggacaccagaaat

SEQ ID NO: 5858 - DNA, 201 bp, Homo sapiens
ttctgcgggtgatgagccggtcaatgcccctcttcatgacgctggcctggatttactcagtggctgtgatcatcaagggcatcgtgtatgagaaggaggcrcggctgaaagagaccatgcggatcatgggcctggacaacagcatcctctggtttagctggttcattagtagcctcattcctcttcttgtgagcgctggcc

SEQ ID NO: 5859 - DNA, 201 bp, Homo sapiens
cctacttgcaggatgtggtggagcaggcaatcatcagggtgctgacgggcaccgagaagaaaactggtgtctatatgcaacagatgccctatccctgttasgttgatgacatctttctgcgggtgatgagccggtcaatgcccctcttcatgacgctggcctggatttactcagtggctgtgatcatcaagggcatcgtgt

SEQ ID NO: 5860 - DNA, 201 bp, Homo sapiens
ctggtaaaagtctaccgagatgggatgaaggtggctgtcgatggcctggcactgaatttttatgagggccagatcacctccttcctgggccacaatggagyggggaagacgaccaccatgtcaatcctgaccgggttgttccccccgacctcgggcaccgcctacatcctgggaaaagacattcgctctgagatgagcacc

SEQ ID NO: 5861 - DNA, 201 bp, Homo sapiens; identical to SEQ ID NO: 5801

SEQ ID NO: 5862 - DNA, 201 bp, Homo sapiens
  misc_feature (1)...(201): n = A,T,C or G, or insertion/deletion polymorphism (see Tables 1-2)
ggctaccagttacatttgacaagtctgtgcaatggatcaaaatcagaagagatgattcaacttggtgaccaagaagtttctgagctttgtggcctaccaanggagaaactggctgcagcagagcgagtacttcgttccaacatggacatcctgaagccaatcctgatggatgtgacatgtgatgacattgcacatgggcag

SEQ ID NO: 5863 - DNA, 201 bp, Homo sapiens; identical to SEQ ID NO: 5805

SEQ ID NO: 5864 - DNA, 201 bp, Homo sapiens; identical to SEQ ID NO: 5810

SEQ ID NO: 5865 - DNA, 201 bp, Homo sapiens; identical to SEQ ID NO: 5811

SEQ ID NO: 5866 - DNA, 201 bp, Homo sapiens; identical to SEQ ID NO: 5812

SEQ ID NO: 5867 - DNA, 201 bp, Homo sapiens; identical to SEQ ID NO: 5813
  misc_feature (1)...(201): n = A,T,C or G, or insertion/deletion polymorphism (see Tables 1-2)

SEQ ID NO: 5868 - DNA, 201 bp, Homo sapiens; identical to SEQ ID NO: 5814

SEQ ID NO: 5869 - DNA, 201 bp, Homo sapiens; identical to SEQ ID NO: 5801

SEQ ID NO: 5870 - DNA, 201 bp, Homo sapiens; identical to SEQ ID NO: 5816

SEQ ID NO: 5871 - DNA, 201 bp, Homo sapiens; identical to SEQ ID NO: 5817
  misc_feature (1)...(201): n = A,T,C or G, or insertion/deletion polymorphism (see Tables 1-2)

SEQ ID NO: 5872 - DNA, 201 bp, Homo sapiens; identical to SEQ ID NO: 5818

SEQ ID NO: 5873 - DNA, 201 bp, Homo sapiens; identical to SEQ ID NO: 5819

SEQ ID NO: 5874 - DNA, 201 bp, Homo sapiens; identical to SEQ ID NO: 5820

SEQ ID NO: 5875 - DNA, 201 bp, Homo sapiens; identical to SEQ ID NO: 5821

SEQ ID NO: 5876 - DNA, 201 bp, Homo sapiens; identical to SEQ ID NO: 5822

SEQ ID NO: 5877 - DNA, 201 bp, Homo sapiens; identical to SEQ ID NO: 5823

SEQ ID NO: 5878 - DNA, 201 bp, Homo sapiens; identical to SEQ ID NO: 5824

SEQ ID NO: 5879 - DNA, 201 bp, Homo sapiens; identical to SEQ ID NO: 5825

SEQ ID NO: 5880 - DNA, 201 bp, Homo sapiens; identical to SEQ ID NO: 5826

SEQ ID NO: 5881 - DNA, 201 bp, Homo sapiens; identical to SEQ ID NO: 5827

SEQ ID NO: 5882 - DNA, 201 bp, Homo sapiens; identical to SEQ ID NO: 5828

SEQ ID NO: 5883 - DNA, 201 bp, Homo sapiens; identical to SEQ ID NO: 5829

SEQ ID NO: 5884 - DNA, 201 bp, Homo sapiens; identical to SEQ ID NO: 5830

SEQ ID NO: 5885 - DNA, 201 bp, Homo sapiens; identical to SEQ ID NO: 5831

SEQ ID NO: 5886 - DNA, 201 bp, Homo sapiens; identical to SEQ ID NO: 5832

SEQ ID NO: 5887 - DNA, 201 bp, Homo sapiens; identical to SEQ ID NO: 5833

SEQ ID NO: 5888 - DNA, 201 bp, Homo sapiens; identical to SEQ ID NO: 5805

SEQ ID NO: 5889 - DNA, 201 bp, Homo sapiens; identical to SEQ ID NO: 5834

SEQ ID NO: 5890 - DNA, 201 bp, Homo sapiens; identical to SEQ ID NO: 5835

SEQ ID NO: 5891 - DNA, 201 bp, Homo sapiens; identical to SEQ ID NO: 5836

SEQ ID NO: 5892 - DNA, 201 bp, Homo sapiens; identical to SEQ ID NO: 5837

SEQ ID NO: 5893 - DNA, 201 bp, Homo sapiens; identical to SEQ ID NO: 5838

SEQ ID NO: 5894 - DNA, 201 bp, Homo sapiens; identical to SEQ ID NO: 5839

SEQ ID NO: 5895 - DNA, 201 bp, Homo sapiens; identical to SEQ ID NO: 5840

SEQ ID NO: 5896 - DNA, 201 bp, Homo sapiens; identical to SEQ ID NO: 5841

SEQ ID NO: 5897 - DNA, 201 bp, Homo sapiens; identical to SEQ ID NO: 5842

SEQ ID NO: 5898 - DNA, 201 bp, Homo sapiens; identical to SEQ ID NO: 5843
  misc_feature (1)...(201): n = A,T,C or G, or insertion/deletion polymorphism (see Tables 1-2)

SEQ ID NO: 5899 - DNA, 201 bp, Homo sapiens; identical to SEQ ID NO: 5844

SEQ ID NO: 5900 - DNA, 201 bp, Homo sapiens; identical to SEQ ID NO: 5845

SEQ ID NO: 5901 - DNA, 201 bp, Homo sapiens; identical to SEQ ID NO: 5846

SEQ ID NO: 5902 - DNA, 201 bp, Homo sapiens; identical to SEQ ID NO: 5847

SEQ ID NO: 5903 - DNA, 201 bp, Homo sapiens; identical to SEQ ID NO: 5848

SEQ ID NO: 5904 - DNA, 201 bp, Homo sapiens; identical to SEQ ID NO: 5849

SEQ ID NO: 5905 - DNA, 201 bp, Homo sapiens; identical to SEQ ID NO: 5850

SEQ ID NO: 5906 - DNA, 201 bp, Homo sapiens; identical to SEQ ID NO: 5851

SEQ ID NO: 5907 - DNA, 201 bp, Homo sapiens; identical to SEQ ID NO: 5852

SEQ ID NO: 5908 - DNA, 201 bp, Homo sapiens; identical to SEQ ID NO: 5853

SEQ ID NO: 5909 - DNA, 201 bp, Homo sapiens; identical to SEQ ID NO: 5854

SEQ ID NO: 5910 - DNA, 201 bp, Homo sapiens; identical to SEQ ID NO: 5855

SEQ ID NO: 5911 - DNA, 201 bp, Homo sapiens; identical to SEQ ID NO: 5856

SEQ ID NO: 5912 - DNA, 201 bp, Homo sapiens; identical to SEQ ID NO: 5857

SEQ ID NO: 5913 - DNA, 201 bp, Homo sapiens; identical to SEQ ID NO: 5858

SEQ ID NO: 5914 - DNA, 201 bp, Homo sapiens; identical to SEQ ID NO: 5859

SEQ ID NO: 5915 - DNA, 201 bp, Homo sapiens; identical to SEQ ID NO: 5860

SEQ ID NO: 5916 - DNA, 201 bp, Homo sapiens; identical to SEQ ID NO: 5810

SEQ ID NO: 5917 - DNA, 201 bp, Homo sapiens; identical to SEQ ID NO: 5811

SEQ ID NO: 5918 - DNA, 201 bp, Homo sapiens; identical to SEQ ID NO: 5812

SEQ ID NO: 5919 - DNA, 201 bp, Homo sapiens; identical to SEQ ID NO: 5813
  misc_feature (1)...(201): n = A,T,C or G, or insertion/deletion polymorphism (see Tables 1-2)

SEQ ID NO: 5920 - DNA, 201 bp, Homo sapiens; identical to SEQ ID NO: 5814

SEQ ID NO: 5921 - DNA, 201 bp, Homo sapiens; identical to SEQ ID NO: 5801

SEQ ID NO: 5922 - DNA, 201 bp, Homo sapiens; identical to SEQ ID NO: 5816

SEQ ID NO: 5923 - DNA, 201 bp, Homo sapiens; identical to SEQ ID NO: 5817
  misc_feature (1)...(201): n = A,T,C or G, or insertion/deletion polymorphism (see Tables 1-2)

SEQ ID NO: 5924 - DNA, 201 bp, Homo sapiens; identical to SEQ ID NO: 5818

SEQ ID NO: 5925 - DNA, 201 bp, Homo sapiens; identical to SEQ ID NO: 5819

SEQ ID NO: 5926 - DNA, 201 bp, Homo sapiens; identical to SEQ ID NO: 5820

SEQ ID NO: 5927 - DNA, 201 bp, Homo sapiens; identical to SEQ ID NO: 5821

SEQ ID NO: 5928 - DNA, 201 bp, Homo sapiens; identical to SEQ ID NO: 5822

SEQ ID NO: 5929 - DNA, 201 bp, Homo sapiens; identical to SEQ ID NO: 5823

SEQ ID NO: 5930 - DNA, 201 bp, Homo sapiens; identical to SEQ ID NO: 5824

SEQ ID NO: 5931 - DNA, 201 bp, Homo sapiens; identical to SEQ ID NO: 5825

SEQ ID NO: 5932 - DNA, 201 bp, Homo sapiens; identical to SEQ ID NO: 5826

SEQ ID NO: 5933 - DNA, 201 bp, Homo sapiens; identical to SEQ ID NO: 5827

SEQ ID NO: 5934 - DNA, 201 bp, Homo sapiens; identical to SEQ ID NO: 5828

SEQ ID NO: 5935 - DNA, 201 bp, Homo sapiens; identical to SEQ ID NO: 5829

SEQ ID NO: 5936 - DNA, 201 bp, Homo sapiens; identical to SEQ ID NO: 5830

SEQ ID NO: 5937 - DNA, 201 bp, Homo sapiens; identical to SEQ ID NO: 5831

SEQ ID NO: 5938 - DNA, 201 bp, Homo sapiens; identical to SEQ ID NO: 5832

SEQ ID NO: 5939 - DNA, 201 bp, Homo sapiens; identical to SEQ ID NO: 5833

SEQ ID NO: 5940 - DNA, 201 bp, Homo sapiens; identical to SEQ ID NO: 5834

SEQ ID NO: 5941 - DNA, 201 bp, Homo sapiens; identical to SEQ ID NO: 5835

SEQ ID NO: 5942 - DNA, 201 bp, Homo sapiens; identical to SEQ ID NO: 5836

SEQ ID NO: 5943 - DNA, 201 bp, Homo sapiens; identical to SEQ ID NO: 5837

SEQ ID NO: 5944 - DNA, 201 bp, Homo sapiens; identical to SEQ ID NO: 5838

SEQ ID NO: 5945 - DNA, 201 bp, Homo sapiens; identical to SEQ ID NO: 5839

SEQ ID NO: 5946 - DNA, 201 bp, Homo sapiens; identical to SEQ ID NO: 5840

SEQ ID NO: 5947 - DNA, 201 bp, Homo sapiens; identical to SEQ ID NO: 5841

SEQ ID NO: 5948 - DNA, 201 bp, Homo sapiens; identical to SEQ ID NO: 5842

SEQ ID NO: 5949 - DNA, 201 bp, Homo sapiens; identical to SEQ ID NO: 5843
  misc_feature (1)...(201): n = A,T,C or G, or insertion/deletion polymorphism (see Tables 1-2)

SEQ ID NO: 5950 - DNA, 201 bp, Homo sapiens; identical to SEQ ID NO: 5844

SEQ ID NO: 5951 - DNA, 201 bp, Homo sapiens; identical to SEQ ID NO: 5845

SEQ ID NO: 5952 - DNA, 201 bp, Homo sapiens; identical to SEQ ID NO: 5846

SEQ ID NO: 5953 - DNA, 201 bp, Homo sapiens; identical to SEQ ID NO: 5847

SEQ ID NO: 5954 - DNA, 201 bp, Homo sapiens; identical to SEQ ID NO: 5848

SEQ ID NO: 5955 - DNA, 201 bp, Homo sapiens; identical to SEQ ID NO: 5849

SEQ ID NO: 5956 - DNA, 201 bp, Homo sapiens; identical to SEQ ID NO: 5850

SEQ ID NO: 5957 - DNA, 201 bp, Homo sapiens; identical to SEQ ID NO: 5851

SEQ ID NO: 5958 - DNA, 201 bp, Homo sapiens; identical to SEQ ID NO: 5852

SEQ ID NO: 5959 - DNA, 201 bp, Homo sapiens; identical to SEQ ID NO: 5853

SEQ ID NO: 5960 - DNA, 201 bp, Homo sapiens; identical to SEQ ID NO: 5854

SEQ ID NO: 5961 - DNA, 201 bp, Homo sapiens; identical to SEQ ID NO: 5855

SEQ ID NO: 5962 - DNA, 201 bp, Homo sapiens; identical to SEQ ID NO: 5856

SEQ ID NO: 5963 - DNA, 201 bp, Homo sapiens; identical to SEQ ID NO: 5857

SEQ ID NO: 5964 - DNA, 201 bp, Homo sapiens; identical to SEQ ID NO: 5858

SEQ ID NO: 5965 - DNA, 201 bp, Homo sapiens; identical to SEQ ID NO: 5859

SEQ ID NO: 5966 - DNA, 201 bp, Homo sapiens; identical to SEQ ID NO: 5860

SEQ ID NO: 5967 - DNA, 201 bp, Homo sapiens
aggtgtatgcctgtcacccacagggctctcattctggagacagaaacccagaagagttgggacagctacctaataatcatggttcttcctagtcttctaaragatgatgcttgtgacccacaagcaccaggtgcgagaagggttctggcagagcaagtggaggtgctggctctgatggtgatatctgtgacacccgtgaac

SEQ ID NO: 5968 - DNA, 201 bp, Homo sapiens
ccctgctatgaggctttctatggaaggaaagggagaagcgggggtttcagcagactgccccagtttgtacagaagctaggactggtgcaagtagaccatgrggtcacagttgagagggacatcaccagcgggacccttcatcagaagtggggccacaaagaaactcagaggacaccaagaatgagggacagagccaggaaa

SEQ ID NO: 5969 - DNA, 201 bp, Homo sapiens
aaaagcaaaaacaaaaacatatgagaagaaacatgagaacggggtctcaggagcccaaagaagagaggatttcagaggaggagagggaatggtgcagtagrtgtatgcctgtcacccacagggctctcattctggagacagaaacccagaagagttgggacagctacctaataatcatggttcttcctagtcttctaaaag

SEQ ID NO: 5970 - DNA, 201 bp, Homo sapiens
cagtgactctagatctgatgccttctattcaaaaagcccattctttcttcttcaagccagcagccccaaacttcatcccagaaggcttgcctctctctccrtcctgtgcatttcagagagggacgtagagaaaactgccctcaggacttgcattcttgtactgggagagaaaaacgatgaaaagaagaccatttcagagag

SEQ ID NO: 5971 - DNA, 169 bp, Homo sapiens
tcccagaaggcttgcctctctctccgtcctgtgcatttcagagagggacgtagagaaaactgccctcaggacttgcattcttgtactgggagagaaaaacratgaaaagaagaccatttcagagagccagaagtgctgtgaaacagcaggaccacagcaactctgctaa

SEQ ID NO: 5972 - DNA, 201 bp, Homo sapiens
gagggacagagccaggaaagctaatgaaaagcaaaaacaaaaacatatgagaagaaacatgagaacggggtctcaggagcccaaagaagagaggatttcaraggaggagagggaatggtgcagtaggtgtatgcctgtcacccacagggctctcattctggagacagaaacccagaagagttgggacagctacctaataat

SEQ ID NO: 5973 - DNA, 201 bp, Homo sapiens
ggggccacaaagaaactcagaggacaccaagaatgagggacagagccaggaaagctaatgaaaagcaaaaacaaaaacatatgagaagaaacatgagaacrgggtctcaggagcccaaagaagagaggatttcagaggaggagagggaatggtgcagtaggtgtatgcctgtcacccacagggctctcattctggagacag

SEQ ID NO: 5974 - DNA, 201 bp, Homo sapiens
tgatgccttctattcaaaaagcccattctttcttcttcaagccagcagccccaaacttcatcccagaaggcttgcctctctctccgtcctgtgcatttcasagagggacgtagagaaaactgccctcaggacttgcattcttgtactgggagagaaaaacgatgaaaagaagaccatttcagagagccagaagtgctgtga

SEQ ID NO: 5975 - DNA, 123 bp, Homo sapiens
gacgtagagaaaactgccctcaggacttgcattcttgtactgggagagaaaaacgatgaaaagaagaccatttcagagagccagaagtgctgtgaaacagmaggaccacagcaactctgctaa

SEQ ID NO: 5976 - DNA, 201 bp, Homo sapiens
tctattcaaaaagcccattctttcttcttcaagccagcagccccaaacttcatcccagaaggcttgcctctctctccgtcctgtgcatttcagagagggaygtagagaaaactgccctcaggacttgcattcttgtactgggagagaaaaacgatgaaaagaagaccatttcagagagccagaagtgctgtgaaacagcag

SEQ ID NO: 5977 - DNA, 201 bp, Homo sapiens
acccctttccagcaagcaactgccttctcttctcttgttagacaatggtgccgtcaaacccggggacatcagcacatctcaggcgctgacaaaccaggaaygatgccctctcatcgcagccacatatgcacgtgaacatatagcacagtcaatgcagagcctcgttcaaaacccctgctatgaggctttctatggaaggaa

SEQ ID NO: 5978 - DNA, 201 bp, Homo sapiens
atagatgggaagatttcacccctttccagcaagcaactgccttctcttctcttgttagacaatggtgccgtcaaacccggggacatcagcacatctcaggygctgacaaaccaggaacgatgccctctcatcgcagccacatatgcacgtgaacatatagcacagtcaatgcagagcctcgttcaaaacccctgctatgag

SEQ ID NO: 5979 - DNA, 201 bp, Homo sapiens
agaatgagggacagagccaggaaagctaatgaaaagcaaaaacaaaaacatatgagaagaaacatgagaacggggtctcaggagcccaaagaagagaggakttcagaggaggagagggaatggtgcagtaggtgtatgcctgtcacccacagggctctcattctggagacagaaacccagaagagttgggacagctaccta

SEQ ID NO: 5980 - DNA, 201 bp, Homo sapiens
gggacccttcatcagaagtggggccacaaagaaactcagaggacaccaagaatgagggacagagccaggaaagctaatgaaaagcaaaaacaaaaacataygagaagaaacatgagaacggggtctcaggagcccaaagaagagaggatttcagaggaggagagggaatggtgcagtaggtgtatgcctgtcacccacagg

SEQ ID NO: 5981 - DNA, 201 bp, Homo sapiens
gagttggaggcattcctacttacggggttggagctgggggctttcccggctttggtgtcggagtcggaggtatccctggagtcgcaggtgtccctggtgtyggaggtgttcccggagtcggaggtgtcccgggagttggcatttcccccgaagctcaggcagcagctgccgccaaggctgccaagtacggagtggggaccc

SEQ ID NO: 5982 - DNA, 201 bp, Homo sapiens
tcggtgtggctcctggagttggcttggctcctggagttggcgtggctcctggagttggtgtggctcctggcgttggcgtggctcccggcattggccctggwggagttgcagctgcagcaaaatccgctgccaaggtggctgccaaagcccagctccgagctgcagctgggcttggtgctggcatccctggacttggagttg

SEQ ID NO: 5983 - DNA, 201 bp, Homo sapiens
tggtgtggctcctggcgttggcgtggctcccggcattggccctggtggagttgcagctgcagcaaaatccgctgccaaggtggctgccaaagcccagctcygagctgcagctgggcttggtgctggcatccctggacttggagttggtgtcggcgtccctggacttggagttggtgctggtgttcctggacttggagttgg

SEQ ID NO: 5984 - DNA, 201 bp, Homo sapiens
gtaggcatcccaggcggtgtggtgggagccggacccgccgccgccgctgccgcagccaaagctgctgccaaagccgcccagtttggcctagtgggagccgmtgggctcggaggactcggagtcggagggcttggagttccaggtgttgggggccttggaggtatacctccagctgcagccgctaaagcagctaaatacggt

SEQ ID NO: 5985 - DNA, 201 bp, Homo sapiens
tgctggcatccctggacttggagttggtgtcggcgtccctggacttggagttggtgctggtgttcctggacttggagttggtgctggtgttcctggcttcbgggcagtacctggagccctggctgccgctaaagcagccaaatatggagcagcagtgcctggggtccttggagggctcggggctctcggtggagtaggcat

SEQ ID NO: 5986 - DNA, 201 bp, Homo sapiens
cccacatctggggcgcttttgggttggaaaaccaccccacactgggaatagccaccttgcccttgtagaatccatccgcccatccgtccattcatccatcsgtccgtccatccatgtccccagttgaccgcccggcaccactagctggctgggtgcacccaccatcaacctggttgacctgtcatggccgcctgtgccctg

SEQ ID NO: 5987 - DNA, 201 bp, Homo sapiens
aggaaacaagaggggagcggccaagtgccccgaccaggaggccccctacttcagaggcaagggccatgtggtcctggccccccaccccatcccttcccacmtaggagctccccctccacacagcctccatctccaggggaacttggtgctacacgctggtgctcttatcttcctggggggagggaggagggaagggtggcc

SEQ ID NO: 5988 - DNA, 201 bp, Homo sapiens
ttggaggagtggcagcaagacctggcttcggattgtctcccattttcccaggtggggcctgcctggggaaagcttgtggccggaagagaaaatgagcttcmtaggacccctgactcacgacctcatcaacgttggtgctactgcttggtggagaatgtaaaccctttgtaaccccatcccatgcccctccgactccccacc

SEQ ID NO: 5989 - DNA, 201 bp, Homo sapiens
tgtggtgggagccggacccgccgccgccgctgccgcagccaaagctgctgccaaagccgcccagtttggcctagtgggagccgctgggctcggaggactcrgagtcggagggcttggagttccaggtgttgggggccttggaggtatacctccagctgcagccgctaaagcagctaaatacggtgctgctggccttggagg

SEQ ID NO: 5990 - DNA, 201 bp, Homo sapiens
gagttggtggcttaggagtgtctgcaggtgcggtggttcctcagcctggagccggagtgaagcctgggaaagtgccgggtgtggggctgccaggtgtatavccaggtggcgtgctcccaggagctcggttccccggtgtgggggtgctccctggagttcccactggagcaggagttaagcccaaggctccaggagttggac

SEQ ID NO: 5991 - DNA, 201 bp, Homo sapiens
gggtgtggggctgccaggtgtatacccaggtggcgtgctcccaggagctcggttccccggtgtgggggtgctccctggagttcccactggagcaggagttwagcccaaggctccaggagttggaccctttgggggaccgcaacctggagtcccactggggtatcccatcaaggcccccaagctgcctggtggctatggact

SEQ ID NO: 5992 - DNA, 201 bp, Homo sapiens
gctggcatccctggacttggagttggtgtcggcgtccctggacttggagttggtgctggtgttcctggacttggagttggtgctggtgttcctggcttcgrggcagtacctggagccctggctgccgctaaagcagccaaatatggagcagcagtgcctggggtccttggagggctcggggctctcggtggagtaggcatc

SEQ ID NO: 5993 - DNA, 201 bp, Homo sapiens
gggctctggtgcctggtggagtggctgacgctgctgcagcctataaagctgctaaggctggcgctgggcttggtggtgtcccaggagttggtggcttaggrgtgtctgcaggtgcggtggttcctcagcctggagccggagtgaagcctgggaaagtgccgggtgtggggctgccaggtgtatacccaggtggcgtgctcc

SEQ ID NO: 5994 - DNA, 201 bp, Homo sapiens
gcctggagccggagtgaagcctgggaaagtgccgggtgtggggctgccaggtgtatacccaggtggcgtgctcccaggagctcggttccccggtgtggggktgctccctggagttcccactggagcaggagttaagcccaaggctccaggagttggaccctttgggggaccgcaacctggagtcccactggggtatcccat

SEQ ID NO: 5995 - DNA, 201 bp, Homo sapiens
agtcggagttggaggcattcctacttacggggttggagctgggggctttcccggctttggtgtcggagtcggaggtatccctggagtcgcaggtgtccctrgtgtcggaggtgttcccggagtcggaggtgtcccgggagttggcatttcccccgaagctcaggcagcagctgccgccaaggctgccaagtacggagtggg

SEQ ID NO: 5996 - DNA, 201 bp, Homo sapiens
ggaggtgtcccgggagttggcatttcccccgaagctcaggcagcagctgccgccaaggctgccaagtacggagtggggaccccagcagctgcagctgctaragcagccgccaaagccgcccagtttgggttagttcctggtgtcggcgtggctcctggagttggcgtggctcctggtgtcggtgtggctcctggagttggc

SEQ ID NO: 5997 - DNA, 201 bp, Homo sapiens
aaagttcggtgctggagcagccggagtcctccctggtgttggaggggctggtgttcctggcgtgcctggggcaattcctggaattggaggcatcgcaggcrttgggactccagctgcagctgcagctgcagcagcagccgctaaggcagccaagtatggagctgctgcaggcttagtgcctggtgggccaggctttggccc

SEQ ID NO: 5998 - DNA, 201 bp, Homo sapiens; identical to SEQ ID NO: 5981

SEQ ID NO: 5999 - DNA, 201 bp, Homo sapiens; identical to SEQ ID NO: 5982

SEQ ID NO: 6000 - DNA, 201 bp, Homo sapiens; identical to SEQ ID NO: 5983

SEQ ID NO: 6001 - DNA, 201 bp, Homo sapiens; identical to SEQ ID NO: 5984

SEQ ID NO: 6002 - DNA, 201 bp, Homo sapiens
tgctggcatccctggacttggagttggtgtcggcgtccctggacttggagttggtgctggtgttcctggacttggagttggtgctggtgttcctggcttcbgggcaggtgcagatgagggagttaggcggagcctgtcccctgagctcagggaaggagatccctcctcctctcagcacctccccagcaccccctcatcacc

SEQ ID NO: 6003 - DNA, 201 bp, Homo sapiens; identical to SEQ ID NO: 5986

SEQ ID NO: 6004 - DNA, 201 bp, Homo sapiens; identical to SEQ ID NO: 5987

SEQ ID NO: 6005 - DNA, 201 bp, Homo sapiens; identical to SEQ ID NO: 5988

SEQ ID NO: 6006 - DNA, 201 bp, Homo sapiens; identical to SEQ ID NO: 5989

SEQ ID NO: 6007 - DNA, 201 bp, Homo sapiens
gagttggtggcttaggagtgtctgcaggtgcggtggttcctcagcctggagccggagtgaagcctgggaaagtgccgggtgtggggctgccaggtgtatavccaggtggcgtgctcccaggagctcggttccccggtgtgggggtgctccctggagttcccactggagcaggagttaagcccaaggctccaggtgtaggtg

SEQ ID NO: 6008 - DNA, 201 bp, Homo sapiens
gggtgtggggctgccaggtgtatacccaggtggcgtgctcccaggagctcggttccccggtgtgggggtgctccctggagttcccactggagcaggagttwagcccaaggctccaggtgtaggtggagcttttgctggaatcccaggagttggaccctttgggggaccgcaacctggagtcccactggggtatcccatcaa

SEQ ID NO: 6009 - DNA, 201 bp, Homo sapiens
gctggcatccctggacttggagttggtgtcggcgtccctggacttggagttggtgctggtgttcctggacttggagttggtgctggtgttcctggcttcgrggcaggtgcagatgagggagttaggcggagcctgtcccctgagctcagggaaggagatccctcctcctctcagcacctccccagcaccccctcatcaccc

SEQ ID NO: 6010 - DNA, 201 bp, Homo sapiens; identical to SEQ ID NO: 5993

SEQ ID NO: 6011 - DNA, 201 bp, Homo sapiens
gcctggagccggagtgaagcctgggaaagtgccgggtgtggggctgccaggtgtatacccaggtggcgtgctcccaggagctcggttccccggtgtggggktgctccctggagttcccactggagcaggagttaagcccaaggctccaggtgtaggtggagcttttgctggaatcccaggagttggaccctttgggggacc

SEQ ID NO: 6012 - DNA, 201 bp, Homo sapiens; identical to SEQ ID NO: 5995

SEQ ID NO: 6013 - DNA, 201 bp, Homo sapiens; identical to SEQ ID NO: 5996

SEQ ID NO: 6014 - DNA, 201 bp, Homo sapiens; identical to SEQ ID NO: 5997

SEQ ID NO: 6015 - DNA, 201 bp, Homo sapiens
tttaaacagcctgctctacttaatactgcctgaaagcaagacagaggtattaacgcaacaaagaaagaggcttttcaagcacaggaagaaaccagaacaawtgtacaaataggtttaactggtgagagctgaaggggctccagatattttccaaatacttggcatgcaaaaatcaccacaagtcagtggttctgaaagctt

SEQ ID NO: 6016 - DNA, 201 bp, Homo sapiens
tcctggatttcctggcaaagcccaggccttctcacacgcactcagggtgatctgagcagaccacaggctgttcatcccattgggttaaaaagtacttggaracttagttgcagtaaggtcttaggttttgttggggttttttttgtgggaaagtgaaggcatctgcacctgaaatgaaataccagaaagcctccacagcaa

SEQ ID NO: 6017 - DNA, 201 bp, Homo sapiens
caacacagcccggccctgccttcctggatttcctggcaaagcccaggccttctcacacgcactcagggtgatctgagcagaccacaggctgttcatcccawtgggttaaaaagtacttggagacttagttgcagtaaggtcttaggttttgttggggttttttttgtgggaaagtgaaggcatctgcacctgaaatgaaat

SEQ ID NO: 6018 - DNA, 201 bp, Homo sapiens
aggaaatggaagtacagggcagacaggtgacgtggcaaccgtccctaggaaaggcactgctggacccagctgtccctgtccctcaccagcctcacatgccsaagtcccatgtacccctggggctgccatgctggctgctgagccatgggcgctggtttggaggtgaacttcttcgaggaaagcagcttcttatcccccaga

SEQ ID NO: 6019 - DNA, 201 bp, Homo sapiens
atctgactagtttccatttgtctctgcattacaactaatacctctgggaggtgggggtgggggtgatcctaattcaaacagtaaggctgcccaggaagtayttctaataatatcaaccttcgtctttccttttttgtactgtaggctctttgtctcctgatcttcttttattttgttccccctttttactactaagcccaa

SEQ ID NO: 6020 - DNA, 201 bp, Homo sapiens
gacccagctgtccctgtccctcaccagcctcacatgcccaagtcccatgtacccctggggctgccatgctggctgctgagccatgggcgctggtttggagrtgaacttcttcgaggaaagcagcttcttatcccccagaagttctgcagatcatctgtgcactttggtttttacttaaaatgtgatttaaacagcctgctc

SEQ ID NO: 6021 - DNA, 201 bp, Homo sapiens
tcagtactcctcagtagcaatgacagcaacaatgacacagtaaacatctgcatttcataatcctggtacaactggctcaccgaagactgccaggatacgcyactctctgctcaaggggaaaatgtatcttccgaacaataaatccttcactaagcagatgcagtgcttgcccttggggtgacagcatacagtggaggatac

SEQ ID NO: 6022 - DNA, 201 bp, Homo sapiens
caccctattcccattctcaggagaaactgtcttcatgtcgatggaaaacccaggtctatggattctggggtgccacaactcagactttcggaacagaggcmtgaccgccttactgaaggtttctagttgtgacaagaacactggtgattattacgaggacagttatgaagatatttcagcatacttgctgagtaaaaacaa

SEQ ID NO: 6023 - DNA, 201 bp, Homo sapiens
ctcaccctattcccattctcaggagaaactgtcttcatgtcgatggaaaacccaggtctatggattctggggtgccacaactcagactttcggaacagagrcatgaccgccttactgaaggtttctagttgtgacaagaacactggtgattattacgaggacagttatgaagatatttcagcatacttgctgagtaaaaac

SEQ ID NO: 6024 - DNA, 201 bp, Homo sapiens
gaagacacactcaccctattcccattctcaggagaaactgtcttcatgtcgatggaaaacccaggtctatggattctggggtgccacaactcagactttckgaacagaggcatgaccgccttactgaaggtttctagttgtgacaagaacactggtgattattacgaggacagttatgaagatatttcagcatacttgctg

SEQ ID NO: 6025 - DNA, 201 bp, Homo sapiens
aaccaaaacttacttttggaaagtgcaacatcatatggcacccactaaagatgagtttgactgcaaagcctgggcttatttctctgatgttgacctggaaraagatgtgcactcaggcctgattggaccccttctggtctgccacactaacacactgaaccctgctcatgggagacaagtgacagtacaggaatttgctct

SEQ ID NO: 6026 - DNA, 201 bp, Homo sapiens
caaaacttacttttggaaagtgcaacatcatatggcacccactaaagatgagtttgactgcaaagcctgggcttatttctctgatgttgacctggaaaaadatgtgcactcaggcctgattggaccccttctggtctgccacactaacacactgaaccctgctcatgggagacaagtgacagtacaggaatttgctctgtt

SEQ ID NO: 6027 - DNA, 201 bp, Homo sapiens
tacttttggaaagtgcaacatcatatggcacccactaaagatgagtttgactgcaaagcctgggcttatttctctgatgttgacctggaaaaagatgtgcvctcaggcctgattggaccccttctggtctgccacactaacacactgaaccctgctcatgggagacaagtgacagtacaggaatttgctctgtttttcacc

SEQ ID NO: 6028 - DNA, 201 bp, Homo sapiens
tggaaagtgcaacatcatatggcacccactaaagatgagtttgactgcaaagcctgggcttatttctctgatgttgacctggaaaaagatgtgcactcagdcctgattggaccccttctggtctgccacactaacacactgaaccctgctcatgggagacaagtgacagtacaggaatttgctctgtttttcaccatcttt

SEQ ID NO: 6029 - DNA, 201 bp, Homo sapiens
caaaagctggtacttcactgaaaatatggaaagaaactgcagggctccctgcaatatccagatggaagatcccacttttaaagagaattatcgcttccatrcaatcaatggctacataatggatacactacctggcttagtaatggctcaggatcaaaggattcgatggtatctgctcagcatgggcagcaatgaaaacat

SEQ ID NO: 6030 - DNA, 201 bp, Homo sapiens
ctggtacttcactgaaaatatggaaagaaactgcagggctccctgcaatatccagatggaagatcccacttttaaagagaattatcgcttccatgcaatcratggctacataatggatacactacctggcttagtaatggctcaggatcaaaggattcgatggtatctgctcagcatgggcagcaatgaaaacatccattc

SEQ ID NO: 6031 - DNA, 201 bp, Homo sapiens
tggtacttcactgaaaatatggaaagaaactgcagggctccctgcaatatccagatggaagatcccacttttaaagagaattatcgcttccatgcaatcartggctacataatggatacactacctggcttagtaatggctcaggatcaaaggattcgatggtatctgctcagcatgggcagcaatgaaaacatccattct

SEQ ID NO: 6032 - DNA, 201 bp, Homo sapiens
tgttgacctggaaaaagatgtgcactcaggcctgattggaccccttctggtctgccacactaacacactgaaccctgctcatgggagacaagtgacagtayaggaatttgctctgtttttcaccatctttgatgagaccaaaagctggtacttcactgaaaatatggaaagaaactgcagggctccctgcaatatccagat

SEQ ID NO: 6033 - DNA, 201 bp, Homo sapiens
tacttcactgaaaatatggaaagaaactgcagggctccctgcaatatccagatggaagatcccacttttaaagagaattatcgcttccatgcaatcaatgsctacataatggatacactacctggcttagtaatggctcaggatcaaaggattcgatggtatctgctcagcatgggcagcaatgaaaacatccattctatt

SEQ ID NO: 6034 - DNA, 201 bp, Homo sapiens
gcagggctccctgcaatatccagatggaagatcccacttttaaagagaattatcgcttccatgcaatcaatggctacataatggatacactacctggcttwgtaatggctcaggatcaaaggattcgatggtatctgctcagcatgggcagcaatgaaaacatccattctattcatttcagtggacatgtgttcactgtac

SEQ ID NO: 6035 - DNA, 201 bp, Homo sapiens
gacctggaaaaagatgtgcactcaggcctgattggaccccttctggtctgccacactaacacactgaaccctgctcatgggagacaagtgacagtacaggratttgctctgtttttcaccatctttgatgagaccaaaagctggtacttcactgaaaatatggaaagaaactgcagggctccctgcaatatccagatggaa

SEQ ID NO: 6036 - DNA, 201 bp, Homo sapiens
agcatgggcagcaatgaaaacatccattctattcatttcagtggacatgtgttcactgtacgaaaaaaagaggagtataaaatggcactgtacaatctctrtccaggtgtttttgagacagtggaaatgttaccatccaaagctggaatttggcgggtggaatgccttattggcgagcatctacatgctgggatgagcaca

SEQ ID NO: 6037 - DNA, 201 bp, Homo sapiens
ctcaggcctgattggaccccttctggtctgccacactaacacactgaaccctgctcatgggagacaagtgacagtacaggaatttgctctgtttttcaccwtctttgatgagaccaaaagctggtacttcactgaaaatatggaaagaaactgcagggctccctgcaatatccagatggaagatcccacttttaaagagaa

SEQ ID NO: 6038 - DNA, 201 bp, Homo sapiens
gattggaccccttctggtctgccacactaacacactgaaccctgctcatgggagacaagtgacagtacaggaatttgctctgtttttcaccatctttgatragaccaaaagctggtacttcactgaaaatatggaaagaaactgcagggctccctgcaatatccagatggaagatcccacttttaaagagaattatcgctt

SEQ ID NO: 6039 - DNA, 201 bp, Homo sapiens
ctggtctgccacactaacacactgaaccctgctcatgggagacaagtgacagtacaggaatttgctctgtttttcaccatctttgatgagaccaaaagctkgtacttcactgaaaatatggaaagaaactgcagggctccctgcaatatccagatggaagatcccacttttaaagagaattatcgcttccatgcaatcaat

SEQ ID NO: 6040 - DNA, 201 bp, Homo sapiens
tggcatgtgattggaatgggcaccactcctgaagtgcactcaatattcctcgaaggtcacacatttcttgtgaggaaccatcgccaggcgtccttggaaakctcgccaataactttccttactgctcaaacactcttgatggaccttggacagtttctactgttttgtcatatctcttcccaccaacatgatggcatggaa

SEQ ID NO: 6041 - DNA, 201 bp, Homo sapiens
ggaagatcccacttttaaagagaattatcgcttccatgcaatcaatggctacataatggatacactacctggcttagtaatggctcaggatcaaaggattygatggtatctgctcagcatgggcagcaatgaaaacatccattctattcatttcagtggacatgtgttcactgtacgaaaaaaagaggagtataaaatggc

SEQ ID NO: 6042 - DNA, 201 bp, Homo sapiens
agacaagaggaatgtcatcctgttttctgtatttgatgagaaccgaagctggtacctcacagagaatatacaacgctttctccccaatccagctggagtgyagcttgaggatccagagttccaagcctccaacatcatgcacagcatcaatggctatgtttttgatagtttgcagttgtcagtttgtttgcatgaggtggc

SEQ ID NO: 6043 - DNA, 201 bp, Homo sapiens
gaagatcccacttttaaagagaattatcgcttccatgcaatcaatggctacataatggatacactacctggcttagtaatggctcaggatcaaaggattcdatggtatctgctcagcatgggcagcaatgaaaacatccattctattcatttcagtggacatgtgttcactgtacgaaaaaaagaggagtataaaatggca

SEQ ID NO: 6044 - DNA, 201 bp, Homo sapiens
tgtagatcaaagaggaaaccagataatgtcagacaagaggaatgtcatcctgttttctgtatttgatgagaaccgaagctggtacctcacagagaatatayaacgctttctccccaatccagctggagtgcagcttgaggatccagagttccaagcctccaacatcatgcacagcatcaatggctatgtttttgatagttt

SEQ ID NO: 6045 - DNA, 201 bp, Homo sapiens
gcgaggcacaggacctctactgagggtggccactgcagcacctgccactgccgtcacctctccctcctcagctccagggcagtgtccctccctggcttgcyttctacctttgtgctaaatcctagcagacactgccttgaagcctcctgaattaactatcatcagtcctgcatttctttggtggggggccaggagggtgca

SEQ ID NO: 6046 - DNA, 201 bp, Homo sapiens
gccaggtctgattggatgccacaggaaatcagtctattggcatgtgattggaatgggcaccactcctgaagtgcactcaatattcctcgaaggtcacacayttcttgtgaggaaccatcgccaggcgtccttggaaatctcgccaataactttccttactgctcaaacactcttgatggaccttggacagtttctactgtt

SEQ ID NO: 6047 - DNA, 201 bp, Homo sapiens
gtcaatggttatgtaaacaggtctctgccaggtctgattggatgccacaggaaatcagtctattggcatgtgattggaatgggcaccactcctgaagtgcmctcaatattcctcgaaggtcacacatttcttgtgaggaaccatcgccaggcgtccttggaaatctcgccaataactttccttactgctcaaacactcttg

SEQ ID NO: 6048 - DNA, 201 bp, Homo sapiens
agatcaaagaggaaaccagataatgtcagacaagaggaatgtcatcctgttttctgtatttgatgagaaccgaagctggtacctcacagagaatatacaaygctttctccccaatccagctggagtgcagcttgaggatccagagttccaagcctccaacatcatgcacagcatcaatggctatgtttttgatagtttgca

SEQ ID NO: 6049 - DNA, 201 bp, Homo sapiens
atctgctacaaagaatctgtagatcaaagaggaaaccagataatgtcagacaagaggaatgtcatcctgttttctgtatttgatgagaaccgaagctggtmcctcacagagaatatacaacgctttctccccaatccagctggagtgcagcttgaggatccagagttccaagcctccaacatcatgcacagcatcaatggc

SEQ ID NO: 6050 - DNA, 201 bp, Homo sapiens
atgattcaacaaatagaacaaagaaacacacagctcatttctcaaaaaaaggggaggaagaaaacttggaaggcttgggaaatcaaaccaagcaaattgtmgagaaatatgcatgcaccacaaggatatctcctaatacaagccagcagaattttgtcacgcaacgtagtaagagagctttgaaacaattcagactcccac

SEQ ID NO: 6051 - DNA, 201 bp, Homo sapiens
aacatcatgcacagcatcaatggctatgtttttgatagtttgcagttgtcagtttgtttgcatgaggtggcatactggtacattctaagcattggagcacmgactgacttcctttctgtcttcttctctggatataccttcaaacacaaaatggtctatgaagacacactcaccctattcccattctcaggagaaactgtc

SEQ ID NO: 6052 - DNA, 201 bp, Homo sapiens
catctgctacaaagaatctgtagatcaaagaggaaaccagataatgtcagacaagaggaatgtcatcctgttttctgtatttgatgagaaccgaagctggyacctcacagagaatatacaacgctttctccccaatccagctggagtgcagcttgaggatccagagttccaagcctccaacatcatgcacagcatcaatgg

SEQ ID NO: 6053 - DNA, 201 bp, Homo sapiens
atgtagttttgcctcagatacatacagtgactggcactaagaatttcatgaagaaccttttcttactgagcactaggcaaaatgtagaaggttcatatgasggggcatatgctccagtacttcaagattttaggtcattaaatgattcaacaaatagaacaaagaaacacacagctcatttctcaaaaaaaggggaggaag

SEQ ID NO: 6054 - DNA, 201 bp, Homo sapiens
tcatctgctacaaagaatctgtagatcaaagaggaaaccagataatgtcagacaagaggaatgtcatcctgttttctgtatttgatgagaaccgaagctgstacctcacagagaatatacaacgctttctccccaatccagctggagtgcagcttgaggatccagagttccaagcctccaacatcatgcacagcatcaatg

SEQ ID NO: 6055 - DNA, 201 bp, Homo sapiens
tcctcatctgctacaaagaatctgtagatcaaagaggaaaccagataatgtcagacaagaggaatgtcatcctgttttctgtatttgatgagaaccgaagstggtacctcacagagaatatacaacgctttctccccaatccagctggagtgcagcttgaggatccagagttccaagcctccaacatcatgcacagcatca

SEQ ID NO: 6056 - DNA, 201 bp, Homo sapiens
ggcagcaatgaaaacatccattctattcatttcagtggacatgtgttcactgtacgaaaaaaagaggagtataaaatggcactgtacaatctctatccagstgtttttgagacagtggaaatgttaccatccaaagctggaatttggcgggtggaatgccttattggcgagcatctacatgctgggatgagcacacttttt

SEQ ID NO: 6057 - DNA, 201 bp, Homo sapiens
ccattctattcatttcagtggacatgtgttcactgtacgaaaaaaagaggagtataaaatggcactgtacaatctctatccaggtgtttttgagacagtgkaaatgttaccatccaaagctggaatttggcgggtggaatgccttattggcgagcatctacatgctgggatgagcacactttttctggtgtacagcaataa

SEQ ID NO: 6058 - DNA, 201 bp, Homo sapiens
ctattcatttcagtggacatgtgttcactgtacgaaaaaaagaggagtataaaatggcactgtacaatctctatccaggtgtttttgagacagtggaaatrttaccatccaaagctggaatttggcgggtggaatgccttattggcgagcatctacatgctgggatgagcacactttttctggtgtacagcaataagtgtc

SEQ ID NO: 6059 - DNA, 201 bp, Homo sapiens
tttgagacagtggaaatgttaccatccaaagctggaatttggcgggtggaatgccttattggcgagcatctacatgctgggatgagcacactttttctggygtacagcaataagtgtcagactcccctgggaatggcttctggacacattagagattttcagattacagcttcaggacaatatggacagtgggccccaaag

SEQ ID NO: 6060 - DNA, 201 bp, Homo sapiens
gagacagtggaaatgttaccatccaaagctggaatttggcgggtggaatgccttattggcgagcatctacatgctgggatgagcacactttttctggtgtrcagcaataagtgtcagactcccctgggaatggcttctggacacattagagattttcagattacagcttcaggacaatatggacagtgggccccaaagctg

SEQ ID NO: 6061 - DNA, 201 bp, Homo sapiens
gtggaaatgttaccatccaaagctggaatttggcgggtggaatgccttattggcgagcatctacatgctgggatgagcacactttttctggtgtacagcartaagtgtcagactcccctgggaatggcttctggacacattagagattttcagattacagcttcaggacaatatggacagtgggccccaaagctggccaga

SEQ ID NO: 6062 - DNA, 201 bp, Homo sapiens
tgttaccatccaaagctggaatttggcgggtggaatgccttattggcgagcatctacatgctgggatgagcacactttttctggtgtacagcaataagtgwcagactcccctgggaatggcttctggacacattagagattttcagattacagcttcaggacaatatggacagtgggccccaaagctggccagacttcatt

SEQ ID NO: 6063 - DNA, 201 bp, Homo sapiens
atgttaccatccaaagctggaatttggcgggtggaatgccttattggcgagcatctacatgctgggatgagcacactttttctggtgtacagcaataagtrtcagactcccctgggaatggcttctggacacattagagattttcagattacagcttcaggacaatatggacagtgggccccaaagctggccagacttcat

SEQ ID NO: 6064 - DNA, 201 bp, Homo sapiens
gatcccacttttaaagagaattatcgcttccatgcaatcaatggctacataatggatacactacctggcttagtaatggctcaggatcaaaggattcgatrgtatctgctcagcatgggcagcaatgaaaacatccattctattcatttcagtggacatgtgttcactgtacgaaaaaaagaggagtataaaatggcactg

SEQ ID NO: 6065 - DNA, 201 bp, Homo sapiens
agaattatcgcttccatgcaatcaatggctacataatggatacactacctggcttagtaatggctcaggatcaaaggattcgatggtatctgctcagcatrggcagcaatgaaaacatccattctattcatttcagtggacatgtgttcactgtacgaaaaaaagaggagtataaaatggcactgtacaatctctatccag

SEQ ID NO: 6066 - DNA, 201 bp, Homo sapiens
gctggaatttggcgggtggaatgccttattggcgagcatctacatgctgggatgagcacactttttctggtgtacagcaataagtgtcagactcccctggdaatggcttctggacacattagagattttcagattacagcttcaggacaatatggacagtgggccccaaagctggccagacttcattattccggatcaatc

SEQ ID NO: 6067 - DNA, 201 bp, Homo sapiens
catgcaatcaatggctacataatggatacactacctggcttagtaatggctcaggatcaaaggattcgatggtatctgctcagcatgggcagcaatgaaamcatccattctattcatttcagtggacatgtgttcactgtacgaaaaaaagaggagtataaaatggcactgtacaatctctatccaggtgtttttgagaca

SEQ ID NO: 6068 - DNA, 201 bp, Homo sapiens
tttaaccctccaattattgctcgatacatccgtttgcacccaactcattatagcattcgcagcactcttcgcatggagttgatgggctgtgatttaaatakttgcagcatgccattgggaatggagagtaaagcaatatcagatgcacagattactgcttcatcctactttaccaatatgtttgccacctggtctccttca

SEQ ID NO: 6069 - DNA, 201 bp, Homo sapiens
atcaatggctacataatggatacactacctggcttagtaatggctcaggatcaaaggattcgatggtatctgctcagcatgggcagcaatgaaaacatccwttctattcatttcagtggacatgtgttcactgtacgaaaaaaagaggagtataaaatggcactgtacaatctctatccaggtgtttttgagacagtggaa

SEQ ID NO: 6070 - DNA, 201 bp, Homo sapiens
gatacactacctggcttagtaatggctcaggatcaaaggattcgatggtatctgctcagcatgggcagcaatgaaaacatccattctattcatttcagtgdacatgtgttcactgtacgaaaaaaagaggagtataaaatggcactgtacaatctctatccaggtgtttttgagacagtggaaatgttaccatccaaagct

SEQ ID NO: 6071 - DNA, 201 bp, Homo sapiens
tacactacctggcttagtaatggctcaggatcaaaggattcgatggtatctgctcagcatgggcagcaatgaaaacatccattctattcatttcagtggabatgtgttcactgtacgaaaaaaagaggagtataaaatggcactgtacaatctctatccaggtgtttttgagacagtggaaatgttaccatccaaagctgg

SEQ ID NO: 6072 - DNA, 201 bp, Homo sapiens
cactgtacgaaaaaaagaggagtataaaatggcactgtacaatctctatccaggtgtttttgagacagtggaaatgttaccatccaaagctggaatttggygggtggaatgccttattggcgagcatctacatgctgggatgagcacactttttctggtgtacagcaataagtgtcagactcccctgggaatggcttctgg

SEQ ID NO: 6073 - DNA, 201 bp, Homo sapiens
gagtataaaatggcactgtacaatctctatccaggtgtttttgagacagtggaaatgttaccatccaaagctggaatttggcgggtggaatgccttattgrcgagcatctacatgctgggatgagcacactttttctggtgtacagcaataagtgtcagactcccctgggaatggcttctggacacattagagattttcag

SEQ ID NO: 6074 - DNA, 201 bp, Homo sapiens
  misc_feature (1)...(201): n = A,T,C or G, or insertion/deletion polymorphism (see Tables 1-2)
ttttttcagaatggcaaagtaaaggtttttcagggaaatcaagactccttcacacctgtggtgaactctctagacccaccgttactgactcgctaccttcnaattcacccccagagttgggtgcaccagattgccctgaggatggaggttctgggctgcgaggcacaggacctctactgagggtggccactgcagcacctg

SEQ ID NO: 6075 - DNA, 201 bp, Homo sapiens
tacatagttgaaatatcaaggaggtcagaagaaaattggactggtgaaaacagaaaaaacactccagtctgccatatcaccacacaataggatcccccttyttgccctccacccccataagattgtgaagggtttactgctccttccatctgcctgaccccttcactatgactacacagaatctcctgatagtaaaggggg

SEQ ID NO: 6076 - DNA, 201 bp, Homo sapiens
ccctctcctcatctgctacaaagaatctgtagatcaaagaggaaaccagataatgtcagacaagaggaatgtcatcctgttttctgtatttgatgagaacbgaagctggtacctcacagagaatatacaacgctttctccccaatccagctggagtgcagcttgaggatccagagttccaagcctccaacatcatgcacag

SEQ ID NO: 6077 - DNA, 201 bp, Homo sapiens
gccctctcctcatctgctacaaagaatctgtagatcaaagaggaaaccagataatgtcagacaagaggaatgtcatcctgttttctgtatttgatgagaascgaagctggtacctcacagagaatatacaacgctttctccccaatccagctggagtgcagcttgaggatccagagttccaagcctccaacatcatgcaca

SEQ ID NO: 6078 - DNA, 201 bp, Homo sapiens
tggccctctcctcatctgctacaaagaatctgtagatcaaagaggaaaccagataatgtcagacaagaggaatgtcatcctgttttctgtatttgatgagraccgaagctggtacctcacagagaatatacaacgctttctccccaatccagctggagtgcagcttgaggatccagagttccaagcctccaacatcatgca

SEQ ID NO: 6079 - DNA, 201 bp, Homo sapiens
cattggccctctcctcatctgctacaaagaatctgtagatcaaagaggaaaccagataatgtcagacaagaggaatgtcatcctgttttctgtatttgatkagaaccgaagctggtacctcacagagaatatacaacgctttctccccaatccagctggagtgcagcttgaggatccagagttccaagcctccaacatcat

SEQ ID NO: 6080 - DNA, 201 bp, Homo sapiens
ttcaaatataaatggacagtgactgtagaagatgggccaactaaatcagatcctcggtgcctgacccgctattactctagtttcgttaatatggagagagvtctagcttcaggactcattggccctctcctcatctgctacaaagaatctgtagatcaaagaggaaaccagataatgtcagacaagaggaatgtcatcctg

SEQ ID NO: 6081 - DNA, 201 bp, Homo sapiens
gctcgatacatccgtttgcacccaactcattatagcattcgcagcactcttcgcatggagttgatgggctgtgatttaaatagttgcagcatgccattggkaatggagagtaaagcaatatcagatgcacagattactgcttcatcctactttaccaatatgtttgccacctggtctccttcaaaagctcgacttcacctc

SEQ ID NO: 6082 - DNA, 201 bp, Homo sapiens
acagattactgcttcatcctactttaccaatatgtttgccacctggtctccttcaaaagctcgacttcacctccaagggaggagtaatgcctggagacctyaggtgaataatccaaaagagtggctgcaagtggacttccagaagacaatgaaagtcacaggagtaactactcagggagtaaaatctctgcttaccagcat

SEQ ID NO: 6083 - DNA, 201 bp, Homo sapiens
gattactgcttcatcctactttaccaatatgtttgccacctggtctccttcaaaagctcgacttcacctccaagggaggagtaatgcctggagacctcagrtgaataatccaaaagagtggctgcaagtggacttccagaagacaatgaaagtcacaggagtaactactcagggagtaaaatctctgcttaccagcatgta

SEQ ID NO: 6084 - DNA, 201 bp, Homo sapiens
ttaccaatatgtttgccacctggtctccttcaaaagctcgacttcacctccaagggaggagtaatgcctggagacctcaggtgaataatccaaaagagtgkctgcaagtggacttccagaagacaatgaaagtcacaggagtaactactcagggagtaaaatctctgcttaccagcatgtatgtgaaggagttcctcatct

SEQ ID NO: 6085 - DNA, 201 bp, Homo sapiens
attaaccttttgcttctccagttgaacatttgtagcaataagtcatgcaaatagagctctccacctgcttctttctgtgccttttgcgattctgctttagkgccaccagaagatactacctgggtgcagtggaactgtcatgggactatatgcaaagtgatctcggtgagctgcctgtggacgcaagatttcctcctagag

SEQ ID NO: 6086 - DNA, 201 bp, Homo sapiens
tctccagttgaacatttgtagcaataagtcatgcaaatagagctctccacctgcttctttctgtgccttttgcgattctgctttagtgccaccagaagatrctacctgggtgcagtggaactgtcatgggactatatgcaaagtgatctcggtgagctgcctgtggacgcaagatttcctcctagagtgccaaaatctttt

SEQ ID NO: 6087 - DNA, 201 bp, Homo sapiens
gttgaacatttgtagcaataagtcatgcaaatagagctctccacctgcttctttctgtgccttttgcgattctgctttagtgccaccagaagatactaccbgggtgcagtggaactgtcatgggactatatgcaaagtgatctcggtgagctgcctgtggacgcaagatttcctcctagagtgccaaaatcttttccattc

SEQ ID NO: 6088 - DNA, 201 bp, Homo sapiens
tagcaataagtcatgcaaatagagctctccacctgcttctttctgtgccttttgcgattctgctttagtgccaccagaagatactacctgggtgcagtggwactgtcatgggactatatgcaaagtgatctcggtgagctgcctgtggacgcaagatttcctcctagagtgccaaaatcttttccattcaacacctcagtc

SEQ ID NO: 6089 - DNA, 201 bp, Homo sapiens
agtaaaggtttttcagggaaatcaagactccttcacacctgtggtgaactctctagacccaccgttactgactcgctaccttcgaattcacccccagagtygggtgcaccagattgccctgaggatggaggttctgggctgcgaggcacaggacctctactgagggtggccactgcagcacctgccactgccgtcacctct

SEQ ID NO: 6090 - DNA, 201 bp, Homo sapiens
ccatacatatgtctggcaggtcctgaaagagaatggtccaatggcctctgacccactgtgccttacctactcatatctttctcatgtggacctggtaaaakacttgaattcaggcctcattggagccctactagtatgtagagaagggagtctggccaaggaaaagacacagaccttgcacaaatttatactactttttgc

SEQ ID NO: 6091 - DNA, 201 bp, Homo sapiens
  misc_feature (1)...(201): n = A,T,C or G, or insertion/deletion polymorphism (see Tables 1-2)
atgccattgggaatggagagtaaagcaatatcagatgcacagattactgcttcatcctactttaccaatatgtttgccacctggtctccttcaaaagctcnacttcacctccaagggaggagtaatgcctggagacctcaggtgaataatccaaaagagtggctgcaagtggacttccagaagacaatgaaagtcacagga

SEQ ID NO: 6092 - DNA, 201 bp, Homo sapiens
agccatacatatgtctggcaggtcctgaaagagaatggtccaatggcctctgacccactgtgccttacctactcatatctttctcatgtggacctggtaamagacttgaattcaggcctcattggagccctactagtatgtagagaagggagtctggccaaggaaaagacacagaccttgcacaaatttatactacttttt

SEQ ID NO: 6093 - DNA, 201 bp, Homo sapiens
attcaaatataaatggacagtgactgtagaagatgggccaactaaatcagatcctcggtgcctgacccgctattactctagtttcgttaatatggagagabatctagcttcaggactcattggccctctcctcatctgctacaaagaatctgtagatcaaagaggaaaccagataatgtcagacaagaggaatgtcatcct

SEQ ID NO: 6094 - DNA, 201 bp, Homo sapiens
atattcaaatataaatggacagtgactgtagaagatgggccaactaaatcagatcctcggtgcctgacccgctattactctagtttcgttaatatggagasagatctagcttcaggactcattggccctctcctcatctgctacaaagaatctgtagatcaaagaggaaaccagataatgtcagacaagaggaatgtcatc

SEQ ID NO: 6095 - DNA, 201 bp, Homo sapiens
ctgccaggagaaatattcaaatataaatggacagtgactgtagaagatgggccaactaaatcagatcctcggtgcctgacccgctattactctagtttcgwtaatatggagagagatctagcttcaggactcattggccctctcctcatctgctacaaagaatctgtagatcaaagaggaaaccagataatgtcagacaag

SEQ ID NO: 6096 - DNA, 201 bp, Homo sapiens
tccaattctgccaggagaaatattcaaatataaatggacagtgactgtagaagatgggccaactaaatcagatcctcggtgcctgacccgctattactctdgtttcgttaatatggagagagatctagcttcaggactcattggccctctcctcatctgctacaaagaatctgtagatcaaagaggaaaccagataatgtc

SEQ ID NO: 6097 - DNA, 201 bp, Homo sapiens
ttttccaattctgccaggagaaatattcaaatataaatggacagtgactgtagaagatgggccaactaaatcagatcctcggtgcctgacccgctattacyctagtttcgttaatatggagagagatctagcttcaggactcattggccctctcctcatctgctacaaagaatctgtagatcaaagaggaaaccagataat

SEQ ID NO: 6098 - DNA, 201 bp, Homo sapiens
ttgaaggattttccaattctgccaggagaaatattcaaatataaatggacagtgactgtagaagatgggccaactaaatcagatcctcggtgcctgacccrctattactctagtttcgttaatatggagagagatctagcttcaggactcattggccctctcctcatctgctacaaagaatctgtagatcaaagaggaaac

SEQ ID NO: 6099 - DNA, 201 bp, Homo sapiens
tttgaaggattttccaattctgccaggagaaatattcaaatataaatggacagtgactgtagaagatgggccaactaaatcagatcctcggtgcctgaccbgctattactctagtttcgttaatatggagagagatctagcttcaggactcattggccctctcctcatctgctacaaagaatctgtagatcaaagaggaaa

SEQ ID NO: 6100 - DNA, 201 bp, Homo sapiens
aggtgtaaaacatttgaaggattttccaattctgccaggagaaatattcaaatataaatggacagtgactgtagaagatgggccaactaaatcagatcctyggtgcctgacccgctattactctagtttcgttaatatggagagagatctagcttcaggactcattggccctctcctcatctgctacaaagaatctgtaga

SEQ ID NO: 6101 - DNA, 201 bp, Homo sapiens
accaaaaggtgtaaaacatttgaaggattttccaattctgccaggagaaatattcaaatataaatggacagtgactgtagaagatgggccaactaaatcaratcctcggtgcctgacccgctattactctagtttcgttaatatggagagagatctagcttcaggactcattggccctctcctcatctgctacaaagaatc

SEQ ID NO: 6102 - DNA, 201 bp, Homo sapiens
aaggagattaccaaaaggtgtaaaacatttgaaggattttccaattctgccaggagaaatattcaaatataaatggacagtgactgtagaagatgggccawctaaatcagatcctcggtgcctgacccgctattactctagtttcgttaatatggagagagatctagcttcaggactcattggccctctcctcatctgcta

SEQ ID NO: 6103 - DNA, 201 bp, Homo sapiens
gagctgcctgtggacgcaagatttcctcctagagtgccaaaatcttttccattcaacacctcagtcgtgtacaaaaagactctgtttgtagaattcacggwtcaccttttcaacatcgctaagccaaggccaccctggatgggtctgctaggtcctaccatccaggctgaggtttatgatacagtggtcattacacttaag

SEQ ID NO: 6104 - DNA, 201 bp, Homo sapiens
gtcatatctcttcccaccaacatgatggcatggaagcttatgtcaaagtagacagctgtccagaggaaccccaactacgaatgaaaaataatgaagaagcrgaagactatgatgatgatcttactgattctgaaatggatgtggtcaggtttgatgatgacaactctccttcctttatccaaattcgctcagttgccaaga

SEQ ID NO: 6105 - DNA, 201 bp, Homo sapiens
catgggactatatgcaaagtgatctcggtgagctgcctgtggacgcaagatttcctcctagagtgccaaaatcttttccattcaacacctcagtcgtgtamaaaaagactctgtttgtagaattcacggatcaccttttcaacatcgctaagccaaggccaccctggatgggtctgctaggtcctaccatccaggctgagg

SEQ ID NO: 6106 - DNA, 201 bp, Homo sapiens
tggctgcaagtggacttccagaagacaatgaaagtcacaggagtaactactcagggagtaaaatctctgcttaccagcatgtatgtgaaggagttcctcayctccagcagtcaagatggccatcagtggactctcttttttcagaatggcaaagtaaaggtttttcagggaaatcaagactccttcacacctgtggtgaac

SEQ ID NO: 6107 - DNA, 201 bp, Homo sapiens
gatcaccttttcaacatcgctaagccaaggccaccctggatgggtctgctaggtcctaccatccaggctgaggtttatgatacagtggtcattacacttamgaacatggcttcccatcctgtcagtcttcatgctgttggtgtatcctactggaaagcttctgagggagctgaatatgatgatcagaccagtcaaagggag

SEQ ID NO: 6108 - DNA, 201 bp, Homo sapiens
ccttttcaacatcgctaagccaaggccaccctggatgggtctgctaggtcctaccatccaggctgaggtttatgatacagtggtcattacacttaagaacrtggcttcccatcctgtcagtcttcatgctgttggtgtatcctactggaaagcttctgagggagctgaatatgatgatcagaccagtcaaagggagaaaga

SEQ ID NO: 6109 - DNA, 201 bp, Homo sapiens
atcgctaagccaaggccaccctggatgggtctgctaggtcctaccatccaggctgaggtttatgatacagtggtcattacacttaagaacatggcttcccrtcctgtcagtcttcatgctgttggtgtatcctactggaaagcttctgagggagctgaatatgatgatcagaccagtcaaagggagaaagaagatgataaa

SEQ ID NO: 6110 - DNA, 201 bp, Homo sapiens
tgttctaagaaacagggctcagagtggcagtgtccctcagttcaagaaagttgttttccaggaatttactgatggctcctttactcagcccttataccgtrgagaactaaatgaacatttgggactcctggggccatatataagagcagaagttgaagataatatcatggtaactttcagaaatcaggcctctcgtcccta

SEQ ID NO: 6111 - DNA, 201 bp, Homo sapiens
gaatatgatgatcagaccagtcaaagggagaaagaagatgataaagtcttccctggtggaagccatacatatgtctggcaggtcctgaaagagaatggtcyaatggcctctgacccactgtgccttacctactcatatctttctcatgtggacctggtaaaagacttgaattcaggcctcattggagccctactagtatgt

SEQ ID NO: 6112 - DNA, 201 bp, Homo sapiens
acctgtggtgaactctctagacccaccgttactgactcgctaccttcgaattcacccccagagttgggtgcaccagattgccctgaggatggaggttctgdgctgcgaggcacaggacctctactgagggtggccactgcagcacctgccactgccgtcacctctccctcctcagctccagggcagtgtccctccctggct

SEQ ID NO: 6113 - DNA, 201 bp, Homo sapiens
ttcccatcctgtcagtcttcatgctgttggtgtatcctactggaaagcttctgagggagctgaatatgatgatcagaccagtcaaagggagaaagaagatsataaagtcttccctggtggaagccatacatatgtctggcaggtcctgaaagagaatggtccaatggcctctgacccactgtgccttacctactcatatct

SEQ ID NO: 6114 - DNA, 201 bp, Homo sapiens
tctccccttactgagtctggtggacctctgagcttgagtgaagaaaataatgattcaaagttgttagaatcaggtttaatgaatagccaagaaagttcatrgggaaaaaatgtatcgtcaacagagagtggtaggttatttaaagggaaaagagctcatggacctgctttgttgactaaagataatgccttattcaaagtt

SEQ ID NO: 6115 - DNA, 201 bp, Homo sapiens
atcaggaatcttgggacctttactttatggggaagttggagacacactgttgattatatttaagaatcaagcaagcagaccatataacatctaccctcacrgaatcactgatgtccgtcctttgtattcaaggagattaccaaaaggtgtaaaacatttgaaggattttccaattctgccaggagaaatattcaaatataa

SEQ ID NO: 6116 - DNA, 201 bp, Homo sapiens
gtggactctcttttttcagaatggcaaagtaaaggtttttcagggaaatcaagactccttcacacctgtggtgaactctctagacccaccgttactgactbgctaccttcgaattcacccccagagttgggtgcaccagattgccctgaggatggaggttctgggctgcgaggcacaggacctctactgagggtggccact

SEQ ID NO: 6117 - DNA, 201 bp, Homo sapiens
caagactccttcacacctgtggtgaactctctagacccaccgttactgactcgctaccttcgaattcacccccagagttgggtgcaccagattgccctgasgatggaggttctgggctgcgaggcacaggacctctactgagggtggccactgcagcacctgccactgccgtcacctctccctcctcagctccagggcagt

SEQ ID NO: 6118 - DNA, 201 bp, Homo sapiens
gtgaatttacaaaggacgtaggactcaaagagatggtttttccaagcagcagaaacctatttcttactaacttggataatttacatgaaaataatacacayaatcaagaaaaaaaaattcaggaagaaatagaaaagaaggaaacattaatccaagagaatgtagttttgcctcagatacatacagtgactggcactaaga

SEQ ID NO: 6119 - DNA, 201 bp, Homo sapiens
agtaatggctcaggatcaaaggattcgatggtatctgctcagcatgggcagcaatgaaaacatccattctattcatttcagtggacatgtgttcactgtaygaaaaaaagaggagtataaaatggcactgtacaatctctatccaggtgtttttgagacagtggaaatgttaccatccaaagctggaatttggcgggtgga

SEQ ID NO: 6120 - DNA, 201 bp, Homo sapiens
ccctattcccattctcaggagaaactgtcttcatgtcgatggaaaacccaggtctatggattctggggtgccacaactcagactttcggaacagaggcatsaccgccttactgaaggtttctagttgtgacaagaacactggtgattattacgaggacagttatgaagatatttcagcatacttgctgagtaaaaacaatg

SEQ ID NO: 6121 - DNA, 201 bp, Homo sapiens
ttctcaggagaaactgtcttcatgtcgatggaaaacccaggtctatggattctggggtgccacaactcagactttcggaacagaggcatgaccgccttacwgaaggtttctagttgtgacaagaacactggtgattattacgaggacagttatgaagatatttcagcatacttgctgagtaaaaacaatgccattgaacca

SEQ ID NO: 6122 - DNA, 201 bp, Homo sapiens
tttcggaacagaggcatgaccgccttactgaaggtttctagttgtgacaagaacactggtgattattacgaggacagttatgaagatatttcagcatactwgctgagtaaaaacaatgccattgaaccaagaagcttctcccagaattcaagacaccctagcactaggcaaaagcaatttaatgccaccacaattccagaa

SEQ ID NO: 6123 - DNA, 201 bp, Homo sapiens
ggaaattccactggaaccttaatggtcttctttggcaatgtggattcatctgggataaaacacaatatttttaaccctccaattattgctcgatacatccrtttgcacccaactcattatagcattcgcagcactcttcgcatggagttgatgggctgtgatttaaatagttgcagcatgccattgggaatggagagtaaa

SEQ ID NO: 6124 - DNA, 201 bp, Homo sapiens
cagttatgaagatatttcagcatacttgctgagtaaaaacaatgccattgaaccaagaagcttctcccagaattcaagacaccctagcactaggcaaaagyaatttaatgccaccacaattccagaaaatgacatagagaagactgacccttggtttgcacacagaacacctatgcctaaaatacaaaatgtctcctctag

SEQ ID NO: 6125 - DNA, 201 bp, Homo sapiens
agaggaatgtcatcctgttttctgtatttgatgagaaccgaagctggtacctcacagagaatatacaacgctttctccccaatccagctggagtgcagctygaggatccagagttccaagcctccaacatcatgcacagcatcaatggctatgtttttgatagtttgcagttgtcagtttgtttgcatgaggtggcatact

SEQ ID NO: 6126 - DNA, 201 bp, Homo sapiens
agctgcctgtggacgcaagatttcctcctagagtgccaaaatcttttccattcaacacctcagtcgtgtacaaaaagactctgtttgtagaattcacggawcaccttttcaacatcgctaagccaaggccaccctggatgggtctgctaggtcctaccatccaggctgaggtttatgatacagtggtcattacacttaaga

SEQ ID NO: 6127 - DNA, 201 bp, Homo sapiens
actatatgcaaagtgatctcggtgagctgcctgtggacgcaagatttcctcctagagtgccaaaatcttttccattcaacacctcagtcgtgtacaaaaasactctgtttgtagaattcacggatcaccttttcaacatcgctaagccaaggccaccctggatgggtctgctaggtcctaccatccaggctgaggtttatg

SEQ ID NO: 6128 - DNA, 201 bp, Homo sapiens
gtatagtcttgatgggaagaagtggcagacttatcgaggaaattccactggaaccttaatggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 6129 - DNA, 201 bp, Homo sapiens
agaaaatgacatagagaagactgacccttggtttgcacacagaacacctatgcctaaaatacaaaatgtctcctctagtgatttgttgatgctcttgcgayagagtcctactccacatgggctatccttatctgatctccaagaagccaaatatgagactttttctgatgatccatcacctggagcaatagacagtaataa

SEQ ID NO: 6130 - DNA, 201 bp, Homo sapiens
tctttgttaaagacaaacaaaacttccaataattcagcaactaatagaaagactcacattgatggcccatcattattaattgagaatagtccatcagtctrgcaaaatatattagaaagtgacactgagtttaaaaaagtgacacctttgattcatgacagaatgcttatggacaaaaatgctacagctttgaggctaaat

SEQ ID NO: 6131 - DNA, 201 bp, Homo sapiens
gattcatgacagaatgcttatggacaaaaatgctacagctttgaggctaaatcatatgtcaaataaaactacttcatcaaaaaacatggaaatggtccaayagaaaaaagagggccccattccaccagatgcacaaaatccagatatgtcgttctttaagatgctattcttgccagaatcagcaaggtggatacaaaggac

SEQ ID NO: 6132 - DNA, 201 bp, Homo sapiens
aaatggtccaacagaaaaaagagggccccattccaccagatgcacaaaatccagatatgtcgttctttaagatgctattcttgccagaatcagcaaggtgratacaaaggactcatggaaagaactctctgaactctgggcaaggccccagtccaaagcaattagtatccttaggaccagaaaaatctgtggaaggtcaga

SEQ ID NO: 6133 - DNA, 201 bp, Homo sapiens
tgcacaaaatccagatatgtcgttctttaagatgctattcttgccagaatcagcaaggtggatacaaaggactcatggaaagaactctctgaactctgggyaaggccccagtccaaagcaattagtatccttaggaccagaaaaatctgtggaaggtcagaatttcttgtctgagaaaaacaaagtggtagtaggaaaggg

SEQ ID NO: 6134 - DNA, 201 bp, Homo sapiens
attaatccaagagaatgtagttttgcctcagatacatacagtgactggcactaagaatttcatgaagaaccttttcttactgagcactaggcaaaatgtakaaggttcatatgagggggcatatgctccagtacttcaagattttaggtcattaaatgattcaacaaatagaacaaagaaacacacagctcatttctcaaa

SEQ ID NO: 6135 - DNA, 201 bp, Homo sapiens
ctgagagtagcaacagaaagctctgcaaagactccctccaagctattggatcctcttgcttgggataaccactatggtactcagataccaaaagaagagtrgaaatcccaagagaagtcaccagaaaaaacagcttttaagaaaaaggataccattttgtccctgaacgcttgtgaaagcaatcatgcaatagcagcaata

SEQ ID NO: 6136 - DNA, 201 bp, Homo sapiens
gaagattttgacatttatgatgaggatgaaaatcagagcccccgcagctttcaaaagaaaacacgacactattttattgctgcagtggagaggctctgggwttatgggatgagtagctccccacatgttctaagaaacagggctcagagtggcagtgtccctcagttcaagaaagttgttttccaggaatttactgatggc

SEQ ID NO: 6137 - DNA, 201 bp, Homo sapiens
ctggaaagcttctgagggagctgaatatgatgatcagaccagtcaaagggagaaagaagatgataaagtcttccctggtggaagccatacatatgtctggyaggtcctgaaagagaatggtccaatggcctctgacccactgtgccttacctactcatatctttctcatgtggacctggtaaaagacttgaattcaggcct

SEQ ID NO: 6138 - DNA, 201 bp, Homo sapiens
tcttgcgacagagtcctactccacatgggctatccttatctgatctccaagaagccaaatatgagactttttctgatgatccatcacctggagcaatagamagtaataacagcctgtctgaaatgacacacttcaggccacagctccatcacagtggggacatggtatttacccctgagtcaggcctccaattaagattaa

SEQ ID NO: 6139 - DNA, 201 bp, Homo sapiens
aaagcttctgagggagctgaatatgatgatcagaccagtcaaagggagaaagaagatgataaagtcttccctggtggaagccatacatatgtctggcaggycctgaaagagaatggtccaatggcctctgacccactgtgccttacctactcatatctttctcatgtggacctggtaaaagacttgaattcaggcctcatt

SEQ ID NO: 6140 - DNA, 201 bp, Homo sapiens
gagctgaatatgatgatcagaccagtcaaagggagaaagaagatgataaagtcttccctggtggaagccatacatatgtctggcaggtcctgaaagagaawggtccaatggcctctgacccactgtgccttacctactcatatctttctcatgtggacctggtaaaagacttgaattcaggcctcattggagccctactag

SEQ ID NO: 6141 - DNA, 201 bp, Homo sapiens
gctgaatatgatgatcagaccagtcaaagggagaaagaagatgataaagtcttccctggtggaagccatacatatgtctggcaggtcctgaaagagaatgdtccaatggcctctgacccactgtgccttacctactcatatctttctcatgtggacctggtaaaagacttgaattcaggcctcattggagccctactagta

SEQ ID NO: 6142 - DNA, 201 bp, Homo sapiens
tgaatatgatgatcagaccagtcaaagggagaaagaagatgataaagtcttccctggtggaagccatacatatgtctggcaggtcctgaaagagaatggtycaatggcctctgacccactgtgccttacctactcatatctttctcatgtggacctggtaaaagacttgaattcaggcctcattggagccctactagtatg

SEQ ID NO: 6143 - DNA, 201 bp, Homo sapiens
ccccagagttgggtgcaccagattgccctgaggatggaggttctgggctgcgaggcacaggacctctactgagggtggccactgcagcacctgccactgcygtcacctctccctcctcagctccagggcagtgtccctccctggcttgccttctacctttgtgctaaatcctagcagacactgccttgaagcctcctgaat

SEQ ID NO: 6144 - DNA, 201 bp, Homo sapiens
aaagggagaaagaagatgataaagtcttccctggtggaagccatacatatgtctggcaggtcctgaaagagaatggtccaatggcctctgacccactgtgscttacctactcatatctttctcatgtggacctggtaaaagacttgaattcaggcctcattggagccctactagtatgtagagaagggagtctggccaagg

SEQ ID NO: 6145 - DNA, 201 bp, Homo sapiens
aagaagatgataaagtcttccctggtggaagccatacatatgtctggcaggtcctgaaagagaatggtccaatggcctctgacccactgtgccttacctamtcatatctttctcatgtggacctggtaaaagacttgaattcaggcctcattggagccctactagtatgtagagaagggagtctggccaaggaaaagacac

SEQ ID NO: 6146 - DNA, 201 bp, Homo sapiens
agaagatgataaagtcttccctggtggaagccatacatatgtctggcaggtcctgaaagagaatggtccaatggcctctgacccactgtgccttacctacycatatctttctcatgtggacctggtaaaagacttgaattcaggcctcattggagccctactagtatgtagagaagggagtctggccaaggaaaagacaca

SEQ ID NO: 6147 - DNA, 201 bp, Homo sapiens
agtcatgcaaatagagctctccacctgcttctttctgtgccttttgcgattctgctttagtgccaccagaagatactacctgggtgcagtggaactgtcakgggactatatgcaaagtgatctcggtgagctgcctgtggacgcaagatttcctcctagagtgccaaaatcttttccattcaacacctcagtcgtgtacaa

SEQ ID NO: 6148 - DNA, 201 bp, Homo sapiens
taaagtcttccctggtggaagccatacatatgtctggcaggtcctgaaagagaatggtccaatggcctctgacccactgtgccttacctactcatatcttyctcatgtggacctggtaaaagacttgaattcaggcctcattggagccctactagtatgtagagaagggagtctggccaaggaaaagacacagaccttgca

SEQ ID NO: 6149 - DNA, 201 bp, Homo sapiens
cttccctggtggaagccatacatatgtctggcaggtcctgaaagagaatggtccaatggcctctgacccactgtgccttacctactcatatctttctcatrtggacctggtaaaagacttgaattcaggcctcattggagccctactagtatgtagagaagggagtctggccaaggaaaagacacagaccttgcacaaatt

SEQ ID NO: 6150 - DNA, 201 bp, Homo sapiens
tattttagagaagaattaaccttttgcttctccagttgaacatttgtagcaataagtcatgcaaatagagctctccacctgcttctttctgtgccttttgygattctgctttagtgccaccagaagatactacctgggtgcagtggaactgtcatgggactatatgcaaagtgatctcggtgagctgcctgtggacgcaag

SEQ ID NO: 6151 - DNA, 201 bp, Homo sapiens
aacaatggccctcagcggattggtaggaagtacaaaaaagtccgatttatggcatacacagatgaaacctttaagactcgtgaagctattcagcatgaatsaggaatcttgggacctttactttatggggaagttggagacacactgttgattatatttaagaatcaagcaagcagaccatataacatctaccctcacgga

SEQ ID NO: 6152 - DNA, 201 bp, Homo sapiens
aaagagtggctgcaagtggacttccagaagacaatgaaagtcacaggagtaactactcagggagtaaaatctctgcttaccagcatgtatgtgaaggagtkcctcatctccagcagtcaagatggccatcagtggactctcttttttcagaatggcaaagtaaaggtttttcagggaaatcaagactccttcacacctgtg

SEQ ID NO: 6153 - DNA, 201 bp, Homo sapiens
gctgctgaagaggaggactgggactatgctcccttagtcctcgcccccgatgacagaagttataaaagtcaatatttgaacaatggccctcagcggattgdtaggaagtacaaaaaagtccgatttatggcatacacagatgaaacctttaagactcgtgaagctattcagcatgaatcaggaatcttgggacctttactt

SEQ ID NO: 6154 - DNA, 201 bp, Homo sapiens
gtggtcaggtttgatgatgacaactctccttcctttatccaaattcgctcagttgccaagaagcatcctaaaacttgggtacattacattgctgctgaagrggaggactgggactatgctcccttagtcctcgcccccgatgacagaagttataaaagtcaatatttgaacaatggccctcagcggattggtaggaagtac

SEQ ID NO: 6155 - DNA, 201 bp, Homo sapiens
tctgaaatggatgtggtcaggtttgatgatgacaactctccttcctttatccaaattcgctcagttgccaagaagcatcctaaaacttgggtacattacaktgctgctgaagaggaggactgggactatgctcccttagtcctcgcccccgatgacagaagttataaaagtcaatatttgaacaatggccctcagcggatt

SEQ ID NO: 6156 - DNA, 201 bp, Homo sapiens
agaagttgaagataatatcatggtaactttcagaaatcaggcctctcgtccctattccttctattctagccttatttcttatgaggaagatcagaggcaakgagcagaacctagaaaaaactttgtcaagcctaatgaaaccaaaacttacttttggaaagtgcaacatcatatggcacccactaaagatgagtttgactg

SEQ ID NO: 6157 - DNA, 201 bp, Homo sapiens
cagaggcaaggagcagaacctagaaaaaactttgtcaagcctaatgaaaccaaaacttacttttggaaagtgcaacatcatatggcacccactaaagatgrgtttgactgcaaagcctgggcttatttctctgatgttgacctggaaaaagatgtgcactcaggcctgattggaccccttctggtctgccacactaacaca

SEQ ID NO: 6158 - DNA, 201 bp, Homo sapiens
ttatttctctgatgttgacctggaaaaagatgtgcactcaggcctgattggaccccttctggtctgccacactaacacactgaaccctgctcatgggagayaagtgacagtacaggaatttgctctgtttttcaccatctttgatgagaccaaaagctggtacttcactgaaaatatggaaagaaactgcagggctccctg

SEQ ID NO: 6159 - DNA, 201 bp, Homo sapiens
ccttctggtctgccacactaacacactgaaccctgctcatgggagacaagtgacagtacaggaatttgctctgtttttcaccatctttgatgagaccaaawgctggtacttcactgaaaatatggaaagaaactgcagggctccctgcaatatccagatggaagatcccacttttaaagagaattatcgcttccatgcaat

SEQ ID NO: 6160 - DNA, 201 bp, Homo sapiens
ttctggtctgccacactaacacactgaaccctgctcatgggagacaagtgacagtacaggaatttgctctgtttttcaccatctttgatgagaccaaaagstggtacttcactgaaaatatggaaagaaactgcagggctccctgcaatatccagatggaagatcccacttttaaagagaattatcgcttccatgcaatca

SEQ ID NO: 6161 - DNA, 201 bp, Homo sapiens
aagtgacagtacaggaatttgctctgtttttcaccatctttgatgagaccaaaagctggtacttcactgaaaatatggaaagaaactgcagggctccctgmaatatccagatggaagatcccacttttaaagagaattatcgcttccatgcaatcaatggctacataatggatacactacctggcttagtaatggctcagg

SEQ ID NO: 6162 - DNA, 201 bp, Homo sapiens
acttttaaagagaattatcgcttccatgcaatcaatggctacataatggatacactacctggcttagtaatggctcaggatcaaaggattcgatggtatcygctcagcatgggcagcaatgaaaacatccattctattcatttcagtggacatgtgttcactgtacgaaaaaaagaggagtataaaatggcactgtacaat

SEQ ID NO: 6163 - DNA, 201 bp, Homo sapiens
tcgcagcactcttcgcatggagttgatgggctgtgatttaaatagttgcagcatgccattgggaatggagagtaaagcaatatcagatgcacagattactscttcatcctactttaccaatatgtttgccacctggtctccttcaaaagctcgacttcacctccaagggaggagtaatgcctggagacctcaggtgaataa

SEQ ID NO: 6164 - DNA, 201 bp, Homo sapiens
cctccaagggaggagtaatgcctggagacctcaggtgaataatccaaaagagtggctgcaagtggacttccagaagacaatgaaagtcacaggagtaactrctcagggagtaaaatctctgcttaccagcatgtatgtgaaggagttcctcatctccagcagtcaagatggccatcagtggactctcttttttcagaatgg

SEQ ID NO: 6165 - DNA, 201 bp, Homo sapiens
cttttttcagaatggcaaagtaaaggtttttcagggaaatcaagactccttcacacctgtggtgaactctctagacccaccgttactgactcgctaccttbgaattcacccccagagttgggtgcaccagattgccctgaggatggaggttctgggctgcgaggcacaggacctctactgagggtggccactgcagcacct

SEQ ID NO: 6166 - DNA, 201 bp, Homo sapiens
gggctgtgatttaaatagttgcagcatgccattgggaatggagagtaaagcaatatcagatgcacagattactgcttcatcctactttaccaatatgtttsccacctggtctccttcaaaagctcgacttcacctccaagggaggagtaatgcctggagacctcaggtgaataatccaaaagagtggctgcaagtggactt

SEQ ID NO: 6167 - DNA, 201 bp, Homo sapiens
tactgattctgaaatggatgtggtcaggtttgatgatgacaactctccttcctttatccaaattcgctcagttgccaagaagcatcctaaaacttgggtasattacattgctgctgaagaggaggactgggactatgctcccttagtcctcgcccccgatgacagaagttataaaagtcaatatttgaacaatggccctca

SEQ ID NO: 6168 - DNA, 201 bp, Homo sapiens
tgatcttactgattctgaaatggatgtggtcaggtttgatgatgacaactctccttcctttatccaaattcgctcagttgccaagaagcatcctaaaactkgggtacattacattgctgctgaagaggaggactgggactatgctcccttagtcctcgcccccgatgacagaagttataaaagtcaatatttgaacaatgg

SEQ ID NO: 6169 - DNA, 201 bp, Homo sapiens
atgcaaagtgatctcggtgagctgcctgtggacgcaagatttcctcctagagtgccaaaatcttttccattcaacacctcagtcgtgtacaaaaagactcygtttgtagaattcacggatcaccttttcaacatcgctaagccaaggccaccctggatgggtctgctaggtcctaccatccaggctgaggtttatgataca

SEQ ID NO: 6170 - DNA, 201 bp, Homo sapiens
tgagctgcctgtggacgcaagatttcctcctagagtgccaaaatcttttccattcaacacctcagtcgtgtacaaaaagactctgtttgtagaattcacgkatcaccttttcaacatcgctaagccaaggccaccctggatgggtctgctaggtcctaccatccaggctgaggtttatgatacagtggtcattacacttaa

SEQ ID NO: 6171 - DNA, 201 bp, Homo sapiens
ccttggacagtttctactgttttgtcatatctcttcccaccaacatgatggcatggaagcttatgtcaaagtagacagctgtccagaggaaccccaactaygaatgaaaaataatgaagaagcggaagactatgatgatgatcttactgattctgaaatggatgtggtcaggtttgatgatgacaactctccttcctttat

SEQ ID NO: 6172 - DNA, 201 bp, Homo sapiens
atcgcttccatgcaatcaatggctacataatggatacactacctggcttagtaatggctcaggatcaaaggattcgatggtatctgctcagcatgggcagmaatgaaaacatccattctattcatttcagtggacatgtgttcactgtacgaaaaaaagaggagtataaaatggcactgtacaatctctatccaggtgttt

SEQ ID NO: 6173 - DNA, 201 bp, Homo sapiens
acctggcttagtaatggctcaggatcaaaggattcgatggtatctgctcagcatgggcagcaatgaaaacatccattctattcatttcagtggacatgtgwtcactgtacgaaaaaaagaggagtataaaatggcactgtacaatctctatccaggtgtttttgagacagtggaaatgttaccatccaaagctggaatttg

SEQ ID NO: 6174 - DNA, 201 bp, Homo sapiens
tcactgtacgaaaaaaagaggagtataaaatggcactgtacaatctctatccaggtgtttttgagacagtggaaatgttaccatccaaagctggaatttgkcgggtggaatgccttattggcgagcatctacatgctgggatgagcacactttttctggtgtacagcaataagtgtcagactcccctgggaatggcttctg

SEQ ID NO: 6175 - DNA, 201 bp, Homo sapiens
tttgcttctccagttgaacatttgtagcaataagtcatgcaaatagagctctccacctgcttctttctgtgccttttgcgattctgctttagtgccaccasaagatactacctgggtgcagtggaactgtcatgggactatatgcaaagtgatctcggtgagctgcctgtggacgcaagatttcctcctagagtgccaaaa

SEQ ID NO: 6176 - DNA, 201 bp, Homo sapiens
ccagttgaacatttgtagcaataagtcatgcaaatagagctctccacctgcttctttctgtgccttttgcgattctgctttagtgccaccagaagatactrcctgggtgcagtggaactgtcatgggactatatgcaaagtgatctcggtgagctgcctgtggacgcaagatttcctcctagagtgccaaaatcttttcca

SEQ ID NO: 6177 - DNA, 201 bp, Homo sapiens
ggaaccttaatggtcttctttggcaatgtggattcatctgggataaaacacaatatttttaaccctccaattattgctcgatacatccgtttgcacccaaytcattatagcattcgcagcactcttcgcatggagttgatgggctgtgatttaaatagttgcagcatgccattgggaatggagagtaaagcaatatcagat

SEQ ID NO: 6178 - DNA, 201 bp, Homo sapiens
ggactatatgcaaagtgatctcggtgagctgcctgtggacgcaagatttcctcctagagtgccaaaatcttttccattcaacacctcagtcgtgtacaaaragactctgtttgtagaattcacggatcaccttttcaacatcgctaagccaaggccaccctggatgggtctgctaggtcctaccatccaggctgaggttta

SEQ ID NO: 6179 - DNA, 201 bp, Homo sapiens
catgccattgggaatggagagtaaagcaatatcagatgcacagattactgcttcatcctactttaccaatatgtttgccacctggtctccttcaaaagctbgacttcacctccaagggaggagtaatgcctggagacctcaggtgaataatccaaaagagtggctgcaagtggacttccagaagacaatgaaagtcacagg

SEQ ID NO: 6180 - DNA, 201 bp, Homo sapiens
aaaagagtggctgcaagtggacttccagaagacaatgaaagtcacaggagtaactactcagggagtaaaatctctgcttaccagcatgtatgtgaaggagwtcctcatctccagcagtcaagatggccatcagtggactctcttttttcagaatggcaaagtaaaggtttttcagggaaatcaagactccttcacacctgt

SEQ ID NO: 6181 - DNA, 201 bp, Homo sapiens
tccttcaaaagctcgacttcacctccaagggaggagtaatgcctggagacctcaggtgaataatccaaaagagtggctgcaagtggacttccagaagacartgaaagtcacaggagtaactactcagggagtaaaatctctgcttaccagcatgtatgtgaaggagttcctcatctccagcagtcaagatggccatcagtg

SEQ ID NO: 6182 - DNA, 201 bp, Homo sapiens
agcattcgcagcactcttcgcatggagttgatgggctgtgatttaaatagttgcagcatgccattgggaatggagagtaaagcaatatcagatgcacagawtactgcttcatcctactttaccaatatgtttgccacctggtctccttcaaaagctcgacttcacctccaagggaggagtaatgcctggagacctcaggtg

SEQ ID NO: 6183 - DNA, 201 bp, Homo sapiens
tgcaaatagagctctccacctgcttctttctgtgccttttgcgattctgctttagtgccaccagaagatactacctgggtgcagtggaactgtcatgggaytatatgcaaagtgatctcggtgagctgcctgtggacgcaagatttcctcctagagtgccaaaatcttttccattcaacacctcagtcgtgtacaaaaaga

SEQ ID NO: 6184 - DNA, 201 bp, Homo sapiens
ttcaacatcgctaagccaaggccaccctggatgggtctgctaggtcctaccatccaggctgaggtttatgatacagtggtcattacacttaagaacatggyttcccatcctgtcagtcttcatgctgttggtgtatcctactggaaagcttctgagggagctgaatatgatgatcagaccagtcaaagggagaaagaagat

SEQ ID NO: 6185 - DNA, 201 bp, Homo sapiens
catacatatgtctggcaggtcctgaaagagaatggtccaatggcctctgacccactgtgccttacctactcatatctttctcatgtggacctggtaaaagrcttgaattcaggcctcattggagccctactagtatgtagagaagggagtctggccaaggaaaagacacagaccttgcacaaatttatactactttttgct

SEQ ID NO: 6186 - DNA, 201 bp, Homo sapiens
gcacacagtcaatggttatgtaaacaggtctctgccaggtctgattggatgccacaggaaatcagtctattggcatgtgattggaatgggcaccactcctdaagtgcactcaatattcctcgaaggtcacacatttcttgtgaggaaccatcgccaggcgtccttggaaatctcgccaataactttccttactgctcaaac

SEQ ID NO: 6187 - DNA, 201 bp, Homo sapiens
ctcgaaggtcacacatttcttgtgaggaaccatcgccaggcgtccttggaaatctcgccaataactttccttactgctcaaacactcttgatggaccttgracagtttctactgttttgtcatatctcttcccaccaacatgatggcatggaagcttatgtcaaagtagacagctgtccagaggaaccccaactacgaatg

SEQ ID NO: 6188 - DNA, 201 bp, Homo sapiens
gacttatcgaggaaattccactggaaccttaatggtcttctttggcaatgtggattcatctgggataaaacacaatatttttaaccctccaattattgctygatacatccgtttgcacccaactcattatagcattcgcagcactcttcgcatggagttgatgggctgtgatttaaatagttgcagcatgccattgggaat

SEQ ID NO: 6189 - DNA, 201 bp, Homo sapiens
tcttcccaccaacatgatggcatggaagcttatgtcaaagtagacagctgtccagaggaaccccaactacgaatgaaaaataatgaagaagcggaagactrtgatgatgatcttactgattctgaaatggatgtggtcaggtttgatgatgacaactctccttcctttatccaaattcgctcagttgccaagaagcatcct

SEQ ID NO: 6190 - DNA, 201 bp, Homo sapiens
tacattgctgctgaagaggaggactgggactatgctcccttagtcctcgcccccgatgacagaagttataaaagtcaatatttgaacaatggccctcagcsgattggtaggaagtacaaaaaagtccgatttatggcatacacagatgaaacctttaagactcgtgaagctattcagcatgaatcaggaatcttgggacct

SEQ ID NO: 6191 - DNA, 201 bp, Homo sapiens
cattgctgctgaagaggaggactgggactatgctcccttagtcctcgcccccgatgacagaagttataaaagtcaatatttgaacaatggccctcagcggwttggtaggaagtacaaaaaagtccgatttatggcatacacagatgaaacctttaagactcgtgaagctattcagcatgaatcaggaatcttgggaccttt

SEQ ID NO: 6192 - DNA, 201 bp, Homo sapiens
tccctccaagctattggatcctcttgcttgggataaccactatggtactcagataccaaaagaagagtggaaatcccaagagaagtcaccagaaaaaacakcttttaagaaaaaggataccattttgtccctgaacgcttgtgaaagcaatcatgcaatagcagcaataaatgagggacaaaataagcccgaaatagaagt

SEQ ID NO: 6193 - DNA, 201 bp, Homo sapiens
ggcaaagtaaaggtttttcagggaaatcaagactccttcacacctgtggtgaactctctagacccaccgttactgactcgctaccttcgaattcacccccmgagttgggtgcaccagattgccctgaggatggaggttctgggctgcgaggcacaggacctctactgagggtggccactgcagcacctgccactgccgtca

SEQ ID NO: 6194 - DNA, 201 bp, Homo sapiens
ctcccagaattcaagacaccctagcactaggcaaaagcaatttaatgccaccacaattccagaaaatgacatagagaagactgacccttggtttgcacacrgaacacctatgcctaaaatacaaaatgtctcctctagtgatttgttgatgctcttgcgacagagtcctactccacatgggctatccttatctgatctcca

SEQ ID NO: 6195 - DNA, 201 bp, Homo sapiens
aggctaacttacagaaatgaataagttgttttgttttatagcccggtagaggagttaaccccaaaggtgatatggttttatttcctgttatgtttaacttrataatcttattttggcattcttttcccattgactatatacatctctatttctcaaatgttcatggaactagctcttttattttcctgctggtttcttcag

SEQ ID NO: 6196 - DNA, 201 bp, Homo sapiens
tatgctggagtattttctaataatcctgcttgacccttatctgacctctttggaaactataacatagctgtcacagtatagtcacaatccacaaatgatgmaggtgcaaatggtttatagccctgtgaagttcttaaagtttagaggctaacttacagaaatgaataagttgttttgttttatagcccggtagaggagtta

SEQ ID NO: 6197 - DNA, 201 bp, Homo sapiens
tccacccccataagattgtgaagggtttactgctccttccatctgcctgaccccttcactatgactacacagaatctcctgatagtaaagggggctggagrcaaggataagttatagagcagttggaggaagcatccaaagattgcaacccagggcaaatggaaaacaggagatcctaatatgaaagaaaaatggatccca

SEQ ID NO: 6198 - DNA, 201 bp, Homo sapiens
cgcccccgatgacagaagttataaaagtcaatatttgaacaatggccctcagcggattggtaggaagtacaaaaaagtccgatttatggcatacacagatkaaacctttaagactcgtgaagctattcagcatgaatcaggaatcttgggacctttactttatggggaagttggagacacactgttgattatatttaagaa

SEQ ID NO: 6199 - DNA, 201 bp, Homo sapiens
agaaaaaacagcttttaagaaaaaggataccattttgtccctgaacgcttgtgaaagcaatcatgcaatagcagcaataaatgagggacaaaataagccckaaatagaagtcacctgggcaaagcaaggtaggactgaaaggctgtgctctcaaaacccaccagtcttgaaacgccatcaacgggaaataactcgtactac

SEQ ID NO: 6200 - DNA, 201 bp, Homo sapiens
gatgacagaagttataaaagtcaatatttgaacaatggccctcagcggattggtaggaagtacaaaaaagtccgatttatggcatacacagatgaaacctktaagactcgtgaagctattcagcatgaatcaggaatcttgggacctttactttatggggaagttggagacacactgttgattatatttaagaatcaagca

SEQ ID NO: 6201 - DNA, 201 bp, Homo sapiens
agaaaaaggataccattttgtccctgaacgcttgtgaaagcaatcatgcaatagcagcaataaatgagggacaaaataagcccgaaatagaagtcacctgrgcaaagcaaggtaggactgaaaggctgtgctctcaaaacccaccagtcttgaaacgccatcaacgggaaataactcgtactactcttcagtcagatcaag

SEQ ID NO: 6202 - DNA, 201 bp, Homo sapiens
gaatctgtagatcaaagaggaaaccagataatgtcagacaagaggaatgtcatcctgttttctgtatttgatgagaaccgaagctggtacctcacagagawtatacaacgctttctccccaatccagctggagtgcagcttgaggatccagagttccaagcctccaacatcatgcacagcatcaatggctatgtttttgat

SEQ ID NO: 6203 - DNA, 201 bp, Homo sapiens
catcaacgggaaataactcgtactactcttcagtcagatcaagaggaaattgactatgatgataccatatcagttgaaatgaagaaggaagattttgacayttatgatgaggatgaaaatcagagcccccgcagctttcaaaagaaaacacgacactattttattgctgcagtggagaggctctgggattatgggatgagt

SEQ ID NO: 6204 - DNA, 201 bp, Homo sapiens
cagctggagtgcagcttgaggatccagagttccaagcctccaacatcatgcacagcatcaatggctatgtttttgatagtttgcagttgtcagtttgtttscatgaggtggcatactggtacattctaagcattggagcacagactgacttcctttctgtcttcttctctggatataccttcaaacacaaaatggtctatg

SEQ ID NO: 6205 - DNA, 201 bp, Homo sapiens
caacgggaaataactcgtactactcttcagtcagatcaagaggaaattgactatgatgataccatatcagttgaaatgaagaaggaagattttgacatttdtgatgaggatgaaaatcagagcccccgcagctttcaaaagaaaacacgacactattttattgctgcagtggagaggctctgggattatgggatgagtagc

SEQ ID NO: 6206 - DNA, 201 bp, Homo sapiens
tttgtttgcatgaggtggcatactggtacattctaagcattggagcacagactgacttcctttctgtcttcttctctggatataccttcaaacacaaaatsgtctatgaagacacactcaccctattcccattctcaggagaaactgtcttcatgtcgatggaaaacccaggtctatggattctggggtgccacaactcag

SEQ ID NO: 6207 - DNA, 201 bp, Homo sapiens
tactactcttcagtcagatcaagaggaaattgactatgatgataccatatcagttgaaatgaagaaggaagattttgacatttatgatgaggatgaaaatyagagcccccgcagctttcaaaagaaaacacgacactattttattgctgcagtggagaggctctgggattatgggatgagtagctccccacatgttctaag

SEQ ID NO: 6208 - DNA, 201 bp, Homo sapiens
tcagtcagatcaagaggaaattgactatgatgataccatatcagttgaaatgaagaaggaagattttgacatttatgatgaggatgaaaatcagagccccygcagctttcaaaagaaaacacgacactattttattgctgcagtggagaggctctgggattatgggatgagtagctccccacatgttctaagaaacagggc

SEQ ID NO: 6209 - DNA, 201 bp, Homo sapiens
cagtcagatcaagaggaaattgactatgatgataccatatcagttgaaatgaagaaggaagattttgacatttatgatgaggatgaaaatcagagcccccrcagctttcaaaagaaaacacgacactattttattgctgcagtggagaggctctgggattatgggatgagtagctccccacatgttctaagaaacagggct

SEQ ID NO: 6210 - DNA, 201 bp, Homo sapiens
tgactatgatgataccatatcagttgaaatgaagaaggaagattttgacatttatgatgaggatgaaaatcagagcccccgcagctttcaaaagaaaacabgacactattttattgctgcagtggagaggctctgggattatgggatgagtagctccccacatgttctaagaaacagggctcagagtggcagtgtccctca

SEQ ID NO: 6211 - DNA, 201 bp, Homo sapiens
tgaaatgaagaaggaagattttgacatttatgatgaggatgaaaatcagagcccccgcagctttcaaaagaaaacacgacactattttattgctgcagtgragaggctctgggattatgggatgagtagctccccacatgttctaagaaacagggctcagagtggcagtgtccctcagttcaagaaagttgttttccagga

SEQ ID NO: 6212 - DNA, 201 bp, Homo sapiens
ctcctcatctgctacaaagaatctgtagatcaaagaggaaaccagataatgtcagacaagaggaatgtcatcctgttttctgtatttgatgagaaccgaakctggtacctcacagagaatatacaacgctttctccccaatccagctggagtgcagcttgaggatccagagttccaagcctccaacatcatgcacagcatc

SEQ ID NO: 6213 - DNA, 201 bp, Homo sapiens
catcgctaagccaaggccaccctggatgggtctgctaggtcctaccatccaggctgaggtttatgatacagtggtcattacacttaagaacatggcttccyatcctgtcagtcttcatgctgttggtgtatcctactggaaagcttctgagggagctgaatatgatgatcagaccagtcaaagggagaaagaagatgataa

SEQ ID NO: 6214 - DNA, 201 bp, Homo sapiens
gtagaattcacggatcaccttttcaacatcgctaagccaaggccaccctggatgggtctgctaggtcctaccatccaggctgaggtttatgatacagtggwcattacacttaagaacatggcttcccatcctgtcagtcttcatgctgttggtgtatcctactggaaagcttctgagggagctgaatatgatgatcagacc

SEQ ID NO: 6215 - DNA, 201 bp, Homo sapiens
tcgggcctggcctaaaatgcacacagtcaatggttatgtaaacaggtctctgccaggtctgattggatgccacaggaaatcagtctattggcatgtgattrgaatgggcaccactcctgaagtgcactcaatattcctcgaaggtcacacatttcttgtgaggaaccatcgccaggcgtccttggaaatctcgccaataac

SEQ ID NO: 6216 - DNA, 201 bp, Homo sapiens
acagtcaatggttatgtaaacaggtctctgccaggtctgattggatgccacaggaaatcagtctattggcatgtgattggaatgggcaccactcctgaagkgcactcaatattcctcgaaggtcacacatttcttgtgaggaaccatcgccaggcgtccttggaaatctcgccaataactttccttactgctcaaacactc

SEQ ID NO: 6217 - DNA, 201 bp, Homo sapiens
aggaaattccactggaaccttaatggtcttctttggcaatgtggattcatctgggataaaacacaatatttttaaccctccaattattgctcgatacatcygtttgcacccaactcattatagcattcgcagcactcttcgcatggagttgatgggctgtgatttaaatagttgcagcatgccattgggaatggagagtaa

SEQ ID NO: 6218 - DNA, 201 bp, Homo sapiens
aaacaggtctctgccaggtctgattggatgccacaggaaatcagtctattggcatgtgattggaatgggcaccactcctgaagtgcactcaatattcctcdaaggtcacacatttcttgtgaggaaccatcgccaggcgtccttggaaatctcgccaataactttccttactgctcaaacactcttgatggaccttggaca

SEQ ID NO: 6219 - DNA, 201 bp, Homo sapiens
cttctttggcaatgtggattcatctgggataaaacacaatatttttaaccctccaattattgctcgatacatccgtttgcacccaactcattatagcattygcagcactcttcgcatggagttgatgggctgtgatttaaatagttgcagcatgccattgggaatggagagtaaagcaatatcagatgcacagattactgc

SEQ ID NO: 6220 - DNA, 201 bp, Homo sapiens
aacaggtctctgccaggtctgattggatgccacaggaaatcagtctattggcatgtgattggaatgggcaccactcctgaagtgcactcaatattcctcgraggtcacacatttcttgtgaggaaccatcgccaggcgtccttggaaatctcgccaataactttccttactgctcaaacactcttgatggaccttggacag

SEQ ID NO: 6221 - DNA, 201 bp, Homo sapiens
ttcgcatggagttgatgggctgtgatttaaatagttgcagcatgccattgggaatggagagtaaagcaatatcagatgcacagattactgcttcatcctaytttaccaatatgtttgccacctggtctccttcaaaagctcgacttcacctccaagggaggagtaatgcctggagacctcaggtgaataatccaaaagagt

SEQ ID NO: 6222 - DNA, 201 bp, Homo sapiens
atcaaagagaggttggctccctggggacaagtgccacaaattcagtcacatacaagaaagttgagaacactgttctcccgaaaccagacttgcccaaaacmtctggcaaagttgaattgcttccaaaagttcacatttatcagaaggacctattccctacggaaactagcaatgggtctcctggccatctggatctcgtgg

SEQ ID NO: 6223 - DNA, 201 bp, Homo sapiens
caagaaagcagtcatttcttacaaggagccaaaaaaaataacctttctttagccattctaaccttggagatgactggtgatcaaagagaggttggctcccyggggacaagtgccacaaattcagtcacatacaagaaagttgagaacactgttctcccgaaaccagacttgcccaaaacatctggcaaagttgaattgctt

SEQ ID NO: 6224 - DNA, 201 bp, Homo sapiens
tagaaggttcatatgagggggcatatgctccagtacttcaagattttaggtcattaaatgattcaacaaatagaacaaagaaacacacagctcatttctcmaaaaaaggggaggaagaaaacttggaaggcttgggaaatcaaaccaagcaaattgtagagaaatatgcatgcaccacaaggatatctcctaatacaagcc

SEQ ID NO: 6225 - DNA, 201 bp, Homo sapiens
cgaaaaaaagaggagtataaaatggcactgtacaatctctatccaggtgtttttgagacagtggaaatgttaccatccaaagctggaatttggcgggtggratgccttattggcgagcatctacatgctgggatgagcacactttttctggtgtacagcaataagtgtcagactcccctgggaatggcttctggacacatt

SEQ ID NO: 6226 - DNA, 201 bp, Homo sapiens
ctgccaggtctgattggatgccacaggaaatcagtctattggcatgtgattggaatgggcaccactcctgaagtgcactcaatattcctcgaaggtcacayatttcttgtgaggaaccatcgccaggcgtccttggaaatctcgccaataactttccttactgctcaaacactcttgatggaccttggacagtttctactg

SEQ ID NO: 6227 - DNA, 201 bp, Homo sapiens
ctgattggatgccacaggaaatcagtctattggcatgtgattggaatgggcaccactcctgaagtgcactcaatattcctcgaaggtcacacatttcttgygaggaaccatcgccaggcgtccttggaaatctcgccaataactttccttactgctcaaacactcttgatggaccttggacagtttctactgttttgtcat

SEQ ID NO: 6228 - DNA, 201 bp, Homo sapiens
ggatgccacaggaaatcagtctattggcatgtgattggaatgggcaccactcctgaagtgcactcaatattcctcgaaggtcacacatttcttgtgaggawccatcgccaggcgtccttggaaatctcgccaataactttccttactgctcaaacactcttgatggaccttggacagtttctactgttttgtcatatctct

SEQ ID NO: 6229 - DNA, 201 bp, Homo sapiens
ccacaggaaatcagtctattggcatgtgattggaatgggcaccactcctgaagtgcactcaatattcctcgaaggtcacacatttcttgtgaggaaccatygccaggcgtccttggaaatctcgccaataactttccttactgctcaaacactcttgatggaccttggacagtttctactgttttgtcatatctcttccca

SEQ ID NO: 6230 - DNA, 201 bp, Homo sapiens
cacaggaaatcagtctattggcatgtgattggaatgggcaccactcctgaagtgcactcaatattcctcgaaggtcacacatttcttgtgaggaaccatcdccaggcgtccttggaaatctcgccaataactttccttactgctcaaacactcttgatggaccttggacagtttctactgttttgtcatatctcttcccac

SEQ ID NO: 6231 - DNA, 201 bp, Homo sapiens
gaaatcagtctattggcatgtgattggaatgggcaccactcctgaagtgcactcaatattcctcgaaggtcacacatttcttgtgaggaaccatcgccagscgtccttggaaatctcgccaataactttccttactgctcaaacactcttgatggaccttggacagtttctactgttttgtcatatctcttcccaccaaca

SEQ ID NO: 6232 - DNA, 201 bp, Homo sapiens
aaatcagtctattggcatgtgattggaatgggcaccactcctgaagtgcactcaatattcctcgaaggtcacacatttcttgtgaggaaccatcgccaggmgtccttggaaatctcgccaataactttccttactgctcaaacactcttgatggaccttggacagtttctactgttttgtcatatctcttcccaccaacat

SEQ ID NO: 6233 - DNA, 201 bp, Homo sapiens
catgtgattggaatgggcaccactcctgaagtgcactcaatattcctcgaaggtcacacatttcttgtgaggaaccatcgccaggcgtccttggaaatctygccaataactttccttactgctcaaacactcttgatggaccttggacagtttctactgttttgtcatatctcttcccaccaacatgatggcatggaagct

SEQ ID NO: 6234 - DNA, 201 bp, Homo sapiens
tcttttccattcaacacctcagtcgtgtacaaaaagactctgtttgtagaattcacggatcaccttttcaacatcgctaagccaaggccaccctggatggrtctgctaggtcctaccatccaggctgaggtttatgatacagtggtcattacacttaagaacatggcttcccatcctgtcagtcttcatgctgttggtgta

SEQ ID NO: 6235 - DNA, 201 bp, Homo sapiens
atgggcaccactcctgaagtgcactcaatattcctcgaaggtcacacatttcttgtgaggaaccatcgccaggcgtccttggaaatctcgccaataacttyccttactgctcaaacactcttgatggaccttggacagtttctactgttttgtcatatctcttcccaccaacatgatggcatggaagcttatgtcaaagta

SEQ ID NO: 6236 - DNA, 201 bp, Homo sapiens
caggctgaggtttatgatacagtggtcattacacttaagaacatggcttcccatcctgtcagtcttcatgctgttggtgtatcctactggaaagcttctgwgggagctgaatatgatgatcagaccagtcaaagggagaaagaagatgataaagtcttccctggtggaagccatacatatgtctggcaggtcctgaaagag

SEQ ID NO: 6237 - DNA, 201 bp, Homo sapiens
actgtacgaaaaaaagaggagtataaaatggcactgtacaatctctatccaggtgtttttgagacagtggaaatgttaccatccaaagctggaatttggcsggtggaatgccttattggcgagcatctacatgctgggatgagcacactttttctggtgtacagcaataagtgtcagactcccctgggaatggcttctgga

SEQ ID NO: 6238 - DNA, 201 bp, Homo sapiens
caccactcctgaagtgcactcaatattcctcgaaggtcacacatttcttgtgaggaaccatcgccaggcgtccttggaaatctcgccaataactttccttrctgctcaaacactcttgatggaccttggacagtttctactgttttgtcatatctcttcccaccaacatgatggcatggaagcttatgtcaaagtagacag

SEQ ID NO: 6239 - DNA, 201 bp, Homo sapiens
ggctgaggtttatgatacagtggtcattacacttaagaacatggcttcccatcctgtcagtcttcatgctgttggtgtatcctactggaaagcttctgagsgagctgaatatgatgatcagaccagtcaaagggagaaagaagatgataaagtcttccctggtggaagccatacatatgtctggcaggtcctgaaagagaa

SEQ ID NO: 6240 - DNA, 201 bp, Homo sapiens
tttatgatacagtggtcattacacttaagaacatggcttcccatcctgtcagtcttcatgctgttggtgtatcctactggaaagcttctgagggagctgamtatgatgatcagaccagtcaaagggagaaagaagatgataaagtcttccctggtggaagccatacatatgtctggcaggtcctgaaagagaatggtccaa

SEQ ID NO: 6241 - DNA, 201 bp, Homo sapiens
tatgatacagtggtcattacacttaagaacatggcttcccatcctgtcagtcttcatgctgttggtgtatcctactggaaagcttctgagggagctgaatrtgatgatcagaccagtcaaagggagaaagaagatgataaagtcttccctggtggaagccatacatatgtctggcaggtcctgaaagagaatggtccaatg

SEQ ID NO: 6242 - DNA, 201 bp, Homo sapiens
acagtggtcattacacttaagaacatggcttcccatcctgtcagtcttcatgctgttggtgtatcctactggaaagcttctgagggagctgaatatgatgrtcagaccagtcaaagggagaaagaagatgataaagtcttccctggtggaagccatacatatgtctggcaggtcctgaaagagaatggtccaatggcctct

SEQ ID NO: 6243 - DNA, 201 bp, Homo sapiens
gtaatggctcaggatcaaaggattcgatggtatctgctcagcatgggcagcaatgaaaacatccattctattcatttcagtggacatgtgttcactgtacvaaaaaaagaggagtataaaatggcactgtacaatctctatccaggtgtttttgagacagtggaaatgttaccatccaaagctggaatttggcgggtggaa

SEQ ID NO: 6244 - DNA, 201 bp, Homo sapiens
aattatcgcttccatgcaatcaatggctacataatggatacactacctggcttagtaatggctcaggatcaaaggattcgatggtatctgctcagcatggrcagcaatgaaaacatccattctattcatttcagtggacatgtgttcactgtacgaaaaaaagaggagtataaaatggcactgtacaatctctatccaggt

SEQ ID NO: 6245 - DNA, 201 bp, Homo sapiens
gtctgccacactaacacactgaaccctgctcatgggagacaagtgacagtacaggaatttgctctgtttttcaccatctttgatgagaccaaaagctggtrcttcactgaaaatatggaaagaaactgcagggctccctgcaatatccagatggaagatcccacttttaaagagaattatcgcttccatgcaatcaatggc

SEQ ID NO: 6246 - DNA, 201 bp, Homo sapiens
tggactctcttttttcagaatggcaaagtaaaggtttttcagggaaatcaagactccttcacacctgtggtgaactctctagacccaccgttactgactcrctaccttcgaattcacccccagagttgggtgcaccagattgccctgaggatggaggttctgggctgcgaggcacaggacctctactgagggtggccactg

SEQ ID NO: 6247 - DNA, 201 bp, Homo sapiens
ttcaacacctcagtcgtgtacaaaaagactctgtttgtagaattcacggatcaccttttcaacatcgctaagccaaggccaccctggatgggtctgctagbtcctaccatccaggctgaggtttatgatacagtggtcattacacttaagaacatggcttcccatcctgtcagtcttcatgctgttggtgtatcctactgg

SEQ ID NO: 6248 - DNA, 201 bp, Homo sapiens
cctgtcagtcttcatgctgttggtgtatcctactggaaagcttctgagggagctgaatatgatgatcagaccagtcaaagggagaaagaagatgataaagwcttccctggtggaagccatacatatgtctggcaggtcctgaaagagaatggtccaatggcctctgacccactgtgccttacctactcatatctttctcat

SEQ ID NO: 6249 - DNA, 201 bp, Homo sapiens
gaggaggactgggactatgctcccttagtcctcgcccccgatgacagaagttataaaagtcaatatttgaacaatggccctcagcggattggtaggaagtrcaaaaaagtccgatttatggcatacacagatgaaacctttaagactcgtgaagctattcagcatgaatcaggaatcttgggacctttactttatggggaa

SEQ ID NO: 6250 - DNA, 201 bp, Homo sapiens
aatggccctcagcggattggtaggaagtacaaaaaagtccgatttatggcatacacagatgaaacctttaagactcgtgaagctattcagcatgaatcagraatcttgggacctttactttatggggaagttggagacacactgttgattatatttaagaatcaagcaagcagaccatataacatctaccctcacggaatc

SEQ ID NO: 6251 - DNA, 201 bp, Homo sapiens
accactcctgaagtgcactcaatattcctcgaaggtcacacatttcttgtgaggaaccatcgccaggcgtccttggaaatctcgccaataactttccttaytgctcaaacactcttgatggaccttggacagtttctactgttttgtcatatctcttcccaccaacatgatggcatggaagcttatgtcaaagtagacagc

SEQ ID NO: 6252 - DNA, 201 bp, Homo sapiens
actcctgaagtgcactcaatattcctcgaaggtcacacatttcttgtgaggaaccatcgccaggcgtccttggaaatctcgccaataactttccttactgytcaaacactcttgatggaccttggacagtttctactgttttgtcatatctcttcccaccaacatgatggcatggaagcttatgtcaaagtagacagctgt

SEQ ID NO: 6253 - DNA, 201 bp, Homo sapiens
tacagtggtcattacacttaagaacatggcttcccatcctgtcagtcttcatgctgttggtgtatcctactggaaagcttctgagggagctgaatatgatkatcagaccagtcaaagggagaaagaagatgataaagtcttccctggtggaagccatacatatgtctggcaggtcctgaaagagaatggtccaatggcctc

SEQ ID NO: 6254 - DNA, 201 bp, Homo sapiens
agtggtcattacacttaagaacatggcttcccatcctgtcagtcttcatgctgttggtgtatcctactggaaagcttctgagggagctgaatatgatgatyagaccagtcaaagggagaaagaagatgataaagtcttccctggtggaagccatacatatgtctggcaggtcctgaaagagaatggtccaatggcctctga

SEQ ID NO: 6255 - DNA, 201 bp, Homo sapiens
gatggccatcagtggactctcttttttcagaatggcaaagtaaaggtttttcagggaaatcaagactccttcacacctgtggtgaactctctagacccacygttactgactcgctaccttcgaattcacccccagagttgggtgcaccagattgccctgaggatggaggttctgggctgcgaggcacaggacctctactga

SEQ ID NO: 6256 - DNA, 201 bp, Homo sapiens
gtcattacacttaagaacatggcttcccatcctgtcagtcttcatgctgttggtgtatcctactggaaagcttctgagggagctgaatatgatgatcagaycagtcaaagggagaaagaagatgataaagtcttccctggtggaagccatacatatgtctggcaggtcctgaaagagaatggtccaatggcctctgaccca

SEQ ID NO: 6257 - DNA, 201 bp, Homo sapiens
agatggccatcagtggactctcttttttcagaatggcaaagtaaaggtttttcagggaaatcaagactccttcacacctgtggtgaactctctagacccaycgttactgactcgctaccttcgaattcacccccagagttgggtgcaccagattgccctgaggatggaggttctgggctgcgaggcacaggacctctactg

SEQ ID NO: 6258 - DNA, 201 bp, Homo sapiens
gtaaaagacttgaattcaggcctcattggagccctactagtatgtagagaagggagtctggccaaggaaaagacacagaccttgcacaaatttatactacwttttgctgtatttgatgaagggaaaagttggcactcagaaacaaagaactccttgatgcaggatagggatgctgcatctgctcgggcctggcctaaaatg

SEQ ID NO: 6259 - DNA, 201 bp, Homo sapiens
taaccttggagatgactggtgatcaaagagaggttggctccctggggacaagtgccacaaattcagtcacatacaagaaagttgagaacactgttctcccraaaccagacttgcccaaaacatctggcaaagttgaattgcttccaaaagttcacatttatcagaaggacctattccctacggaaactagcaatgggtctc

SEQ ID NO: 6260 - DNA, 201 bp, Homo sapiens
gacttgaattcaggcctcattggagccctactagtatgtagagaagggagtctggccaaggaaaagacacagaccttgcacaaatttatactactttttgmtgtatttgatgaagggaaaagttggcactcagaaacaaagaactccttgatgcaggatagggatgctgcatctgctcgggcctggcctaaaatgcacaca

SEQ ID NO: 6261 - DNA, 201 bp, Homo sapiens
aaataatgaagaagcggaagactatgatgatgatcttactgattctgaaatggatgtggtcaggtttgatgatgacaactctccttcctttatccaaattygctcagttgccaagaagcatcctaaaacttgggtacattacattgctgctgaagaggaggactgggactatgctcccttagtcctcgcccccgatgacag

SEQ ID NO: 6262 - DNA, 201 bp, Homo sapiens
agacttgaattcaggcctcattggagccctactagtatgtagagaagggagtctggccaaggaaaagacacagaccttgcacaaatttatactactttttrctgtatttgatgaagggaaaagttggcactcagaaacaaagaactccttgatgcaggatagggatgctgcatctgctcgggcctggcctaaaatgcacac

SEQ ID NO: 6263 - DNA, 201 bp, Homo sapiens
aataatgaagaagcggaagactatgatgatgatcttactgattctgaaatggatgtggtcaggtttgatgatgacaactctccttcctttatccaaattcvctcagttgccaagaagcatcctaaaacttgggtacattacattgctgctgaagaggaggactgggactatgctcccttagtcctcgcccccgatgacaga

SEQ ID NO: 6264 - DNA, 201 bp, Homo sapiens
ttgaattcaggcctcattggagccctactagtatgtagagaagggagtctggccaaggaaaagacacagaccttgcacaaatttatactactttttgctgkatttgatgaagggaaaagttggcactcagaaacaaagaactccttgatgcaggatagggatgctgcatctgctcgggcctggcctaaaatgcacacagtc

SEQ ID NO: 6265 - DNA, 201 bp, Homo sapiens
tcaggcctcattggagccctactagtatgtagagaagggagtctggccaaggaaaagacacagaccttgcacaaatttatactactttttgctgtatttgwtgaagggaaaagttggcactcagaaacaaagaactccttgatgcaggatagggatgctgcatctgctcgggcctggcctaaaatgcacacagtcaatggt

SEQ ID NO: 6266 - DNA, 201 bp, Homo sapiens
gcctcattggagccctactagtatgtagagaagggagtctggccaaggaaaagacacagaccttgcacaaatttatactactttttgctgtatttgatgawgggaaaagttggcactcagaaacaaagaactccttgatgcaggatagggatgctgcatctgctcgggcctggcctaaaatgcacacagtcaatggttatg

SEQ ID NO: 6267 - DNA, 201 bp, Homo sapiens
actggaaccttaatggtcttctttggcaatgtggattcatctgggataaaacacaatatttttaaccctccaattattgctcgatacatccgtttgcaccvaactcattatagcattcgcagcactcttcgcatggagttgatgggctgtgatttaaatagttgcagcatgccattgggaatggagagtaaagcaatatca

SEQ ID NO: 6268 - DNA, 201 bp, Homo sapiens
tgagtctggtggacctctgagcttgagtgaagaaaataatgattcaaagttgttagaatcaggtttaatgaatagccaagaaagttcatggggaaaaaatrtatcgtcaacagagagtggtaggttatttaaagggaaaagagctcatggacctgctttgttgactaaagataatgccttattcaaagttagcatctcttt

SEQ ID NO: 6269 - DNA, 201 bp, Homo sapiens
aggcctcattggagccctactagtatgtagagaagggagtctggccaaggaaaagacacagaccttgcacaaatttatactactttttgctgtatttgatraagggaaaagttggcactcagaaacaaagaactccttgatgcaggatagggatgctgcatctgctcgggcctggcctaaaatgcacacagtcaatggtta

SEQ ID NO: 6270 - DNA, 201 bp, Homo sapiens
tttgggactcctggggccatatataagagcagaagttgaagataatatcatggtaactttcagaaatcaggcctctcgtccctattccttctattctagcyttatttcttatgaggaagatcagaggcaaggagcagaacctagaaaaaactttgtcaagcctaatgaaaccaaaacttacttttggaaagtgcaacatca

SEQ ID NO: 6271 - DNA, 201 bp, Homo sapiens
aaagtccgatttatggcatacacagatgaaacctttaagactcgtgaagctattcagcatgaatcaggaatcttgggacctttactttatggggaagttgkagacacactgttgattatatttaagaatcaagcaagcagaccatataacatctaccctcacggaatcactgatgtccgtcctttgtattcaaggagatta

SEQ ID NO: 6272 - DNA, 201 bp, Homo sapiens
agagtggcagtgtccctcagttcaagaaagttgttttccaggaatttactgatggctcctttactcagcccttataccgtggagaactaaatgaacatttsggactcctggggccatatataagagcagaagttgaagataatatcatggtaactttcagaaatcaggcctctcgtccctattccttctattctagcctta

SEQ ID NO: 6273 - DNA, 201 bp, Homo sapiens
aatcactgatgtccgtcctttgtattcaaggagattaccaaaaggtgtaaaacatttgaaggattttccaattctgccaggagaaatattcaaatataaakggacagtgactgtagaagatgggccaactaaatcagatcctcggtgcctgacccgctattactctagtttcgttaatatggagagagatctagcttcagg

SEQ ID NO: 6274 - DNA, 201 bp, Homo sapiens
ctaaaatacaaaatgtctcctctagtgatttgttgatgctcttgcgacagagtcctactccacatgggctatccttatctgatctccaagaagccaaatakgagactttttctgatgatccatcacctggagcaatagacagtaataacagcctgtctgaaatgacacacttcaggccacagctccatcacagtggggaca

SEQ ID NO: 6275 - DNA, 201 bp, Homo sapiens
taataacagcctgtctgaaatgacacacttcaggccacagctccatcacagtggggacatggtatttacccctgagtcaggcctccaattaagattaaatkagaaactggggacaactgcagcaacagagttgaagaaacttgatttcaaagtttctagtacatcaaataatctgatttcaacaattccatcagacaattt

SEQ ID NO: 6276 - DNA, 201 bp, Homo sapiens
gaagaaacttgatttcaaagtttctagtacatcaaataatctgatttcaacaattccatcagacaatttggcagcaggtactgataatacaagttccttakgacccccaagtatgccagttcattatgatagtcaattagataccactctatttggcaaaaagtcatctccccttactgagtctggtggacctctgagctt

SEQ ID NO: 6277 - DNA, 201 bp, Homo sapiens
ttatgatagtcaattagataccactctatttggcaaaaagtcatctccccttactgagtctggtggacctctgagcttgagtgaagaaaataatgattcawagttgttagaatcaggtttaatgaatagccaagaaagttcatggggaaaaaatgtatcgtcaacagagagtggtaggttatttaaagggaaaagagctca

SEQ ID NO: 6278 - DNA, 201 bp, Homo sapiens
ggtagtaggaaagggtgaatttacaaaggacgtaggactcaaagagatggtttttccaagcagcagaaacctatttcttactaacttggataatttacatkaaaataatacacacaatcaagaaaaaaaaattcaggaagaaatagaaaagaaggaaacattaatccaagagaatgtagttttgcctcagatacatacagt

SEQ ID NO: 6279 - DNA, 201 bp, Homo sapiens
aaccaagcaaattgtagagaaatatgcatgcaccacaaggatatctcctaatacaagccagcagaattttgtcacgcaacgtagtaagagagctttgaaamaattcagactcccactagaagaaacagaacttgaaaaaaggataattgtggatgacacctcaacccagtggtccaaaaacatgaaacatttgaccccgag

SEQ ID NO: 6280 - DNA, 201 bp, Homo sapiens
ttttgtcacgcaacgtagtaagagagctttgaaacaattcagactcccactagaagaaacagaacttgaaaaaaggataattgtggatgacacctcaaccyagtggtccaaaaacatgaaacatttgaccccgagcaccctcacacagatagactacaatgagaaggagaaaggggccattactcagtctcccttatcaga

SEQ ID NO: 6281 - DNA, 201 bp, Homo sapiens
aaagaaagattctggggtccaagaaagcagtcatttcttacaaggagccaaaaaaaataacctttctttagccattctaaccttggagatgactggtgatyaaagagaggttggctccctggggacaagtgccacaaattcagtcacatacaagaaagttgagaacactgttctcccgaaaccagacttgcccaaaacatc

SEQ ID NO: 6282 - DNA, 201 bp, Homo sapiens
ttctttggcaatgtggattcatctgggataaaacacaatatttttaaccctccaattattgctcgatacatccgtttgcacccaactcattatagcattcdcagcactcttcgcatggagttgatgggctgtgatttaaatagttgcagcatgccattgggaatggagagtaaagcaatatcagatgcacagattactgct

SEQ ID NO: 6283 - DNA, 201 bp, Homo sapiens
taatgaagaagcggaagactatgatgatgatcttactgattctgaaatggatgtggtcaggtttgatgatgacaactctccttcctttatccaaattcgcycagttgccaagaagcatcctaaaacttgggtacattacattgctgctgaagaggaggactgggactatgctcccttagtcctcgcccccgatgacagaag

SEQ ID NO: 6284 - DNA, 201 bp, Homo sapiens
aatgaagaagcggaagactatgatgatgatcttactgattctgaaatggatgtggtcaggtttgatgatgacaactctccttcctttatccaaattcgcthagttgccaagaagcatcctaaaacttgggtacattacattgctgctgaagaggaggactgggactatgctcccttagtcctcgcccccgatgacagaagt

SEQ ID NO: 6285 - DNA, 201 bp, Homo sapiens
ttctgaaatggatgtggtcaggtttgatgatgacaactctccttcctttatccaaattcgctcagttgccaagaagcatcctaaaacttgggtacattacwttgctgctgaagaggaggactgggactatgctcccttagtcctcgcccccgatgacagaagttataaaagtcaatatttgaacaatggccctcagcggat

SEQ ID NO: 6286 - DNA, 201 bp, Homo sapiens
ctactagtatgtagagaagggagtctggccaaggaaaagacacagaccttgcacaaatttatactactttttgctgtatttgatgaagggaaaagttggcrctcagaaacaaagaactccttgatgcaggatagggatgctgcatctgctcgggcctggcctaaaatgcacacagtcaatggttatgtaaacaggtctctg

SEQ ID NO: 6287 - DNA, 201 bp, Homo sapiens
aggaaccatcgccaggcgtccttggaaatctcgccaataactttccttactgctcaaacactcttgatggaccttggacagtttctactgttttgtcatakctcttcccaccaacatgatggcatggaagcttatgtcaaagtagacagctgtccagaggaaccccaactacgaatgaaaaataatgaagaagcggaagac

SEQ ID NO: 6288 - DNA, 201 bp, Homo sapiens
gaaatctcgccaataactttccttactgctcaaacactcttgatggaccttggacagtttctactgttttgtcatatctcttcccaccaacatgatggcayggaagcttatgtcaaagtagacagctgtccagaggaaccccaactacgaatgaaaaataatgaagaagcggaagactatgatgatgatcttactgattct

SEQ ID NO: 6289 - DNA, 201 bp, Homo sapiens
aatctcgccaataactttccttactgctcaaacactcttgatggaccttggacagtttctactgttttgtcatatctcttcccaccaacatgatggcatgraagcttatgtcaaagtagacagctgtccagaggaaccccaactacgaatgaaaaataatgaagaagcggaagactatgatgatgatcttactgattctga

SEQ ID NO: 6290 - DNA, 201 bp, Homo sapiens
ttacattgctgctgaagaggaggactgggactatgctcccttagtcctcgcccccgatgacagaagttataaaagtcaatatttgaacaatggccctcagyggattggtaggaagtacaaaaaagtccgatttatggcatacacagatgaaacctttaagactcgtgaagctattcagcatgaatcaggaatcttgggacc

SEQ ID NO: 6291 - DNA, 201 bp, Homo sapiens
gactgggactatgctcccttagtcctcgcccccgatgacagaagttataaaagtcaatatttgaacaatggccctcagcggattggtaggaagtacaaaaragtccgatttatggcatacacagatgaaacctttaagactcgtgaagctattcagcatgaatcaggaatcttgggacctttactttatggggaagttgga

SEQ ID NO: 6292 - DNA, 201 bp, Homo sapiens
caataactttccttactgctcaaacactcttgatggaccttggacagtttctactgttttgtcatatctcttcccaccaacatgatggcatggaagcttawgtcaaagtagacagctgtccagaggaaccccaactacgaatgaaaaataatgaagaagcggaagactatgatgatgatcttactgattctgaaatggatg

SEQ ID NO: 6293 - DNA, 201 bp, Homo sapiens
gccaagaagcatcctaaaacttgggtacattacattgctgctgaagaggaggactgggactatgctcccttagtcctcgcccccgatgacagaagttatawaagtcaatatttgaacaatggccctcagcggattggtaggaagtacaaaaaagtccgatttatggcatacacagatgaaacctttaagactcgtgaagct

SEQ ID NO: 6294 - DNA, 201 bp, Homo sapiens
ggactatgctcccttagtcctcgcccccgatgacagaagttataaaagtcaatatttgaacaatggccctcagcggattggtaggaagtacaaaaaagtcygatttatggcatacacagatgaaacctttaagactcgtgaagctattcagcatgaatcaggaatcttgggacctttactttatggggaagttggagacac

SEQ ID NO: 6295 - DNA, 201 bp, Homo sapiens
cctaaaacttgggtacattacattgctgctgaagaggaggactgggactatgctcccttagtcctcgcccccgatgacagaagttataaaagtcaatattygaacaatggccctcagcggattggtaggaagtacaaaaaagtccgatttatggcatacacagatgaaacctttaagactcgtgaagctattcagcatgaa

SEQ ID NO: 6296 - DNA, 201 bp, Homo sapiens
cttagtcctcgcccccgatgacagaagttataaaagtcaatatttgaacaatggccctcagcggattggtaggaagtacaaaaaagtccgatttatggcawacacagatgaaacctttaagactcgtgaagctattcagcatgaatcaggaatcttgggacctttactttatggggaagttggagacacactgttgattat

SEQ ID NO: 6297 - DNA, 201 bp, Homo sapiens
tcagagtggcagtgtccctcagttcaagaaagttgttttccaggaatttactgatggctcctttactcagcccttataccgtggagaactaaatgaacatktgggactcctggggccatatataagagcagaagttgaagataatatcatggtaactttcagaaatcaggcctctcgtccctattccttctattctagcct

SEQ ID NO: 6298 - DNA, 201 bp, Homo sapiens
agtccgatttatggcatacacagatgaaacctttaagactcgtgaagctattcagcatgaatcaggaatcttgggacctttactttatggggaagttggaracacactgttgattatatttaagaatcaagcaagcagaccatataacatctaccctcacggaatcactgatgtccgtcctttgtattcaaggagattacc

SEQ ID NO: 6299 - DNA, 201 bp, Homo sapiens
agaaacagggctcagagtggcagtgtccctcagttcaagaaagttgttttccaggaatttactgatggctcctttactcagcccttataccgtggagaacyaaatgaacatttgggactcctggggccatatataagagcagaagttgaagataatatcatggtaactttcagaaatcaggcctctcgtccctattccttc

SEQ ID NO: 6300 - DNA, 201 bp, Homo sapiens
acagatgaaacctttaagactcgtgaagctattcagcatgaatcaggaatcttgggacctttactttatggggaagttggagacacactgttgattatatktaagaatcaagcaagcagaccatataacatctaccctcacggaatcactgatgtccgtcctttgtattcaaggagattaccaaaaggtgtaaaacatttg

SEQ ID NO: 6301 - DNA, 201 bp, Homo sapiens
catgttctaagaaacagggctcagagtggcagtgtccctcagttcaagaaagttgttttccaggaatttactgatggctcctttactcagcccttataccrtggagaactaaatgaacatttgggactcctggggccatatataagagcagaagttgaagataatatcatggtaactttcagaaatcaggcctctcgtccc

SEQ ID NO: 6302 - DNA, 201 bp, Homo sapiens
gatgaaacctttaagactcgtgaagctattcagcatgaatcaggaatcttgggacctttactttatggggaagttggagacacactgttgattatatttamgaatcaagcaagcagaccatataacatctaccctcacggaatcactgatgtccgtcctttgtattcaaggagattaccaaaaggtgtaaaacatttgaag

SEQ ID NO: 6303 - DNA, 201 bp, Homo sapiens
aaggaagattttgacatttatgatgaggatgaaaatcagagcccccgcagctttcaaaagaaaacacgacactattttattgctgcagtggagaggctctrggattatgggatgagtagctccccacatgttctaagaaacagggctcagagtggcagtgtccctcagttcaagaaagttgttttccaggaatttactgat

SEQ ID NO: 6304 - DNA, 201 bp, Homo sapiens
cagatcaagaggaaattgactatgatgataccatatcagttgaaatgaagaaggaagattttgacatttatgatgaggatgaaaatcagagcccccgcagmtttcaaaagaaaacacgacactattttattgctgcagtggagaggctctgggattatgggatgagtagctccccacatgttctaagaaacagggctcaga

SEQ ID NO: 6305 - DNA, 201 bp, Homo sapiens
atcccaagagaagtcaccagaaaaaacagcttttaagaaaaaggataccattttgtccctgaacgcttgtgaaagcaatcatgcaatagcagcaataaatkagggacaaaataagcccgaaatagaagtcacctgggcaaagcaaggtaggactgaaaggctgtgctctcaaaacccaccagtcttgaaacgccatcaacg

SEQ ID NO: 6306 - DNA, 201 bp, Homo sapiens
ttctgagagtagcaacagaaagctctgcaaagactccctccaagctattggatcctcttgcttgggataaccactatggtactcagataccaaaagaagaktggaaatcccaagagaagtcaccagaaaaaacagcttttaagaaaaaggataccattttgtccctgaacgcttgtgaaagcaatcatgcaatagcagcaa

SEQ ID NO: 6307 - DNA, 201 bp, Homo sapiens
aattgactatgatgataccatatcagttgaaatgaagaaggaagattttgacatttatgatgaggatgaaaatcagagcccccgcagctttcaaaagaaawcacgacactattttattgctgcagtggagaggctctgggattatgggatgagtagctccccacatgttctaagaaacagggctcagagtggcagtgtccc

SEQ ID NO: 6308 - DNA, 201 bp, Homo sapiens
agtggaatgaagcaaacagacctggaaaagttccctttctgagagtagcaacagaaagctctgcaaagactccctccaagctattggatcctcttgcttgrgataaccactatggtactcagataccaaaagaagagtggaaatcccaagagaagtcaccagaaaaaacagcttttaagaaaaaggataccattttgtccc

SEQ ID NO: 6309 - DNA, 201 bp, Homo sapiens
ggcagtgtccctcagttcaagaaagttgttttccaggaatttactgatggctcctttactcagcccttataccgtggagaactaaatgaacatttgggacycctggggccatatataagagcagaagttgaagataatatcatggtaactttcagaaatcaggcctctcgtccctattccttctattctagccttatttct

SEQ ID NO: 6310 - DNA, 201 bp, Homo sapiens
aagtggaatgaagcaaacagacctggaaaagttccctttctgagagtagcaacagaaagctctgcaaagactccctccaagctattggatcctcttgcttrggataaccactatggtactcagataccaaaagaagagtggaaatcccaagagaagtcaccagaaaaaacagcttttaagaaaaaggataccattttgtcc

SEQ ID NO: 6311 - DNA, 201 bp, Homo sapiens
acccactaaagatgagtttgactgcaaagcctgggcttatttctctgatgttgacctggaaaaagatgtgcactcaggcctgattggaccccttctggtcygccacactaacacactgaaccctgctcatgggagacaagtgacagtacaggaatttgctctgtttttcaccatctttgatgagaccaaaagctggtactt

SEQ ID NO: 6312 - DNA, 201 bp, Homo sapiens
tgaaaatatggaaagaaactgcagggctccctgcaatatccagatggaagatcccacttttaaagagaattatcgcttccatgcaatcaatggctacatartggatacactacctggcttagtaatggctcaggatcaaaggattcgatggtatctgctcagcatgggcagcaatgaaaacatccattctattcatttcag

SEQ ID NO: 6313 - DNA, 201 bp, Homo sapiens
aaagagaattatcgcttccatgcaatcaatggctacataatggatacactacctggcttagtaatggctcaggatcaaaggattcgatggtatctgctcakcatgggcagcaatgaaaacatccattctattcatttcagtggacatgtgttcactgtacgaaaaaaagaggagtataaaatggcactgtacaatctctat

SEQ ID NO: 6314 - DNA, 201 bp, Homo sapiens
aacatccattctattcatttcagtggacatgtgttcactgtacgaaaaaaagaggagtataaaatggcactgtacaatctctatccaggtgtttttgagasagtggaaatgttaccatccaaagctggaatttggcgggtggaatgccttattggcgagcatctacatgctgggatgagcacactttttctggtgtacagc

SEQ ID NO: 6315 - DNA, 201 bp, Homo sapiens
caagggaggagtaatgcctggagacctcaggtgaataatccaaaagagtggctgcaagtggacttccagaagacaatgaaagtcacaggagtaactactcrgggagtaaaatctctgcttaccagcatgtatgtgaaggagttcctcatctccagcagtcaagatggccatcagtggactctcttttttcagaatggcaaa

SEQ ID NO: 6316 - DNA, 201 bp, Homo sapiens
tctgggataaaacacaatatttttaaccctccaattattgctcgatacatccgtttgcacccaactcattatagcattcgcagcactcttcgcatggagtbgatgggctgtgatttaaatagttgcagcatgccattgggaatggagagtaaagcaatatcagatgcacagattactgcttcatcctactttaccaatatg

SEQ ID NO: 6317 - DNA, 201 bp, Homo sapiens
tttaagactcgtgaagctattcagcatgaatcaggaatcttgggacctttactttatggggaagttggagacacactgttgattatatttaagaatcaagbaagcagaccatataacatctaccctcacggaatcactgatgtccgtcctttgtattcaaggagattaccaaaaggtgtaaaacatttgaaggattttcca

SEQ ID NO: 6318 - DNA, 201 bp, Homo sapiens
aatagttgcagcatgccattgggaatggagagtaaagcaatatcagatgcacagattactgcttcatcctactttaccaatatgtttgccacctggtctcyttcaaaagctcgacttcacctccaagggaggagtaatgcctggagacctcaggtgaataatccaaaagagtggctgcaagtggacttccagaagacaatg

SEQ ID NO: 6319 - DNA, 201 bp, Homo sapiens
actgttgattatatttaagaatcaagcaagcagaccatataacatctaccctcacggaatcactgatgtccgtcctttgtattcaaggagattaccaaaargtgtaaaacatttgaaggattttccaattctgccaggagaaatattcaaatataaatggacagtgactgtagaagatgggccaactaaatcagatcctcg

SEQ ID NO: 6320 - DNA, 201 bp, Homo sapiens
ctctcttttttcagaatggcaaagtaaaggtttttcagggaaatcaagactccttcacacctgtggtgaactctctagacccaccgttactgactcgctascttcgaattcacccccagagttgggtgcaccagattgccctgaggatggaggttctgggctgcgaggcacaggacctctactgagggtggccactgcagc

SEQ ID NO: 6321 - DNA, 201 bp, Homo sapiens
gatcctcggtgcctgacccgctattactctagtttcgttaatatggagagagatctagcttcaggactcattggccctctcctcatctgctacaaagaatytgtagatcaaagaggaaaccagataatgtcagacaagaggaatgtcatcctgttttctgtatttgatgagaaccgaagctggtacctcacagagaatata

SEQ ID NO: 6322 - DNA, 201 bp, Homo sapiens
gtggtgaactctctagacccaccgttactgactcgctaccttcgaattcacccccagagttgggtgcaccagattgccctgaggatggaggttctgggctrcgaggcacaggacctctactgagggtggccactgcagcacctgccactgccgtcacctctccctcctcagctccagggcagtgtccctccctggcttgcc

SEQ ID NO: 6323 - DNA, 201 bp, Homo sapiens
cctcggtgcctgacccgctattactctagtttcgttaatatggagagagatctagcttcaggactcattggccctctcctcatctgctacaaagaatctgyagatcaaagaggaaaccagataatgtcagacaagaggaatgtcatcctgttttctgtatttgatgagaaccgaagctggtacctcacagagaatatacaa

SEQ ID NO: 6324 - DNA, 201 bp, Homo sapiens
ttgtttgcatgaggtggcatactggtacattctaagcattggagcacagactgacttcctttctgtcttcttctctggatataccttcaaacacaaaatgktctatgaagacacactcaccctattcccattctcaggagaaactgtcttcatgtcgatggaaaacccaggtctatggattctggggtgccacaactcaga

SEQ ID NO: 6325 - DNA, 201 bp, Homo sapiens
cggtgcctgacccgctattactctagtttcgttaatatggagagagatctagcttcaggactcattggccctctcctcatctgctacaaagaatctgtagmtcaaagaggaaaccagataatgtcagacaagaggaatgtcatcctgttttctgtatttgatgagaaccgaagctggtacctcacagagaatatacaacgc

SEQ ID NO: 6326 - DNA, 201 bp, Homo sapiens
tcggtgcctgacccgctattactctagtttcgttaatatggagagagatctagcttcaggactcattggccctctcctcatctgctacaaagaatctgtasatcaaagaggaaaccagataatgtcagacaagaggaatgtcatcctgttttctgtatttgatgagaaccgaagctggtacctcacagagaatatacaacg

SEQ ID NO: 6327 - DNA, 201 bp, Homo sapiens
cgctattactctagtttcgttaatatggagagagatctagcttcaggactcattggccctctcctcatctgctacaaagaatctgtagatcaaagaggaarccagataatgtcagacaagaggaatgtcatcctgttttctgtatttgatgagaaccgaagctggtacctcacagagaatatacaacgctttctccccaat

SEQ ID NO: 6328 - DNA, 201 bp, Homo sapiens
tattactctagtttcgttaatatggagagagatctagcttcaggactcattggccctctcctcatctgctacaaagaatctgtagatcaaagaggaaaccrgataatgtcagacaagaggaatgtcatcctgttttctgtatttgatgagaaccgaagctggtacctcacagagaatatacaacgctttctccccaatcca

SEQ ID NO: 6329 - DNA, 201 bp, Homo sapiens
attactctagtttcgttaatatggagagagatctagcttcaggactcattggccctctcctcatctgctacaaagaatctgtagatcaaagaggaaaccakataatgtcagacaagaggaatgtcatcctgttttctgtatttgatgagaaccgaagctggtacctcacagagaatatacaacgctttctccccaatccag

SEQ ID NO: 6330 - DNA, 201 bp, Homo sapiens
cccgatgacagaagttataaaagtcaatatttgaacaatggccctcagcggattggtaggaagtacaaaaaagtccgatttatggcatacacagatgaaayctttaagactcgtgaagctattcagcatgaatcaggaatcttgggacctttactttatggggaagttggagacacactgttgattatatttaagaatcaa

SEQ ID NO: 6331 - DNA, 201 bp, Homo sapiens
ctattactctagtttcgttaatatggagagagatctagcttcaggactcattggccctctcctcatctgctacaaagaatctgtagatcaaagaggaaacmagataatgtcagacaagaggaatgtcatcctgttttctgtatttgatgagaaccgaagctggtacctcacagagaatatacaacgctttctccccaatcc

SEQ ID NO: 6332 - DNA, 201 bp, Homo sapiens
tggaaccttaatggtcttctttggcaatgtggattcatctgggataaaacacaatatttttaaccctccaattattgctcgatacatccgtttgcacccarctcattatagcattcgcagcactcttcgcatggagttgatgggctgtgatttaaatagttgcagcatgccattgggaatggagagtaaagcaatatcaga

SEQ ID NO: 6333 - DNA, 201 bp, Homo sapiens
tataagagcagaagttgaagataatatcatggtaactttcagaaatcaggcctctcgtccctattccttctattctagccttatttcttatgaggaagatyagaggcaaggagcagaacctagaaaaaactttgtcaagcctaatgaaaccaaaacttacttttggaaagtgcaacatcatatggcacccactaaagatga

SEQ ID NO: 6334 - DNA, 201 bp, Homo sapiens
tttcttatgaggaagatcagaggcaaggagcagaacctagaaaaaactttgtcaagcctaatgaaaccaaaacttacttttggaaagtgcaacatcatatrgcacccactaaagatgagtttgactgcaaagcctgggcttatttctctgatgttgacctggaaaaagatgtgcactcaggcctgattggaccccttctgg

SEQ ID NO: 6335 - DNA, 201 bp, Homo sapiens
ttatgaggaagatcagaggcaaggagcagaacctagaaaaaactttgtcaagcctaatgaaaccaaaacttacttttggaaagtgcaacatcatatggcayccactaaagatgagtttgactgcaaagcctgggcttatttctctgatgttgacctggaaaaagatgtgcactcaggcctgattggaccccttctggtctg

SEQ ID NO: 6336 - DNA, 201 bp, Homo sapiens
tgaggaagatcagaggcaaggagcagaacctagaaaaaactttgtcaagcctaatgaaaccaaaacttacttttggaaagtgcaacatcatatggcacccmctaaagatgagtttgactgcaaagcctgggcttatttctctgatgttgacctggaaaaagatgtgcactcaggcctgattggaccccttctggtctgcca

SEQ ID NO: 6337 - DNA, 201 bp, Homo sapiens
ggaagatcagaggcaaggagcagaacctagaaaaaactttgtcaagcctaatgaaaccaaaacttacttttggaaagtgcaacatcatatggcacccactwaagatgagtttgactgcaaagcctgggcttatttctctgatgttgacctggaaaaagatgtgcactcaggcctgattggaccccttctggtctgccacac

SEQ ID NO: 6338 - DNA, 201 bp, Homo sapiens
tattccaagacaactcttctcatcttccagcagcatcttatagaaagaaagattctggggtccaagaaagcagtcatttcttacaaggagccaaaaaaaawaacctttctttagccattctaaccttggagatgactggtgatcaaagagaggttggctccctggggacaagtgccacaaattcagtcacatacaagaaag

SEQ ID NO: 6339 - DNA, 201 bp, Homo sapiens
tgattcaacaaatagaacaaagaaacacacagctcatttctcaaaaaaaggggaggaagaaaacttggaaggcttgggaaatcaaaccaagcaaattgtakagaaatatgcatgcaccacaaggatatctcctaatacaagccagcagaattttgtcacgcaacgtagtaagagagctttgaaacaattcagactcccact

SEQ ID NO: 6340 - DNA, 201 bp, Homo sapiens
atgaagaaccttttcttactgagcactaggcaaaatgtagaaggttcatatgagggggcatatgctccagtacttcaagattttaggtcattaaatgattsaacaaatagaacaaagaaacacacagctcatttctcaaaaaaaggggaggaagaaaacttggaaggcttgggaaatcaaaccaagcaaattgtagagaaa

SEQ ID NO: 6341 - DNA, 201 bp, Homo sapiens
tggtacattctaagcattggagcacagactgacttcctttctgtcttcttctctggatataccttcaaacacaaaatggtctatgaagacacactcaccckattcccattctcaggagaaactgtcttcatgtcgatggaaaacccaggtctatggattctggggtgccacaactcagactttcggaacagaggcatgacc

SEQ ID NO: 6342 - DNA, 201 bp, Homo sapiens
tcatggaaagaactctctgaactctgggcaaggccccagtccaaagcaattagtatccttaggaccagaaaaatctgtggaaggtcagaatttcttgtctkagaaaaacaaagtggtagtaggaaagggtgaatttacaaaggacgtaggactcaaagagatggtttttccaagcagcagaaacctatttcttactaactt

SEQ ID NO: 6343 - DNA, 201 bp, Homo sapiens
gtggcatactggtacattctaagcattggagcacagactgacttcctttctgtcttcttctctggatataccttcaaacacaaaatggtctatgaagacasactcaccctattcccattctcaggagaaactgtcttcatgtcgatggaaaacccaggtctatggattctggggtgccacaactcagactttcggaacaga

SEQ ID NO: 6344 - DNA, 201 bp, Homo sapiens
ttgcatgaggtggcatactggtacattctaagcattggagcacagactgacttcctttctgtcttcttctctggatataccttcaaacacaaaatggtctrtgaagacacactcaccctattcccattctcaggagaaactgtcttcatgtcgatggaaaacccaggtctatggattctggggtgccacaactcagacttt

SEQ ID NO: 6345 - DNA, 201 bp, Homo sapiens
caataattcagcaactaatagaaagactcacattgatggcccatcattattaattgagaatagtccatcagtctggcaaaatatattagaaagtgacactragtttaaaaaagtgacacctttgattcatgacagaatgcttatggacaaaaatgctacagctttgaggctaaatcatatgtcaaataaaactacttcatc

SEQ ID NO: 6346 - DNA, 201 bp, Homo sapiens
tttgcatgaggtggcatactggtacattctaagcattggagcacagactgacttcctttctgtcttcttctctggatataccttcaaacacaaaatggtcwatgaagacacactcaccctattcccattctcaggagaaactgtcttcatgtcgatggaaaacccaggtctatggattctggggtgccacaactcagactt

SEQ ID NO: 6347 - DNA, 201 bp, Homo sapiens
atggggaaaaaatgtatcgtcaacagagagtggtaggttatttaaagggaaaagagctcatggacctgctttgttgactaaagataatgccttattcaaasttagcatctctttgttaaagacaaacaaaacttccaataattcagcaactaatagaaagactcacattgatggcccatcattattaattgagaatagtcc

SEQ ID NO: 6348 - DNA, 201 bp, Homo sapiens
gcagcaggtactgataatacaagttccttaggacccccaagtatgccagttcattatgatagtcaattagataccactctatttggcaaaaagtcatctcsccttactgagtctggtggacctctgagcttgagtgaagaaaataatgattcaaagttgttagaatcaggtttaatgaatagccaagaaagttcatgggga

SEQ ID NO: 6349 - DNA, 201 bp, Homo sapiens
tttgcagttgtcagtttgtttgcatgaggtggcatactggtacattctaagcattggagcacagactgacttcctttctgtcttcttctctggatataccytcaaacacaaaatggtctatgaagacacactcaccctattcccattctcaggagaaactgtcttcatgtcgatggaaaacccaggtctatggattctggg

SEQ ID NO: 6350 - DNA, 201 bp, Homo sapiens
ccatcacctggagcaatagacagtaataacagcctgtctgaaatgacacacttcaggccacagctccatcacagtggggacatggtatttacccctgagtsaggcctccaattaagattaaatgagaaactggggacaactgcagcaacagagttgaagaaacttgatttcaaagtttctagtacatcaaataatctgatt

SEQ ID NO: 6351 - DNA, 201 bp, Homo sapiens
tccagaaaatgacatagagaagactgacccttggtttgcacacagaacacctatgcctaaaatacaaaatgtctcctctagtgatttgttgatgctcttgygacagagtcctactccacatgggctatccttatctgatctccaagaagccaaatatgagactttttctgatgatccatcacctggagcaatagacagtaa

SEQ ID NO: 6352 - DNA, 201 bp, Homo sapiens
actttcggaacagaggcatgaccgccttactgaaggtttctagttgtgacaagaacactggtgattattacgaggacagttatgaagatatttcagcatamttgctgagtaaaaacaatgccattgaaccaagaagcttctcccagaattcaagacaccctagcactaggcaaaagcaatttaatgccaccacaattccag

SEQ ID NO: 6353 - DNA, 201 bp, Homo sapiens
gatttaaatagttgcagcatgccattgggaatggagagtaaagcaatatcagatgcacagattactgcttcatcctactttaccaatatgtttgccacctrgtctccttcaaaagctcgacttcacctccaagggaggagtaatgcctggagacctcaggtgaataatccaaaagagtggctgcaagtggacttccagaag

SEQ ID NO: 6354 - DNA, 201 bp, Homo sapiens
tactctagtttcgttaatatggagagagatctagcttcaggactcattggccctctcctcatctgctacaaagaatctgtagatcaaagaggaaaccagabaatgtcagacaagaggaatgtcatcctgttttctgtatttgatgagaaccgaagctggtacctcacagagaatatacaacgctttctccccaatccagct

SEQ ID NO: 6355 - DNA, 201 bp, Homo sapiens
ctctagtttcgttaatatggagagagatctagcttcaggactcattggccctctcctcatctgctacaaagaatctgtagatcaaagaggaaaccagatartgtcagacaagaggaatgtcatcctgttttctgtatttgatgagaaccgaagctggtacctcacagagaatatacaacgctttctccccaatccagctgg

SEQ ID NO: 6356 - DNA, 201 bp, Homo sapiens
agtttcgttaatatggagagagatctagcttcaggactcattggccctctcctcatctgctacaaagaatctgtagatcaaagaggaaaccagataatgtmagacaagaggaatgtcatcctgttttctgtatttgatgagaaccgaagctggtacctcacagagaatatacaacgctttctccccaatccagctggagtg

SEQ ID NO: 6357 - DNA, 201 bp, Homo sapiens
ttcgttaatatggagagagatctagcttcaggactcattggccctctcctcatctgctacaaagaatctgtagatcaaagaggaaaccagataatgtcagrcaagaggaatgtcatcctgttttctgtatttgatgagaaccgaagctggtacctcacagagaatatacaacgctttctccccaatccagctggagtgcag

SEQ ID NO: 6358 - DNA, 201 bp, Homo sapiens
atcagaaattttacttttttcccctcctgggagctaaagatattttagagaagaattaaccttttgcttctccagttgaacatttgtagcaataagtcatrcaaatagagctctccacctgcttctttctgtgccttttgcgattctgctttagtgccaccagaagatactacctgggtgcagtggaactgtcatgggact

SEQ ID NO: 6359 - DNA, 201 bp, Homo sapiens
actgatggctcctttactcagcccttataccgtggagaactaaatgaacatttgggactcctggggccatatataagagcagaagttgaagataatatcayggtaactttcagaaatcaggcctctcgtccctattccttctattctagccttatttcttatgaggaagatcagaggcaaggagcagaacctagaaaaaac

SEQ ID NO: 6360 - DNA, 201 bp, Homo sapiens
tcagcccttataccgtggagaactaaatgaacatttgggactcctggggccatatataagagcagaagttgaagataatatcatggtaactttcagaaatyaggcctctcgtccctattccttctattctagccttatttcttatgaggaagatcagaggcaaggagcagaacctagaaaaaactttgtcaagcctaatga

SEQ ID NO: 6361 - DNA, 201 bp, Homo sapiens
gcccttataccgtggagaactaaatgaacatttgggactcctggggccatatataagagcagaagttgaagataatatcatggtaactttcagaaatcagscctctcgtccctattccttctattctagccttatttcttatgaggaagatcagaggcaaggagcagaacctagaaaaaactttgtcaagcctaatgaaac

SEQ ID NO: 6362 - DNA, 201 bp, Homo sapiens
aaaactttgtcaagcctaatgaaaccaaaacttacttttggaaagtgcaacatcatatggcacccactaaagatgagtttgactgcaaagcctgggcttakttctctgatgttgacctggaaaaagatgtgcactcaggcctgattggaccccttctggtctgccacactaacacactgaaccctgctcatgggagacaag

SEQ ID NO: 6363 - DNA, 201 bp, Homo sapiens
tttgtcaagcctaatgaaaccaaaacttacttttggaaagtgcaacatcatatggcacccactaaagatgagtttgactgcaaagcctgggcttatttctstgatgttgacctggaaaaagatgtgcactcaggcctgattggaccccttctggtctgccacactaacacactgaaccctgctcatgggagacaagtgaca

SEQ ID NO: 6364 - DNA, 201 bp, Homo sapiens
tccaacatcatgcacagcatcaatggctatgtttttgatagtttgcagttgtcagtttgtttgcatgaggtggcatactggtacattctaagcattggagyacagactgacttcctttctgtcttcttctctggatataccttcaaacacaaaatggtctatgaagacacactcaccctattcccattctcaggagaaact

SEQ ID NO: 6365 - DNA, 201 bp, Homo sapiens
gagttccaagcctccaacatcatgcacagcatcaatggctatgtttttgatagtttgcagttgtcagtttgtttgcatgaggtggcatactggtacattcyaagcattggagcacagactgacttcctttctgtcttcttctctggatataccttcaaacacaaaatggtctatgaagacacactcaccctattcccattc

SEQ ID NO: 6366 - DNA, 201 bp, Homo sapiens
tttgactgcaaagcctgggcttatttctctgatgttgacctggaaaaagatgtgcactcaggcctgattggaccccttctggtctgccacactaacacacygaaccctgctcatgggagacaagtgacagtacaggaatttgctctgtttttcaccatctttgatgagaccaaaagctggtacttcactgaaaatatggaa

SEQ ID NO: 6367 - DNA, 201 bp, Homo sapiens
gcttatttctctgatgttgacctggaaaaagatgtgcactcaggcctgattggaccccttctggtctgccacactaacacactgaaccctgctcatgggakacaagtgacagtacaggaatttgctctgtttttcaccatctttgatgagaccaaaagctggtacttcactgaaaatatggaaagaaactgcagggctccc

SEQ ID NO: 6368 - DNA, 201 bp, Homo sapiens
ctggggtgccacaactcagactttcggaacagaggcatgaccgccttactgaaggtttctagttgtgacaagaacactggtgattattacgaggacagttrtgaagatatttcagcatacttgctgagtaaaaacaatgccattgaaccaagaagcttctcccagaattcaagacaccctagcactaggcaaaagcaattt

SEQ ID NO: 6369 - DNA, 201 bp, Homo sapiens
ttgaggatccagagttccaagcctccaacatcatgcacagcatcaatggctatgtttttgatagtttgcagttgtcagtttgtttgcatgaggtggcatastggtacattctaagcattggagcacagactgacttcctttctgtcttcttctctggatataccttcaaacacaaaatggtctatgaagacacactcaccc

SEQ ID NO: 6370 - DNA, 201 bp, Homo sapiens
gtgcagcttgaggatccagagttccaagcctccaacatcatgcacagcatcaatggctatgtttttgatagtttgcagttgtcagtttgtttgcatgaggyggcatactggtacattctaagcattggagcacagactgacttcctttctgtcttcttctctggatataccttcaaacacaaaatggtctatgaagacaca

SEQ ID NO: 6371 - DNA, 201 bp, Homo sapiens
tctatggattctggggtgccacaactcagactttcggaacagaggcatgaccgccttactgaaggtttctagttgtgacaagaacactggtgattattacraggacagttatgaagatatttcagcatacttgctgagtaaaaacaatgccattgaaccaagaagcttctcccagaattcaagacaccctagcactaggca

SEQ ID NO: 6372 - DNA, 201 bp, Homo sapiens
gtctatggattctggggtgccacaactcagactttcggaacagaggcatgaccgccttactgaaggtttctagttgtgacaagaacactggtgattattasgaggacagttatgaagatatttcagcatacttgctgagtaaaaacaatgccattgaaccaagaagcttctcccagaattcaagacaccctagcactaggc

SEQ ID NO: 6373 - DNA, 201 bp, Homo sapiens
agtgcagcttgaggatccagagttccaagcctccaacatcatgcacagcatcaatggctatgtttttgatagtttgcagttgtcagtttgtttgcatgagrtggcatactggtacattctaagcattggagcacagactgacttcctttctgtcttcttctctggatataccttcaaacacaaaatggtctatgaagacac

SEQ ID NO: 6374 - DNA, 201 bp, Homo sapiens
aggagaaactgtcttcatgtcgatggaaaacccaggtctatggattctggggtgccacaactcagactttcggaacagaggcatgaccgccttactgaagktttctagttgtgacaagaacactggtgattattacgaggacagttatgaagatatttcagcatacttgctgagtaaaaacaatgccattgaaccaagaag

SEQ ID NO: 6375 - DNA, 201 bp, Homo sapiens
attcccattctcaggagaaactgtcttcatgtcgatggaaaacccaggtctatggattctggggtgccacaactcagactttcggaacagaggcatgaccrccttactgaaggtttctagttgtgacaagaacactggtgattattacgaggacagttatgaagatatttcagcatacttgctgagtaaaaacaatgccat

SEQ ID NO: 6376 - DNA, 201 bp, Homo sapiens; identical to SEQ ID NO: 6181

SEQ ID NO: 6377 - DNA, 201 bp, Homo sapiens; identical to SEQ ID NO: 6074
  misc_feature (1)...(201): n = A,T,C or G, or insertion/deletion polymorphism (see Tables 1-2)

SEQ ID NO: 6378 - DNA, 201 bp, Homo sapiens; identical to SEQ ID NO: 6182

SEQ ID NO: 6379 - DNA, 201 bp, Homo sapiens; identical to SEQ ID NO: 6075

SEQ ID NO: 6380 - DNA, 201 bp, Homo sapiens; identical to SEQ ID NO: 6315

SEQ ID NO: 6381 - DNA, 201 bp, Homo sapiens; identical to SEQ ID NO: 6152

SEQ ID NO: 6382 - DNA, 201 bp, Homo sapiens; identical to SEQ ID NO: 6316

SEQ ID NO: 6383 - DNA, 201 bp, Homo sapiens; identical to SEQ ID NO: 6112

SEQ ID NO: 6384 - DNA, 201 bp, Homo sapiens; identical to SEQ ID NO: 6318

SEQ ID NO: 6385 - DNA, 201 bp, Homo sapiens; identical to SEQ ID NO: 6320

SEQ ID NO: 6386 - DNA, 201 bp, Homo sapiens; identical to SEQ ID NO: 6322

SEQ ID NO: 6387 - DNA, 201 bp, Homo sapiens; identical to SEQ ID NO: 6116

SEQ ID NO: 6388 - DNA, 201 bp, Homo sapiens; identical to SEQ ID NO: 6117

SEQ ID NO: 6389 - DNA, 201 bp, Homo sapiens; identical to SEQ ID NO: 6081

SEQ ID NO: 6390 - DNA, 201 bp, Homo sapiens; identical to SEQ ID NO: 6082

SEQ ID NO: 6391 - DNA, 201 bp, Homo sapiens
gatgcggatccaagaccctgggaaggtcttctttggcaatgtggattcatctgggataaaacacaatatttttaaccctccaattattgctcgatacatcygtttgcacccaactcattatagcattcgcagcactcttcgcatggagttgatgggctgtgatttaaatagttgcagcatgccattgggaatggagagtaa

SEQ ID NO: 6392 - DNA, 201 bp, Homo sapiens
agaccctgggaaggtcttctttggcaatgtggattcatctgggataaaacacaatatttttaaccctccaattattgctcgatacatccgtttgcacccarctcattatagcattcgcagcactcttcgcatggagttgatgggctgtgatttaaatagttgcagcatgccattgggaatggagagtaaagcaatatcaga

SEQ ID NO: 6393 - DNA, 201 bp, Homo sapiens; identical to SEQ ID NO: 6255

SEQ ID NO: 6394 - DNA, 201 bp, Homo sapiens; identical to SEQ ID NO: 6219

SEQ ID NO: 6395 - DNA, 201 bp, Homo sapiens
atgcggatccaagaccctgggaaggtcttctttggcaatgtggattcatctgggataaaacacaatatttttaaccctccaattattgctcgatacatccrtttgcacccaactcattatagcattcgcagcactcttcgcatggagttgatgggctgtgatttaaatagttgcagcatgccattgggaatggagagtaaa

SEQ ID NO: 6396 - DNA, 201 bp, Homo sapiens; identical to SEQ ID NO: 6257

SEQ ID NO: 6397 - DNA, 201 bp, Homo sapiens; identical to SEQ ID NO: 6221

SEQ ID NO: 6398 - DNA, 201 bp, Homo sapiens; identical to SEQ ID NO: 6083

SEQ ID NO: 6399 - DNA, 201 bp, Homo sapiens; identical to SEQ ID NO: 6084

SEQ ID NO: 6400 - DNA, 201 bp, Homo sapiens
caagaccctgggaaggtcttctttggcaatgtggattcatctgggataaaacacaatatttttaaccctccaattattgctcgatacatccgtttgcaccvaactcattatagcattcgcagcactcttcgcatggagttgatgggctgtgatttaaatagttgcagcatgccattgggaatggagagtaaagcaatatca

SEQ ID NO: 6401 - DNA, 201 bp, Homo sapiens
ggtctcggggatgcggatccaagaccctgggaaggtcttctttggcaatgtggattcatctgggataaaacacaatatttttaaccctccaattattgctygatacatccgtttgcacccaactcattatagcattcgcagcactcttcgcatggagttgatgggctgtgatttaaatagttgcagcatgccattgggaat

SEQ ID NO: 6402 - DNA, 201 bp, Homo sapiens; identical to SEQ ID NO: 6163

SEQ ID NO: 6403 - DNA, 201 bp, Homo sapiens; identical to SEQ ID NO: 6164

SEQ ID NO: 6404 - DNA, 201 bp, Homo sapiens; identical to SEQ ID NO: 6089

SEQ ID NO: 6405 - DNA, 201 bp, Homo sapiens; identical to SEQ ID NO: 6165

SEQ ID NO: 6406 - DNA, 201 bp, Homo sapiens; identical to SEQ ID NO: 6045

SEQ ID NO: 6407 - DNA, 201 bp, Homo sapiens; identical to SEQ ID NO: 6091
  misc_feature (1)...(201): n = A,T,C or G, or insertion/deletion polymorphism (see Tables 1-2)

SEQ ID NO: 6408 - DNA, 201 bp, Homo sapiens
ggctgtgagcggcgtatgcaaatcgagggtctcggggatgcggatccaagaccctgggaaggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 6409 - DNA, 201 bp, Homo sapiens; identical to SEQ ID NO: 6166

SEQ ID NO: 6410 - DNA, 201 bp, Homo sapiens; identical to SEQ ID NO: 6353

SEQ ID NO: 6411 - DNA, 201 bp, Homo sapiens; identical to SEQ ID NO: 6193

SEQ ID NO: 6412 - DNA, 201 bp, Homo sapiens; identical to SEQ ID NO: 6282

SEQ ID NO: 6413 - DNA, 201 bp, Homo sapiens; identical to SEQ ID NO: 6195

SEQ ID NO: 6414 - DNA, 201 bp, Homo sapiens; identical to SEQ ID NO: 6196

SEQ ID NO: 6415 - DNA, 201 bp, Homo sapiens; identical to SEQ ID NO: 6197

SEQ ID NO: 6416 - DNA, 201 bp, Homo sapiens
gaccctgggaaggtcttctttggcaatgtggattcatctgggataaaacacaatatttttaaccctccaattattgctcgatacatccgtttgcacccaaytcattatagcattcgcagcactcttcgcatggagttgatgggctgtgatttaaatagttgcagcatgccattgggaatggagagtaaagcaatatcagat

SEQ ID NO: 6417 - DNA, 201 bp, Homo sapiens; identical to SEQ ID NO: 6068

SEQ ID NO: 6418 - DNA, 201 bp, Homo sapiens; identical to SEQ ID NO: 6106

SEQ ID NO: 6419 - DNA, 201 bp, Homo sapiens; identical to SEQ ID NO: 6179

SEQ ID NO: 6420 - DNA, 201 bp, Homo sapiens; identical to SEQ ID NO: 6180

SEQ ID NO: 6421 - DNA, 201 bp, Homo sapiens; identical to SEQ ID NO: 6246

SEQ ID NO: 6422 - DNA, 201 bp, Homo sapiens; identical to SEQ ID NO: 6143

SEQ ID NO: 6423 - DNA, 201 bp, Homo sapiens; identical to SEQ ID NO: 6022

SEQ ID NO: 6424 - DNA, 201 bp, Homo sapiens; identical to SEQ ID NO: 6023

SEQ ID NO: 6425 - DNA, 201 bp, Homo sapiens; identical to SEQ ID NO: 6024

SEQ ID NO: 6426 - DNA, 201 bp, Homo sapiens; identical to SEQ ID NO: 6025

SEQ ID NO: 6427 - DNA, 201 bp, Homo sapiens; identical to SEQ ID NO: 6026

SEQ ID NO: 6428 - DNA, 201 bp, Homo sapiens; identical to SEQ ID NO: 6027

SEQ ID NO: 6429 - DNA, 201 bp, Homo sapiens; identical to SEQ ID NO: 6028

SEQ ID NO: 6430 - DNA, 201 bp, Homo sapiens; identical to SEQ ID NO: 6029

SEQ ID NO: 6431 - DNA, 201 bp, Homo sapiens; identical to SEQ ID NO: 6030

SEQ ID NO: 6432 - DNA, 201 bp, Homo sapiens; identical to SEQ ID NO: 6031

SEQ ID NO: 6433 - DNA, 201 bp, Homo sapiens; identical to SEQ ID NO: 6032

SEQ ID NO: 6434 - DNA, 201 bp, Homo sapiens; identical to SEQ ID NO: 6033

SEQ ID NO: 6435 - DNA, 201 bp, Homo sapiens; identical to SEQ ID NO: 6034

SEQ ID NO: 6436 - DNA, 201 bp, Homo sapiens; identical to SEQ ID NO: 6035

SEQ ID NO: 6437 - DNA, 201 bp, Homo sapiens; identical to SEQ ID NO: 6036

SEQ ID NO: 6438 - DNA, 201 bp, Homo sapiens; identical to SEQ ID NO: 6037

SEQ ID NO: 6439 - DNA, 201 bp, Homo sapiens; identical to SEQ ID NO: 6038

SEQ ID NO: 6440 - DNA, 201 bp, Homo sapiens; identical to SEQ ID NO: 6039

SEQ ID NO: 6441 - DNA, 201 bp, Homo sapiens; identical to SEQ ID NO: 6040

SEQ ID NO: 6442 - DNA, 201 bp, Homo sapiens; identical to SEQ ID NO: 6041

SEQ ID NO: 6443 - DNA, 201 bp, Homo sapiens; identical to SEQ ID NO: 6042

SEQ ID NO: 6444 - DNA, 201 bp, Homo sapiens; identical to SEQ ID NO: 6043

SEQ ID NO: 6445 - DNA, 201 bp, Homo sapiens; identical to SEQ ID NO: 6044

SEQ ID NO: 6446 - DNA, 201 bp, Homo sapiens; identical to SEQ ID NO: 6045

SEQ ID NO: 6447 - DNA, 201 bp, Homo sapiens; identical to SEQ ID NO: 6046

SEQ ID NO: 6448 - DNA, 201 bp, Homo sapiens; identical to SEQ ID NO: 6047

SEQ ID NO: 6449 - DNA, 201 bp, Homo sapiens; identical to SEQ ID NO: 6048

SEQ ID NO: 6450 - DNA, 201 bp, Homo sapiens; identical to SEQ ID NO: 6049

SEQ ID NO: 6451 - DNA, 201 bp, Homo sapiens; identical to SEQ ID NO: 6050

SEQ ID NO: 6452 - DNA, 201 bp, Homo sapiens; identical to SEQ ID NO: 6051

SEQ ID NO: 6453 - DNA, 201 bp, Homo sapiens; identical to SEQ ID NO: 6052

SEQ ID NO: 6454 - DNA, 201 bp, Homo sapiens; identical to SEQ ID NO: 6053

SEQ ID NO: 6455 - DNA, 201 bp, Homo sapiens; identical to SEQ ID NO: 6054

SEQ ID NO: 6456 - DNA, 201 bp, Homo sapiens; identical to SEQ ID NO: 6055

SEQ ID NO: 6457 - DNA, 201 bp, Homo sapiens; identical to SEQ ID NO: 6056

SEQ ID NO: 6458 - DNA, 201 bp, Homo sapiens; identical to SEQ ID NO: 6057

SEQ ID NO: 6459 - DNA, 201 bp, Homo sapiens; identical to SEQ ID NO: 6058

SEQ ID NO: 6460 - DNA, 201 bp, Homo sapiens; identical to SEQ ID NO: 6059

SEQ ID NO: 6461 - DNA, 201 bp, Homo sapiens; identical to SEQ ID NO: 6060

SEQ ID NO: 6462 - DNA, 201 bp, Homo sapiens; identical to SEQ ID NO: 6061

SEQ ID NO: 6463 - DNA, 201 bp, Homo sapiens; identical to SEQ ID NO: 6062

SEQ ID NO: 6464 - DNA, 201 bp, Homo sapiens; identical to SEQ ID NO: 6063

SEQ ID NO: 6465 - DNA, 201 bp, Homo sapiens; identical to SEQ ID NO: 6064

SEQ ID NO: 6466 - DNA, 201 bp, Homo sapiens; identical to SEQ ID NO: 6065

SEQ ID NO: 6467 - DNA, 201 bp, Homo sapiens; identical to SEQ ID NO: 6066

SEQ ID NO: 6468 - DNA, 201 bp, Homo sapiens; identical to SEQ ID NO: 6067

SEQ ID NO: 6469 - DNA, 201 bp, Homo sapiens; identical to SEQ ID NO: 6068

SEQ ID NO: 6470 - DNA, 201 bp, Homo sapiens; identical to SEQ ID NO: 6069

SEQ ID NO: 6471 - DNA, 201 bp, Homo sapiens; identical to SEQ ID NO: 6070

SEQ ID NO: 6472 - DNA, 201 bp, Homo sapiens; identical to SEQ ID NO: 6071

SEQ ID NO: 6473 - DNA, 201 bp, Homo sapiens; identical to SEQ ID NO: 6072

SEQ ID NO: 6474 - DNA, 201 bp, Homo sapiens; identical to SEQ ID NO: 6073

SEQ ID NO: 6475 - DNA, 201 bp, Homo sapiens; identical to SEQ ID NO: 6074
  misc_feature (1)...(201): n = A,T,C or G, or insertion/deletion polymorphism (see Tables 1-2)

SEQ ID NO: 6476 - DNA, 201 bp, Homo sapiens; identical to SEQ ID NO: 6075

SEQ ID NO: 6477 - DNA, 201 bp, Homo sapiens; identical to SEQ ID NO: 6076

SEQ ID NO: 6478 - DNA, 201 bp, Homo sapiens; identical to SEQ ID NO: 6077

SEQ ID NO: 6479 - DNA, 201 bp, Homo sapiens; identical to SEQ ID NO: 6078

SEQ ID NO: 6480 - DNA, 201 bp, Homo sapiens; identical to SEQ ID NO: 6079

SEQ ID NO: 6481 - DNA, 201 bp, Homo sapiens; identical to SEQ ID NO: 6080

SEQ ID NO: 6482 - DNA, 201 bp, Homo sapiens; identical to SEQ ID NO: 6081

SEQ ID NO: 6483 - DNA, 201 bp, Homo sapiens; identical to SEQ ID NO: 6082

SEQ ID NO: 6484 - DNA, 201 bp, Homo sapiens; identical to SEQ ID NO: 6083

SEQ ID NO: 6485 - DNA, 201 bp, Homo sapiens; identical to SEQ ID NO: 6084

SEQ ID NO: 6486 - DNA, 201 bp, Homo sapiens; identical to SEQ ID NO: 6085

SEQ ID NO: 6487 - DNA, 201 bp, Homo sapiens; identical to SEQ ID NO: 6086

SEQ ID NO: 6488 - DNA, 201 bp, Homo sapiens; identical to SEQ ID NO: 6087

SEQ ID NO: 6489 - DNA, 201 bp, Homo sapiens; identical to SEQ ID NO: 6088

SEQ ID NO: 6490 - DNA, 201 bp, Homo sapiens; identical to SEQ ID NO: 6089

SEQ ID NO: 6491 - DNA, 201 bp, Homo sapiens; identical to SEQ ID NO: 6090

SEQ ID NO: 6492 - DNA, 201 bp, Homo sapiens; identical to SEQ ID NO: 6091
  misc_feature (1)...(201): n = A,T,C or G, or insertion/deletion polymorphism (see Tables 1-2)

SEQ ID NO: 6493 - DNA, 201 bp, Homo sapiens; identical to SEQ ID NO: 6092

SEQ ID NO: 6494 - DNA, 201 bp, Homo sapiens; identical to SEQ ID NO: 6093

SEQ ID NO: 6495 - DNA, 201 bp, Homo sapiens; identical to SEQ ID NO: 6094

SEQ ID NO: 6496 - DNA, 201 bp, Homo sapiens; identical to SEQ ID NO: 6095

SEQ ID NO: 6497 - DNA, 201 bp, Homo sapiens; identical to SEQ ID NO: 6096

SEQ ID NO: 6498 - DNA, 201 bp, Homo sapiens; identical to SEQ ID NO: 6097

SEQ ID NO: 6499 - DNA, 201 bp, Homo sapiens; identical to SEQ ID NO: 6098

SEQ ID NO: 6500 - DNA, 201 bp, Homo sapiens; identical to SEQ ID NO: 6099

SEQ ID NO: 6501 - DNA, 201 bp, Homo sapiens; identical to SEQ ID NO: 6100

SEQ ID NO: 6502 - DNA, 201 bp, Homo sapiens; identical to SEQ ID NO: 6101

SEQ ID NO: 6503 - DNA, 201 bp, Homo sapiens; identical to SEQ ID NO: 6102

SEQ ID NO: 6504 - DNA, 201 bp, Homo sapiens; identical to SEQ ID NO: 6103

SEQ ID NO: 6505 - DNA, 201 bp, Homo sapiens; identical to SEQ ID NO: 6104

SEQ ID NO: 6506 - DNA, 201 bp, Homo sapiens; identical to SEQ ID NO: 6105

SEQ ID NO: 6507 - DNA, 201 bp, Homo sapiens; identical to SEQ ID NO: 6106

SEQ ID NO: 6508 - DNA, 201 bp, Homo sapiens; identical to SEQ ID NO: 6107

SEQ ID NO: 6509 - DNA, 201 bp, Homo sapiens; identical to SEQ ID NO: 6108

SEQ ID NO: 6510 - DNA, 201 bp, Homo sapiens; identical to SEQ ID NO: 6109

SEQ ID NO: 6511 - DNA, 201 bp, Homo sapiens; identical to SEQ ID NO: 6110

SEQ ID NO: 6512 - DNA, 201 bp, Homo sapiens; identical to SEQ ID NO: 6111

SEQ ID NO: 6513 - DNA, 201 bp, Homo sapiens; identical to SEQ ID NO: 6112

SEQ ID NO: 6514 - DNA, 201 bp, Homo sapiens; identical to SEQ ID NO: 6113

SEQ ID NO: 6515 - DNA, 201 bp, Homo sapiens; identical to SEQ ID NO: 6114

SEQ ID NO: 6516 - DNA, 201 bp, Homo sapiens; identical to SEQ ID NO: 6115

SEQ ID NO: 6517 - DNA, 201 bp, Homo sapiens; identical to SEQ ID NO: 6116

SEQ ID NO: 6518 - DNA, 201 bp, Homo sapiens; identical to SEQ ID NO: 6117

SEQ ID NO: 6519 - DNA, 201 bp, Homo sapiens; identical to SEQ ID NO: 6118

SEQ ID NO: 6520 - DNA, 201 bp, Homo sapiens; identical to SEQ ID NO: 6119

SEQ ID NO: 6521 - DNA, 201 bp, Homo sapiens; identical to SEQ ID NO: 6120

SEQ ID NO: 6522 - DNA, 201 bp, Homo sapiens; identical to SEQ ID NO: 6121

SEQ ID NO: 6523 - DNA, 201 bp, Homo sapiens; identical to SEQ ID NO: 6122

SEQ ID NO: 6524 - DNA, 201 bp, Homo sapiens; identical to SEQ ID NO: 6124

SEQ ID NO: 6525 - DNA, 201 bp, Homo sapiens; identical to SEQ ID NO: 6123

SEQ ID NO: 6526 - DNA, 201 bp, Homo sapiens; identical to SEQ ID NO: 6125

SEQ ID NO: 6527 - DNA, 201 bp, Homo sapiens; identical to SEQ ID NO: 6126

SEQ ID NO: 6528 - DNA, 201 bp, Homo sapiens; identical to SEQ ID NO: 6127

SEQ ID NO: 6529 - DNA, 201 bp, Homo sapiens
cctaagtcttgatgggaagaagtggcagacttatcgaggaaattccactggaaccttaatggtcttctttggcaatgtggattcatctgggataaaacacratatttttaaccctccaattattgctcgatacatccgtttgcacccaactcattatagcattcgcagcactcttcgcatggagttgatgggctgtgattt

SEQ ID NO: 6530 - DNA, 201 bp, Homo sapiens; identical to SEQ ID NO: 6129

SEQ ID NO: 6531 - DNA, 201 bp, Homo sapiens; identical to SEQ ID NO: 6130

SEQ ID NO: 6532 - DNA, 201 bp, Homo sapiens; identical to SEQ ID NO: 6131

SEQ ID NO: 6533 - DNA, 201 bp, Homo sapiens; identical to SEQ ID NO: 6132

SEQ ID NO: 6534 - DNA, 201 bp, Homo sapiens; identical to SEQ ID NO: 6133

SEQ ID NO: 6535 - DNA, 201 bp, Homo sapiens; identical to SEQ ID NO: 6134

SEQ ID NO: 6536 - DNA, 201 bp, Homo sapiens; identical to SEQ ID NO: 6135

SEQ ID NO: 6537 - DNA, 201 bp, Homo sapiens; identical to SEQ ID NO: 6136

SEQ ID NO: 6538 - DNA, 201 bp, Homo sapiens; identical to SEQ ID NO: 6137

SEQ ID NO: 6539 - DNA, 201 bp, Homo sapiens; identical to SEQ ID NO: 6138

SEQ ID NO: 6540 - DNA, 201 bp, Homo sapiens; identical to SEQ ID NO: 6139

SEQ ID NO: 6541 - DNA, 201 bp, Homo sapiens; identical to SEQ ID NO: 6140

SEQ ID NO: 6542 - DNA, 201 bp, Homo sapiens; identical to SEQ ID NO: 6141

SEQ ID NO: 6543 - DNA, 201 bp, Homo sapiens; identical to SEQ ID NO: 6142

SEQ ID NO: 6544 - DNA, 201 bp, Homo sapiens; identical to SEQ ID NO: 6143

SEQ ID NO: 6545 - DNA, 201 bp, Homo sapiens; identical to SEQ ID NO: 6144

SEQ ID NO: 6546 - DNA, 201 bp, Homo sapiens; identical to SEQ ID NO: 6145

SEQ ID NO: 6547 - DNA, 201 bp, Homo sapiens; identical to SEQ ID NO: 6146

SEQ ID NO: 6548 - DNA, 201 bp, Homo sapiens; identical to SEQ ID NO: 6147

SEQ ID NO: 6549 - DNA, 201 bp, Homo sapiens; identical to SEQ ID NO: 6148

SEQ ID NO: 6550 - DNA, 201 bp, Homo sapiens; identical to SEQ ID NO: 6149

SEQ ID NO: 6551 - DNA, 201 bp, Homo sapiens; identical to SEQ ID NO: 6150

SEQ ID NO: 6552 - DNA, 201 bp, Homo sapiens; identical to SEQ ID NO: 6151

SEQ ID NO: 6553 - DNA, 201 bp, Homo sapiens; identical to SEQ ID NO: 6152

SEQ ID NO: 6554 - DNA, 201 bp, Homo sapiens; identical to SEQ ID NO: 6153

SEQ ID NO: 6555 - DNA, 201 bp, Homo sapiens; identical to SEQ ID NO: 6154

SEQ ID NO: 6556 - DNA, 201 bp, Homo sapiens; identical to SEQ ID NO: 6155

SEQ ID NO: 6557 - DNA, 201 bp, Homo sapiens; identical to SEQ ID NO: 6156

SEQ ID NO: 6558 - DNA, 201 bp, Homo sapiens; identical to SEQ ID NO: 6157

SEQ ID NO: 6559 - DNA, 201 bp, Homo sapiens; identical to SEQ ID NO: 6158

SEQ ID NO: 6560 - DNA, 201 bp, Homo sapiens; identical to SEQ ID NO: 6159

SEQ ID NO: 6561 - DNA, 201 bp, Homo sapiens; identical to SEQ ID NO: 6160

SEQ ID NO: 6562 - DNA, 201 bp, Homo sapiens; identical to SEQ ID NO: 6161

SEQ ID NO: 6563 - DNA, 201 bp, Homo sapiens; identical to SEQ ID NO: 6162

SEQ ID NO: 6564 - DNA, 201 bp, Homo sapiens; identical to SEQ ID NO: 6163

SEQ ID NO: 6565 - DNA, 201 bp, Homo sapiens; identical to SEQ ID NO: 6164

SEQ ID NO: 6566 - DNA, 201 bp, Homo sapiens; identical to SEQ ID NO: 6165

SEQ ID NO: 6567 - DNA, 201 bp, Homo sapiens; identical to SEQ ID NO: 6166

SEQ ID NO: 6568 - DNA, 201 bp, Homo sapiens; identical to SEQ ID NO: 6167

SEQ ID NO: 6569 - DNA, 201 bp, Homo sapiens; identical to SEQ ID NO: 6168

SEQ ID NO: 6570 - DNA, 201 bp, Homo sapiens; identical to SEQ ID NO: 6169

SEQ ID NO: 6571 - DNA, 201 bp, Homo sapiens; identical to SEQ ID NO: 6170

SEQ ID NO: 6572 - DNA, 201 bp, Homo sapiens; identical to SEQ ID NO: 6171

SEQ ID NO: 6573 - DNA, 201 bp, Homo sapiens; identical to SEQ ID NO: 6172

SEQ ID NO: 6574 - DNA, 201 bp, Homo sapiens; identical to SEQ ID NO: 6173

SEQ ID NO: 6575 - DNA, 201 bp, Homo sapiens; identical to SEQ ID NO: 6174

SEQ ID NO: 6576 - DNA, 201 bp, Homo sapiens; identical to SEQ ID NO: 6175

SEQ ID NO: 6577 - DNA, 201 bp, Homo sapiens; identical to SEQ ID NO: 6176

SEQ ID NO: 6578 - DNA, 201 bp, Homo sapiens; identical to SEQ ID NO: 6177

SEQ ID NO: 6579 - DNA, 201 bp, Homo sapiens; identical to SEQ ID NO: 6178

SEQ ID NO: 6580 - DNA, 201 bp, Homo sapiens; identical to SEQ ID NO: 6179

SEQ ID NO: 6581 - DNA, 201 bp, Homo sapiens; identical to SEQ ID NO: 6180

SEQ ID NO: 6582 - DNA, 201 bp, Homo sapiens; identical to SEQ ID NO: 6181

SEQ ID NO: 6583 - DNA, 201 bp, Homo sapiens; identical to SEQ ID NO: 6183

SEQ ID NO: 6584 - DNA, 201 bp, Homo sapiens; identical to SEQ ID NO: 6182

SEQ ID NO: 6585 - DNA, 201 bp, Homo sapiens; identical to SEQ ID NO: 6184

SEQ ID NO: 6586 - DNA, 201 bp, Homo sapiens; identical to SEQ ID NO: 6185

SEQ ID NO: 6587 - DNA, 201 bp, Homo sapiens; identical to SEQ ID NO: 6186

SEQ ID NO: 6588 - DNA, 201 bp, Homo sapiens; identical to SEQ ID NO: 6187

SEQ ID NO: 6589 - DNA, 201 bp, Homo sapiens; identical to SEQ ID NO: 6188

SEQ ID NO: 6590 - DNA, 201 bp, Homo sapiens; identical to SEQ ID NO: 6189

SEQ ID NO: 6591 - DNA, 201 bp, Homo sapiens; identical to SEQ ID NO: 6190

SEQ ID NO: 6592 - DNA, 201 bp, Homo sapiens; identical to SEQ ID NO: 6191

SEQ ID NO: 6593 - DNA, 201 bp, Homo sapiens; identical to SEQ ID NO: 6192

SEQ ID NO: 6594 - DNA, 201 bp, Homo sapiens; identical to SEQ ID NO: 6193

SEQ ID NO: 6595 - DNA, 201 bp, Homo sapiens; identical to SEQ ID NO: 6194

SEQ ID NO: 6596 - DNA, 201 bp, Homo sapiens; identical to SEQ ID NO: 6195

SEQ ID NO: 6597 - DNA, 201 bp, Homo sapiens; identical to SEQ ID NO: 6196

SEQ ID NO: 6598 - DNA, 201 bp, Homo sapiens; identical to SEQ ID NO: 6197

SEQ ID NO: 6599 - DNA, 201 bp, Homo sapiens; identical to SEQ ID NO: 6198

SEQ ID NO: 6600 - DNA, 201 bp, Homo sapiens; identical to SEQ ID NO: 6199

SEQ ID NO: 6601 - DNA, 201 bp, Homo sapiens; identical to SEQ ID NO: 6200

SEQ ID NO: 6602 - DNA, 201 bp, Homo sapiens; identical to SEQ ID NO: 6201

SEQ ID NO: 6603 - DNA, 201 bp, Homo sapiens; identical to SEQ ID NO: 6202

SEQ ID NO: 6604 - DNA, 201 bp, Homo sapiens; identical to SEQ ID NO: 6203

SEQ ID NO: 6605 - DNA, 201 bp, Homo sapiens; identical to SEQ ID NO: 6204

SEQ ID NO: 6606 - DNA, 201 bp, Homo sapiens; identical to SEQ ID NO: 6205

SEQ ID NO: 6607 - DNA, 201 bp, Homo sapiens; identical to SEQ ID NO: 6206

SEQ ID NO: 6608 - DNA, 201 bp, Homo sapiens; identical to SEQ ID NO: 6207

SEQ ID NO: 6609 - DNA, 201 bp, Homo sapiens; identical to SEQ ID NO: 6208

SEQ ID NO: 6610 - DNA, 201 bp, Homo sapiens; identical to SEQ ID NO: 6209

SEQ ID NO: 6611 - DNA, 201 bp, Homo sapiens; identical to SEQ ID NO: 6210

SEQ ID NO: 6612 - DNA, 201 bp, Homo sapiens; identical to SEQ ID NO: 6211

SEQ ID NO: 6613 - DNA, 201 bp, Homo sapiens; identical to SEQ ID NO: 6212

SEQ ID NO: 6614 - DNA, 201 bp, Homo sapiens; identical to SEQ ID NO: 6213

SEQ ID NO: 6615 - DNA, 201 bp, Homo sapiens; identical to SEQ ID NO: 6214

SEQ ID NO: 6616 - DNA, 201 bp, Homo sapiens; identical to SEQ ID NO: 6215

SEQ ID NO: 6617 - DNA, 201 bp, Homo sapiens; identical to SEQ ID NO: 6216

SEQ ID NO: 6618 - DNA, 201 bp, Homo sapiens; identical to SEQ ID NO: 6218

SEQ ID NO: 6619 - DNA, 201 bp, Homo sapiens; identical to SEQ ID NO: 6217

SEQ ID NO: 6620 - DNA, 201 bp, Homo sapiens; identical to SEQ ID NO: 6220

SEQ ID NO: 6621 - DNA, 201 bp, Homo sapiens; identical to SEQ ID NO: 6219

SEQ ID NO: 6622 - DNA, 201 bp, Homo sapiens; identical to SEQ ID NO: 6221

SEQ ID NO: 6623 - DNA, 201 bp, Homo sapiens; identical to SEQ ID NO: 6222

SEQ ID NO: 6624 - DNA, 201 bp, Homo sapiens; identical to SEQ ID NO: 6223

SEQ ID NO: 6625 - DNA, 201 bp, Homo sapiens; identical to SEQ ID NO: 6224

SEQ ID NO: 6626 - DNA, 201 bp, Homo sapiens; identical to SEQ ID NO: 6225

SEQ ID NO: 6627 - DNA, 201 bp, Homo sapiens; identical to SEQ ID NO: 6226

SEQ ID NO: 6628 - DNA, 201 bp, Homo sapiens; identical to SEQ ID NO: 6227

SEQ ID NO: 6629 - DNA, 201 bp, Homo sapiens; identical to SEQ ID NO: 6228

SEQ ID NO: 6630 - DNA, 201 bp, Homo sapiens; identical to SEQ ID NO: 6229

SEQ ID NO: 6631 - DNA, 201 bp, Homo sapiens; identical to SEQ ID NO: 6230

SEQ ID NO: 6632 - DNA, 201 bp, Homo sapiens; identical to SEQ ID NO: 6231

SEQ ID NO: 6633 - DNA, 201 bp, Homo sapiens; identical to SEQ ID NO: 6232

SEQ ID NO: 6634 - DNA, 201 bp, Homo sapiens; identical to SEQ ID NO: 6233

SEQ ID NO: 6635 - DNA, 201 bp, Homo sapiens; identical to SEQ ID NO: 6234

SEQ ID NO: 6636 - DNA, 201 bp, Homo sapiens; identical to SEQ ID NO: 6235

SEQ ID NO: 6637 - DNA, 201 bp, Homo sapiens; identical to SEQ ID NO: 6236

SEQ ID NO: 6638 - DNA, 201 bp, Homo sapiens; identical to SEQ ID NO: 6237

SEQ ID NO: 6639 - DNA, 201 bp, Homo sapiens; identical to SEQ ID NO: 6238

SEQ ID NO: 6640 - DNA, 201 bp, Homo sapiens; identical to SEQ ID NO: 6239

SEQ ID NO: 6641 - DNA, 201 bp, Homo sapiens; identical to SEQ ID NO: 6240

SEQ ID NO: 6642 - DNA, 201 bp, Homo sapiens; identical to SEQ ID NO: 6241

SEQ ID NO: 6643 - DNA, 201 bp, Homo sapiens; identical to SEQ ID NO: 6242

SEQ ID NO: 6644 - DNA, 201 bp, Homo sapiens; identical to SEQ ID NO: 6243

SEQ ID NO: 6645 - DNA, 201 bp, Homo sapiens; identical to SEQ ID NO: 6244

SEQ ID NO: 6646 - DNA, 201 bp, Homo sapiens; identical to SEQ ID NO: 6245

SEQ ID NO: 6647 - DNA, 201 bp, Homo sapiens; identical to SEQ ID NO: 6246

SEQ ID NO: 6648 - DNA, 201 bp, Homo sapiens; identical to SEQ ID NO: 6247

SEQ ID NO: 6649 - DNA, 201 bp, Homo sapiens; identical to SEQ ID NO: 6248

SEQ ID NO: 6650 - DNA, 201 bp, Homo sapiens; identical to SEQ ID NO: 6249

SEQ ID NO: 6651 - DNA, 201 bp, Homo sapiens; identical to SEQ ID NO: 6250

SEQ ID NO: 6652 - DNA, 201 bp, Homo sapiens; identical to SEQ ID NO: 6251

SEQ ID NO: 6653 - DNA, 201 bp, Homo sapiens; identical to SEQ ID NO: 6252

SEQ ID NO: 6654 - DNA, 201 bp, Homo sapiens; identical to SEQ ID NO: 6253

SEQ ID NO: 6655 - DNA, 201 bp, Homo sapiens; identical to SEQ ID NO: 6254

SEQ ID NO: 6656 - DNA, 201 bp, Homo sapiens; identical to SEQ ID NO: 6255

SEQ ID NO: 6657 - DNA, 201 bp, Homo sapiens; identical to SEQ ID NO: 6256

SEQ ID NO: 6658 - DNA, 201 bp, Homo sapiens; identical to SEQ ID NO: 6257

SEQ ID NO: 6659 - DNA, 201 bp, Homo sapiens; identical to SEQ ID NO: 6258

SEQ ID NO: 6660 - DNA, 201 bp, Homo sapiens; identical to SEQ ID NO: 6259

SEQ ID NO: 6661 - DNA, 201 bp, Homo sapiens; identical to SEQ ID NO: 6260

SEQ ID NO: 6662 - DNA, 201 bp, Homo sapiens; identical to SEQ ID NO: 6261

SEQ ID NO: 6663 - DNA, 201 bp, Homo sapiens; identical to SEQ ID NO: 6262

SEQ ID NO: 6664 - DNA, 201 bp, Homo sapiens; identical to SEQ ID NO: 6263

SEQ ID NO: 6665 - DNA, 201 bp, Homo sapiens; identical to SEQ ID NO: 6264

SEQ ID NO: 6666 - DNA, 201 bp, Homo sapiens; identical to SEQ ID NO: 6265

SEQ ID NO: 6667 - DNA, 201 bp, Homo sapiens; identical to SEQ ID NO: 6266

SEQ ID NO: 6668 - DNA, 201 bp, Homo sapiens; identical to SEQ ID NO: 6267

SEQ ID NO: 6669 - DNA, 201 bp, Homo sapiens; identical to SEQ ID NO: 6268

SEQ ID NO: 6670 - DNA, 201 bp, Homo sapiens; identical to SEQ ID NO: 6269

SEQ ID NO: 6671 - DNA, 201 bp, Homo sapiens; identical to SEQ ID NO: 6270

SEQ ID NO: 6672 - DNA, 201 bp, Homo sapiens; identical to SEQ ID NO: 6271

SEQ ID NO: 6673 - DNA, 201 bp, Homo sapiens; identical to SEQ ID NO: 6272

SEQ ID NO: 6674 - DNA, 201 bp, Homo sapiens; identical to SEQ ID NO: 6273

SEQ ID NO: 6675 - DNA, 201 bp, Homo sapiens; identical to SEQ ID NO: 6274

SEQ ID NO: 6676 - DNA, 201 bp, Homo sapiens; identical to SEQ ID NO: 6275

SEQ ID NO: 6677 - DNA, 201 bp, Homo sapiens; identical to SEQ ID NO: 6276

SEQ ID NO: 6678 - DNA, 201 bp, Homo sapiens; identical to SEQ ID NO: 6277

SEQ ID NO: 6679 - DNA, 201 bp, Homo sapiens; identical to SEQ ID NO: 6278

SEQ ID NO: 6680 - DNA, 201 bp, Homo sapiens; identical to SEQ ID NO: 6279

SEQ ID NO: 6681 - DNA, 201 bp, Homo sapiens; identical to SEQ ID NO: 6280

SEQ ID NO: 6682 - DNA, 201 bp, Homo sapiens; identical to SEQ ID NO: 6281

SEQ ID NO: 6683 - DNA, 201 bp, Homo sapiens; identical to SEQ ID NO: 6282

SEQ ID NO: 6684 - DNA, 201 bp, Homo sapiens; identical to SEQ ID NO: 6283

SEQ ID NO: 6685 - DNA, 201 bp, Homo sapiens; identical to SEQ ID NO: 6284

SEQ ID NO: 6686 - DNA, 201 bp, Homo sapiens; identical to SEQ ID NO: 6285

SEQ ID NO: 6687 - DNA, 201 bp, Homo sapiens; identical to SEQ ID NO: 6286

SEQ ID NO: 6688 - DNA, 201 bp, Homo sapiens; identical to SEQ ID NO: 6287

SEQ ID NO: 6689 - DNA, 201 bp, Homo sapiens; identical to SEQ ID NO: 6288

SEQ ID NO: 6690 - DNA, 201 bp, Homo sapiens; identical to SEQ ID NO: 6289

SEQ ID NO: 6691 - DNA, 201 bp, Homo sapiens; identical to SEQ ID NO: 6290

SEQ ID NO: 6692 - DNA, 201 bp, Homo sapiens; identical to SEQ ID NO: 6291

SEQ ID NO: 6693 - DNA, 201 bp, Homo sapiens; identical to SEQ ID NO: 6292

SEQ ID NO: 6694 - DNA, 201 bp, Homo sapiens; identical to SEQ ID NO: 6293

SEQ ID NO: 6695 - DNA, 201 bp, Homo sapiens; identical to SEQ ID NO: 6294

SEQ ID NO: 6696 - DNA, 201 bp, Homo sapiens; identical to SEQ ID NO: 6295

SEQ ID NO: 6697 - DNA, 201 bp, Homo sapiens; identical to SEQ ID NO: 6296

SEQ ID NO: 6698 - DNA, 201 bp, Homo sapiens; identical to SEQ ID NO: 6297

SEQ ID NO: 6699 - DNA, 201 bp, Homo sapiens; identical to SEQ ID NO: 6298

SEQ ID NO: 6700 - DNA, 201 bp, Homo sapiens; identical to SEQ ID NO: 6299

SEQ ID NO: 6701 - DNA, 201 bp, Homo sapiens; identical to SEQ ID NO: 6300

SEQ ID NO: 6702 - DNA, 201 bp, Homo sapiens; identical to SEQ ID NO: 6301

SEQ ID NO: 6703 - DNA, 201 bp, Homo sapiens; identical to SEQ ID NO: 6302

SEQ ID NO: 6704 - DNA, 201 bp, Homo sapiens; identical to SEQ ID NO: 6303

SEQ ID NO: 6705 - DNA, 201 bp, Homo sapiens; identical to SEQ ID NO: 6304

SEQ ID NO: 6706 - DNA, 201 bp, Homo sapiens; identical to SEQ ID NO: 6305

SEQ ID NO: 6707 - DNA, 201 bp, Homo sapiens; identical to SEQ ID NO: 6306

SEQ ID NO: 6708 - DNA, 201 bp, Homo sapiens; identical to SEQ ID NO: 6307

SEQ ID NO: 6709 - DNA, 201 bp, Homo sapiens; identical to SEQ ID NO: 6308

SEQ ID NO: 6710 - DNA, 201 bp, Homo sapiens; identical to SEQ ID NO: 6309

SEQ ID NO: 6711 - DNA, 201 bp, Homo sapiens; identical to SEQ ID NO: 6310

SEQ ID NO: 6712 - DNA, 201 bp, Homo sapiens; identical to SEQ ID NO: 6311

SEQ ID NO: 6713 - DNA, 201 bp, Homo sapiens; identical to SEQ ID NO: 6312

SEQ ID NO: 6714 - DNA, 201 bp, Homo sapiens; identical to SEQ ID NO: 6313

SEQ ID NO: 6715 - DNA, 201 bp, Homo sapiens; identical to SEQ ID NO: 6314

SEQ ID NO: 6716 - DNA, 201 bp, Homo sapiens; identical to SEQ ID NO: 6316

SEQ ID NO: 6717 - DNA, 201 bp, Homo sapiens; identical to SEQ ID NO: 6315

SEQ ID NO: 6718 - DNA, 201 bp, Homo sapiens; identical to SEQ ID NO: 6317

SEQ ID NO: 6719 - DNA, 201 bp, Homo sapiens; identical to SEQ ID NO: 6318

SEQ ID NO: 6720 - DNA, 201 bp, Homo sapiens; identical to SEQ ID NO: 6319

SEQ ID NO: 6721 - DNA, 201 bp, Homo sapiens; identical to SEQ ID NO: 6320

SEQ ID NO: 6722 - DNA, 201 bp, Homo sapiens; identical to SEQ ID NO: 6321

SEQ ID NO: 6723 - DNA, 201 bp, Homo sapiens; identical to SEQ ID NO: 6322

SEQ ID NO: 6724 - DNA, 201 bp, Homo sapiens; identical to SEQ ID NO: 6323

SEQ ID NO: 6725 - DNA, 201 bp, Homo sapiens; identical to SEQ ID NO: 6324

SEQ ID NO: 6726 - DNA, 201 bp, Homo sapiens; identical to SEQ ID NO: 6325

SEQ ID NO: 6727 - DNA, 201 bp, Homo sapiens; identical to SEQ ID NO: 6326

SEQ ID NO: 6728 - DNA, 201 bp, Homo sapiens; identical to SEQ ID NO: 6327

SEQ ID NO: 6729 - DNA, 201 bp, Homo sapiens; identical to SEQ ID NO: 6328

SEQ ID NO: 6730 - DNA, 201 bp, Homo sapiens; identical to SEQ ID NO: 6329

SEQ ID NO: 6731 - DNA, 201 bp, Homo sapiens; identical to SEQ ID NO: 6330

SEQ ID NO: 6732 - DNA, 201 bp, Homo sapiens; identical to SEQ ID NO: 6331

SEQ ID NO: 6733 - DNA, 201 bp, Homo sapiens; identical to SEQ ID NO: 6332

SEQ ID NO: 6734 - DNA, 201 bp, Homo sapiens; identical to SEQ ID NO: 6333

SEQ ID NO: 6735 - DNA, 201 bp, Homo sapiens; identical to SEQ ID NO: 6334

SEQ ID NO: 6736 - DNA, 201 bp, Homo sapiens; identical to SEQ ID NO: 6335

SEQ ID NO: 6737 - DNA, 201 bp, Homo sapiens; identical to SEQ ID NO: 6336

SEQ ID NO: 6738 - DNA, 201 bp, Homo sapiens; identical to SEQ ID NO: 6337

SEQ ID NO: 6739 - DNA, 201 bp, Homo sapiens; identical to SEQ ID NO: 6338

SEQ ID NO: 6740 - DNA, 201 bp, Homo sapiens; identical to SEQ ID NO: 6339

SEQ ID NO: 6741 - DNA, 201 bp, Homo sapiens; identical to SEQ ID NO: 6341

SEQ ID NO: 6742 - DNA, 201 bp, Homo sapiens; identical to SEQ ID NO: 6340

SEQ ID NO: 6743 - DNA, 201 bp, Homo sapiens; identical to SEQ ID NO: 6343

SEQ ID NO: 6744 - DNA, 201 bp, Homo sapiens; identical to SEQ ID NO: 6342

SEQ ID NO: 6745 - DNA, 201 bp, Homo sapiens; identical to SEQ ID NO: 6344

SEQ ID NO: 6746 - DNA, 201 bp, Homo sapiens; identical to SEQ ID NO: 6345

SEQ ID NO: 6747 - DNA, 201 bp, Homo sapiens; identical to SEQ ID NO: 6346

SEQ ID NO: 6748 - DNA, 201 bp, Homo sapiens; identical to SEQ ID NO: 6347

SEQ ID NO: 6749 - DNA, 201 bp, Homo sapiens; identical to SEQ ID NO: 6348

SEQ ID NO: 6750 - DNA, 201 bp, Homo sapiens; identical to SEQ ID NO: 6349

SEQ ID NO: 6751 - DNA, 201 bp, Homo sapiens; identical to SEQ ID NO: 6350

SEQ ID NO: 6752 - DNA, 201 bp, Homo sapiens; identical to SEQ ID NO: 6351

SEQ ID NO: 6753 - DNA, 201 bp, Homo sapiens; identical to SEQ ID NO: 6352

SEQ ID NO: 6754 - DNA, 201 bp, Homo sapiens; identical to SEQ ID NO: 6353

SEQ ID NO: 6755 - DNA, 201 bp, Homo sapiens; identical to SEQ ID NO: 6354

SEQ ID NO: 6756 - DNA, 201 bp, Homo sapiens; identical to SEQ ID NO: 6355

SEQ ID NO: 6757 - DNA, 201 bp, Homo sapiens; identical to SEQ ID NO: 6356

SEQ ID NO: 6758 - DNA, 201 bp, Homo sapiens; identical to SEQ ID NO: 6357

SEQ ID NO: 6759 - DNA, 201 bp, Homo sapiens; identical to SEQ ID NO: 6358

SEQ ID NO: 6760 - DNA, 201 bp, Homo sapiens; identical to SEQ ID NO: 6359

SEQ ID NO: 6761 - DNA, 201 bp, Homo sapiens; identical to SEQ ID NO: 6360

SEQ ID NO: 6762 - DNA, 201 bp, Homo sapiens; identical to SEQ ID NO: 6361

SEQ ID NO: 6763 - DNA, 201 bp, Homo sapiens; identical to SEQ ID NO: 6362

SEQ ID NO: 6764 - DNA, 201 bp, Homo sapiens; identical to SEQ ID NO: 6363

SEQ ID NO: 6765 - DNA, 201 bp, Homo sapiens; identical to SEQ ID NO: 6364

SEQ ID NO: 6766 - DNA, 201 bp, Homo sapiens; identical to SEQ ID NO: 6365

SEQ ID NO: 6767 - DNA, 201 bp, Homo sapiens; identical to SEQ ID NO: 6366

SEQ ID NO: 6768 - DNA, 201 bp, Homo sapiens; identical to SEQ ID NO: 6367

SEQ ID NO: 6769 - DNA, 201 bp, Homo sapiens; identical to SEQ ID NO: 6368

SEQ ID NO: 6770 - DNA, 201 bp, Homo sapiens; identical to SEQ ID NO: 6369

SEQ ID NO: 6771 - DNA, 201 bp, Homo sapiens; identical to SEQ ID NO: 6370

SEQ ID NO: 6772 - DNA, 201 bp, Homo sapiens; identical to SEQ ID NO: 6371

SEQ ID NO: 6773 - DNA, 201 bp, Homo sapiens; identical to SEQ ID NO: 6373

SEQ ID NO: 6774 - DNA, 201 bp, Homo sapiens; identical to SEQ ID NO: 6372

SEQ ID NO: 6775 - DNA, 201 bp, Homo sapiens; identical to SEQ ID NO: 6374

SEQ ID NO: 6776 - DNA, 201 bp, Homo sapiens; identical to SEQ ID NO: 6375

SEQ ID NO: 6777 - DNA, 201 bp, Homo sapiens
tactccaccactgtcacaggaagaacttgccaagcttggtcatctatgacaccacaccagcatagtcggaccccagaaaactacccaaatgctggcctgascaggaactactgcaggaatccagatgctgagattcgcccttggtgttacaccatggatcccagtgtcaggtgggagtactgcaacctgacacaatgcctg

SEQ ID NO: 6778 - DNA, 201 bp, Homo sapiens
tgtttgggaatgggaaaggataccggggcaagaaggcaaccactgttactgggacgccatgccaggaatgggctgcccaggagccccatagacacagcacrttcattccagggacaaataaatgggcaggtctggaaaaaaattactgccgtaaccctgatggtgacatcaatggtccctggtgctacacaatgaatccaa

SEQ ID NO: 6779 - DNA, 201 bp, Homo sapiens
caccggcatcagaggaccccagaaaactacccaaatgatggcctgacaatgaactactgcaggaatccagatgccgatacaggcccttggtgttttaccayggaccccagcatcaggtgggagtactgcaacctgacgcgatgctcagacacagaagggactgtggtcgctcctccgactgtcatccaggttccaagccta

SEQ ID NO: 6780 - DNA, 201 bp, Homo sapiens
agggcctccttctgaacaagactgtatgtttgggaatgggaaaggataccggggcaagaaggcaaccactgttactgggacgccatgccaggaatgggctkcccaggagccccatagacacagcacgttcattccagggacaaataaatgggcaggtctggaaaaaaattactgccgtaaccctgatggtgacatcaatgg

SEQ ID NO: 6781 - DNA, 201 bp, Homo sapiens
cactgacagttgccagggtgacagtggagggcctctggtttgcttcgagaaggacaaatacattttacaaggagtcacttcttggggtcttggctgtgcaygccccaataagcctggtgtctatgctcgtgtttcaaggtttgttacttggattgagggaatgatgagaaataattaattggacgggagacagagtgaagc

SEQ ID NO: 6782 - DNA, 201 bp, Homo sapiens
ggattgctaccatggtgatggacggagttatcgaggcatatcctccaccactgtcacaggaaggacctgtcaatcttggtcatctatgataccacactggyatcagaggaccccagaaaactacccaaatgctggcctgaccgagaactactgcaggaatccagattctgggaaacaaccctggtgttacacaaccgatcc

SEQ ID NO: 6783 - DNA, 201 bp, Homo sapiens
gaatccagatgctgagattcgcccttggtgttataccatggatcccagtgtcagatgggagtactgcaacctgacgcaatgtccagtgatggaatcaactstcctcacaactcccacggtggtcccagttccaagcacagagcttccttctgaagaagcaccaactgaaaacagcactggggtccaggactgctaccgagg

SEQ ID NO: 6784 - DNA, 201 bp, Homo sapiens
agtactgcaacctgacgcgatgctcagacacagaagggactgtggtcgctcctccgactgtcatccaggttccaagcctagggcctccttctgaacaagaytgtatgtttgggaatgggaaaggataccggggcaagaaggcaaccactgttactgggacgccatgccaggaatgggctgcccaggagccccatagacaca

SEQ ID NO: 6785 - DNA, 201 bp, Homo sapiens
gtggcctgaccaggaactactgcaggaatccagatgctgagattcgcccttggtgttataccatggatcccagtgtcagatgggagtactgcaacctgacrcaatgtccagtgatggaatcaactctcctcacaactcccacggtggtcccagttccaagcacagagcttccttctgaagaagcaccaactgaaaacagca

SEQ ID NO: 6786 - DNA, 201 bp, Homo sapiens
cccagttccaagcacagagcttccttctgaagaagcaccaactgaaaacagcactggggtccaggactgctaccgaggtgatggacagagttatcgaggcmcactctccaccactatcacaggaagaacatgtcagtcttggtcgtctatgacaccacattggcatcggaggatcccattatactatccaaatgctggcct

SEQ ID NO: 6787 - DNA, 201 bp, Homo sapiens
gagcaaagccccggggtccaggattgctaccatggtgatggacagagttatcgaggctcattctctaccactgtcacaggaaggacatgtcagtcttggtyctctatgacaccacactggcatcagaggacaacagaatattatccaaatggtggcctgaccaggaactactgcaggaatccagatgctgagattagtcct

SEQ ID NO: 6788 - DNA, 201 bp, Homo sapiens
cacaactcccacggtggtcccagttccaagcacagagcttccttctgaagaagcaccaactgaaaacagcactggggtccaggactgctaccgaggtgatrgacagagttatcgaggcacactctccaccactatcacaggaagaacatgtcagtcttggtcgtctatgacaccacattggcatcggaggatcccattata

SEQ ID NO: 6789 - DNA, 201 bp, Homo sapiens
aactcccacagtggccccggttccaagcacagaggctccttctgaacaagcaccacctgagaaaagccctgtggtccaggattgctaccatggtgatggayggagttatcgaggcatatcctccaccactgtcacaggaaggacctgtcaatcttggtcatctatgataccacactggcatcagaggaccccagaaaacta

SEQ ID NO: 6790 - DNA, 201 bp, Homo sapiens
ctttttgactactgtgatatccctctctgtgcatcctcttcatttgattgtgggaagcctcaagtggagccgaagaaatgtcctggaagcattgtaggggkgtgtgtggcccacccacattcctggccctggcaagtcagtctcagaacaaggtttggaaagcacttctgtggaggcaccttaatatccccagagtgggtg

SEQ ID NO: 6791 - DNA, 201 bp, Homo sapiens
cgaggcacactctccaccactatcacaggaagaacatgtcagtcttggtcgtctatgacaccacattggcatcggaggatcccattatactatccaaatgrtggcctgaccaggaactactgcaggaatccagatgctgagattcgcccttggtgttacaccatggatcccagtgtcaggtgggagtactgcaacctgaca

SEQ ID NO: 6792 - DNA, 201 bp, Homo sapiens
ctgtggtcgctcctccgactgtcatccaggttccaagcctagggcctccttctgaacaagactgtatgtttgggaatgggaaaggataccggggcaagaargcaaccactgttactgggacgccatgccaggaatgggctgcccaggagccccatagacacagcacgttcattccagggacaaataaatgggcaggtctgg

SEQ ID NO: 6793 - DNA, 201 bp, Homo sapiens
gttacaccatggatcccagtgtcaggtgggagtactgcaacctgacacaatgcctggtgacagaatcaagtgtccttgcaactctcacggtggtcccagayccaagcacagaggcttcttctgaagaagcaccaacggagcaaagccccggggtccaggattgctaccatggtgatggacagagttatcgaggctcattct

SEQ ID NO: 6794 - DNA, 201 bp, Homo sapiens
aaactttttgactactgtgatatccctctctgtgcatcctcttcatttgattgtgggaagcctcaagtggagccgaagaaatgtcctggaagcattgtagsggggtgtgtggcccacccacattcctggccctggcaagtcagtctcagaacaaggtttggaaagcacttctgtggaggcaccttaatatccccagagtgg

SEQ ID NO: 6795 - DNA, 201 bp, Homo sapiens
accgatccgtgtgtgaggtgggagtactgcaatctgacacaatgctcagaaacagaatcaggtgtcctagagactcccactgttgttccagttccaagcayggaggctcattctgaagcagcaccaactgagcaaacccctgtggtccggcagtgctaccatggtaatggccagagttatcgaggcacattctccaccact

SEQ ID NO: 6796 - DNA, 201 bp, Homo sapiens
tcccagtgtcagatgggagtactgcaacctgacgcaatgtccagtgatggaatcaactctcctcacaactcccacggtggtcccagttccaagcacagagsttccttctgaagaagcaccaactgaaaacagcactggggtccaggactgctaccgaggtgatggacagagttatcgaggcacactctccaccactatcac

SEQ ID NO: 6797 - DNA, 201 bp, Homo sapiens
ctgctgctcactgcttgaagaagtcctcaaggccttcatcctacaaggtcatcctgggtgcacaccaagaagtgaacctcgaatctcatgttcaggaaatrgaagtgtctaggctgttcttggagcccacacaagcagatattgccttgctaaagctaagcaggcctgccgtcatcactgacaaagtaatgccagcttgtc

SEQ ID NO: 6798 - DNA, 201 bp, Homo sapiens; identical to SEQ ID NO: 6781

SEQ ID NO: 6799 - DNA, 201 bp, Homo sapiens; identical to SEQ ID NO: 6784

SEQ ID NO: 6800 - DNA, 201 bp, Homo sapiens; identical to SEQ ID NO: 6782

SEQ ID NO: 6801 - DNA, 201 bp, Homo sapiens; identical to SEQ ID NO: 6779

SEQ ID NO: 6802 - DNA, 201 bp, Homo sapiens; identical to SEQ ID NO: 6785

SEQ ID NO: 6803 - DNA, 201 bp, Homo sapiens; identical to SEQ ID NO: 6793

SEQ ID NO: 6804 - DNA, 201 bp, Homo sapiens; identical to SEQ ID NO: 6780

SEQ ID NO: 6805 - DNA, 201 bp, Homo sapiens; identical to SEQ ID NO: 6796

SEQ ID NO: 6806 - DNA, 201 bp, Homo sapiens; identical to SEQ ID NO: 6777

SEQ ID NO: 6807 - DNA, 201 bp, Homo sapiens; identical to SEQ ID NO: 6787

SEQ ID NO: 6808 - DNA, 201 bp, Homo sapiens; identical to SEQ ID NO: 6788

SEQ ID NO: 6809 - DNA, 201 bp, Homo sapiens; identical to SEQ ID NO: 6789

SEQ ID NO: 6810 - DNA, 201 bp, Homo sapiens; identical to SEQ ID NO: 6792

SEQ ID NO: 6811 - DNA, 201 bp, Homo sapiens; identical to SEQ ID NO: 6783

SEQ ID NO: 6812 - DNA, 201 bp, Homo sapiens; identical to SEQ ID NO: 6791

SEQ ID NO: 6813 - DNA, 201 bp, Homo sapiens; identical to SEQ ID NO: 6786

SEQ ID NO: 6814 - DNA, 201 bp, Homo sapiens; identical to SEQ ID NO: 6795

SEQ ID NO: 6815 - DNA, 201 bp, Homo sapiens; identical to SEQ ID NO: 6797

SEQ ID NO: 6816 - DNA, 201 bp, Homo sapiens; identical to SEQ ID NO: 6778

SEQ ID NO: 6817 - DNA, 201 bp, Homo sapiens; identical to SEQ ID NO: 6790

SEQ ID NO: 6818 - DNA, 201 bp, Homo sapiens; identical to SEQ ID NO: 6794

SEQ ID NO: 6819 - DNA, 201 bp, Homo sapiens
aaagcccaacaccttcccccactggattgactacagcaaagatgcccagtgttccactttcaagtgaccccttacctactcacaccactgcattctcaccsgcaagcacctttgaaagagaaaatgacttctcagagaccacaacttctcttagtccagacaatacttccacccaagtatccccggactctttggataatg

SEQ ID NO: 6820 - DNA, 201 bp, Homo sapiens
cacgagtggcactgaggggccagaacattctgtcaatggtcctgcaagtccagctttaaatcaaggttcataggaaaagacataaatgaggaaactccaamcctcctgttagctgttatttctatttttgtagaagtaggaagtgaaaataggtatacagtggattaattaaatgcagcgaaccaatatttgtagaagggt

SEQ ID NO: 6821 - DNA, 201 bp, Homo sapiens
cacagaagtatttgtgacagggcaaagcccaacaccttcccccactggattgactacagcaaagatgcccagtgttccactttcaagtgaccccttacctrctcacaccactgcattctcacccgcaagcacctttgaaagagaaaatgacttctcagagaccacaacttctcttagtccagacaatacttccacccaagt

SEQ ID NO: 6822 - DNA, 201 bp, Homo sapiens
tgatttgggaacagaaagccacagttattgtcatggtcactcgatgtgaagaaggaaacaggaacaagtgtgcagaatactggccgtcaatggaagagggyactcgggcttttggagatgttgttgtaaagatcaaccagcacaaaagatgtccagattacatcattcagaaattgaacattgtaaataaaaaagaaaaag

SEQ ID NO: 6823 - DNA, 201 bp, Homo sapiens
tttggataatgctagtgcttttaataccacaggtgtttcatcagtacagacgcctcaccttcccacgcacgcagactcgcagacgccctctgctggaactsacacgcagacattcagcggctccgccgccaatgcaaaactcaaccctaccccaggcagcaatgctatctcagatgtcccaggagagaggagtacagccag

SEQ ID NO: 6824 - DNA, 201 bp, Homo sapiens
tacagacccagtttccccattgacaaccaccctcagccttgcacaccacagctctgctgccttacctgcacgcacctccaacaccaccatcacagcgaacrcctcagatgcctaccttaatgcctctgaaacaaccactctgagcccttctggaagcgctgtcatttcaaccacaacaatagctactactccatctaagcc

SEQ ID NO: 6825 - DNA, 201 bp, Homo sapiens
caatacttgcacaaacaatgaggtgcataaccttacagaatgtaaaaatgcgtctgtttccatatctcataattcatgtactgctcctgataagacattamtattagatgtgccaccaggggttgaaaagtttcagttacatgattgtacacaagttgaaaaagcagatactactatttgtttaaaatggaaaaatattga

SEQ ID NO: 6826 - DNA, 201 bp, Homo sapiens
attgtacacaagttgaaaaagcagatactactatttgtttaaaatggaaaaatattgaaacctttacttgtgatacacagaatattacctacagatttcartgtggtaatatgatatttgataataaagaaattaaattagaaaaccttgaacccgaacatgagtataagtgtgactcagaaatactctataataaccaca

SEQ ID NO: 6827 - DNA, 201 bp, Homo sapiens
gggagtccaggagagcctcagattattttttgtagaagtgaagctgcacatcaaggagtaattacctggaatccccctcaaagatcatttcataattttaycctctgttatataaaagagacagaaaaagattgcctcaatctggataaaaacctgatcaaatatgatttgcaaaatttaaaaccttatacgaaatatgtt

SEQ ID NO: 6828 - DNA, 201 bp, Homo sapiens
gcacctaccctgctcagaatggacaagtaaagaaaaacaaccatcaagaagataaaattgaatttgataatgaagtggacaaagtaaagcaggatgctaaytgtgttaatccacttggtgccccagaaaagctccctgaagcaaaggaacaggctgaaggttctgaacccacgagtggcactgaggggccagaacattctg

SEQ ID NO: 6829 - DNA, 201 bp, Homo sapiens; identical to SEQ ID NO: 6825

SEQ ID NO: 6830 - DNA, 201 bp, Homo sapiens; identical to SEQ ID NO: 6819

SEQ ID NO: 6831 - DNA, 201 bp, Homo sapiens; identical to SEQ ID NO: 6826

SEQ ID NO: 6832 - DNA, 201 bp, Homo sapiens; identical to SEQ ID NO: 6820

SEQ ID NO: 6833 - DNA, 201 bp, Homo sapiens; identical to SEQ ID NO: 6827

SEQ ID NO: 6834 - DNA, 201 bp, Homo sapiens; identical to SEQ ID NO: 6828

SEQ ID NO: 6835 - DNA, 201 bp, Homo sapiens; identical to SEQ ID NO: 6821

SEQ ID NO: 6836 - DNA, 201 bp, Homo sapiens; identical to SEQ ID NO: 6822

SEQ ID NO: 6837 - DNA, 201 bp, Homo sapiens
tttggataatgctagtgcttttaataccacaggtgtttcatcagtacagacgcctcaccttcccacgcacgcagactcgcagacgccctctgctggaactsacacgcagacattcagcggctccgccgccaatgcaaaactcaaccctaccccaggcagcaatgctatctcagatgcctaccttaatgcctctgaaacaac

SEQ ID NO: 6838 - DNA, 201 bp, Homo sapiens; identical to SEQ ID NO: 6825

SEQ ID NO: 6839 - DNA, 201 bp, Homo sapiens; identical to SEQ ID NO: 6826

SEQ ID NO: 6840 - DNA, 201 bp, Homo sapiens; identical to SEQ ID NO: 6820

SEQ ID NO: 6841 - DNA, 201 bp, Homo sapiens; identical to SEQ ID NO: 6827

SEQ ID NO: 6842 - DNA, 201 bp, Homo sapiens; identical to SEQ ID NO: 6828

SEQ ID NO: 6843 - DNA, 201 bp, Homo sapiens; identical to SEQ ID NO: 6822

SEQ ID NO: 6844 - DNA, 201 bp, Homo sapiens; identical to SEQ ID NO: 6825

SEQ ID NO: 6845 - DNA, 201 bp, Homo sapiens; identical to SEQ ID NO: 6819

SEQ ID NO: 6846 - DNA, 201 bp, Homo sapiens; identical to SEQ ID NO: 6826

SEQ ID NO: 6847 - DNA, 201 bp, Homo sapiens; identical to SEQ ID NO: 6820

SEQ ID NO: 6848 - DNA, 201 bp, Homo sapiens; identical to SEQ ID NO: 6827

SEQ ID NO: 6849 - DNA, 201 bp, Homo sapiens; identical to SEQ ID NO: 6828

SEQ ID NO: 6850 - DNA, 181 bp, Homo sapiens
ggcaaagcccaacaccttcccccactggattgactacagcaaagatgcccagtgttccactttcaagtgaccccttacctrctcacaccactgcattctcacccgcaagcacctttgaaagagaaaatgacttctcagagaccacaacttctcttagtccagacaatacttccacccaagt

SEQ ID NO: 6851 - DNA, 201 bp, Homo sapiens; identical to SEQ ID NO: 6822

SEQ ID NO: 6852 - DNA, 201 bp, Homo sapiens; identical to SEQ ID NO: 6837

SEQ ID NO: 6853 - DNA, 201 bp, Homo sapiens; identical to SEQ ID NO: 6819

SEQ ID NO: 6854 - DNA, 201 bp, Homo sapiens; identical to SEQ ID NO: 6820

SEQ ID NO: 6855 - DNA, 181 bp, Homo sapiens; identical to SEQ ID NO: 6850

SEQ ID NO: 6856 - DNA, 201 bp, Homo sapiens; identical to SEQ ID NO: 6822

SEQ ID NO: 6857 - DNA, 201 bp, Homo sapiens; identical to SEQ ID NO: 6823

SEQ ID NO: 6858 - DNA, 201 bp, Homo sapiens; identical to SEQ ID NO: 6824

SEQ ID NO: 6859 - DNA, 201 bp, Homo sapiens; identical to SEQ ID NO: 6825

SEQ ID NO: 6860 - DNA, 201 bp, Homo sapiens; identical to SEQ ID NO: 6826

SEQ ID NO: 6861 - DNA, 201 bp, Homo sapiens; identical to SEQ ID NO: 6827

SEQ ID NO: 6862 - DNA, 201 bp, Homo sapiens; identical to SEQ ID NO: 6828

SEQ ID NO: 6863 - DNA, 201 bp, Homo sapiens; identical to SEQ ID NO: 6819

SEQ ID NO: 6864 - DNA, 201 bp, Homo sapiens; identical to SEQ ID NO: 6823

SEQ ID NO: 6865 - DNA, 201 bp, Homo sapiens; identical to SEQ ID NO: 6824

SEQ ID NO: 6866 - DNA, 201 bp, Homo sapiens; identical to SEQ ID NO: 6828

SEQ ID NO: 6867 - DNA, 201 bp, Homo sapiens; identical to SEQ ID NO: 6827

SEQ ID NO: 6868 - DNA, 201 bp, Homo sapiens; identical to SEQ ID NO: 6822

SEQ ID NO: 6869 - DNA, 201 bp, Homo sapiens; identical to SEQ ID NO: 6820

SEQ ID NO: 6870 - DNA, 201 bp, Homo sapiens; identical to SEQ ID NO: 6821

SEQ ID NO: 6871 - DNA, 201 bp, Homo sapiens; identical to SEQ ID NO: 6826

SEQ ID NO: 6872 - DNA, 201 bp, Homo sapiens; identical to SEQ ID NO: 6825

SEQ ID NO: 6873 - DNA, 201 bp, Homo sapiens
acctgcaggtatgggttcatagaagggcacgtggtgattccccggatccaccccaactccatctgtgcagcaaacaacacaggggtgtacatcctcacatmcaacacctcccagtatgacacatattgcttcaatgcttcagctccacctgaagaagattgtacatcagtcacagacctgcccaatgcctttgatggacca

SEQ ID NO: 6874 - DNA, 201 bp, Homo sapiens
ttcacaaacccttgcaacattgcctgaagtttatggaataagatgtattctcactcccttgatctcaagggcgtaactctggaagcacagcttgactacaygtcatttttaccaatgattttcaggtgacctgggctaagtcatttaaactgggtctttataaaagtaaaaggccaacatttaattattttgcaaagcaac

SEQ ID NO: 6875 - DNA, 201 bp, Homo sapiens
aatgaagatgaaagagacagacacctcagtttttctggatcaggcattgatgatgatgaagattttatctccagcaccaatatggactccagtcatagtayaacgcttcagcctactgcaaatccaaacacaggtttggtggaagatttggacaggacaggacctctttcaatgacaacgcagcagagtaattctcagagc

SEQ ID NO: 6876 - DNA, 201 bp, Homo sapiens
aaacataaccattacagggagctgggacacttaacagatgcaatgtgctactgattgtttcattgcgaatcttttttagcataaaattttctactcttttygttttttgtgttttgttctttaaagtcaggtccaatttgtaaaaacagcattgctttctgaaattagggcccaattaataatcagcaagaatttgatcgt

SEQ ID NO: 6877 - DNA, 201 bp, Homo sapiens
aacttatgtgcttaacaggcaatgcttctcagaccacaaagcagaaagaagaagaaaagctcctgactaaatcagggctgggcttagacagagttgatctrtagaatatctttaaaggagagatgtcaactttctgcactattcccagcctctgctcctccctgtctaccctctcccctccctctctccctccacttcacc

SEQ ID NO: 6878 - DNA, 201 bp, Homo sapiens
tctgcaaggctttcaatagcaccttgcccacaatggcccagatggagaaagctctgagcatcggatttgagacctgcaggtatgggttcatagaagggcaygtggtgattccccggatccaccccaactccatctgtgcagcaaacaacacaggggtgtacatcctcacatccaacacctcccagtatgacacatattgct

SEQ ID NO: 6879 - DNA, 201 bp, Homo sapiens
ccacgtccctggcagccccgattatttacagcctcagcagagcacggggcgggggcagaggggcccgcccgggagggctgctacttcttaaaacctctgckggctgcttagtcacagccccccttgcttgggtgtgtccttcgctcgctccctccctccgtcttaggtcactgttttcaacctcgaataaaaactgcagcc

SEQ ID NO: 6880 - DNA, 201 bp, Homo sapiens
accagctaaggacatttcccagggttaatagggcctggtccctgggaggaaatttgaatgggtccattttgcccttccatagcctaatccctgggcattgytttccactgaggttgggggttggggtgtactagttacacatcttcaacagaccccctctagaaatttttcagatgcttctgggagacacccaaagggtga

SEQ ID NO: 6881 - DNA, 201 bp, Homo sapiens
gttggaaacataaccattacagggagctgggacacttaacagatgcaatgtgctactgattgtttcattgcgaatcttttttagcataaaattttctactytttttgttttttgtgttttgttctttaaagtcaggtccaatttgtaaaaacagcattgctttctgaaattagggcccaattaataatcagcaagaatttg

SEQ ID NO: 6882 - DNA, 201 bp, Homo sapiens
ccctgggaggaaatttgaatgggtccattttgcccttccatagcctaatccctgggcattgctttccactgaggttgggggttggggtgtactagttacayatcttcaacagaccccctctagaaatttttcagatgcttctgggagacacccaaagggtgaagctatttatctgtagtaaactatttatctgtgtttttg

SEQ ID NO: 6883 - DNA, 201 bp, Homo sapiens; identical to SEQ ID NO: 6873

SEQ ID NO: 6884 - DNA, 201 bp, Homo sapiens; identical to SEQ ID NO: 6874

SEQ ID NO: 6885 - DNA, 201 bp, Homo sapiens
accttttctactgtacaccccatcccagacgaagacagtccctggatcaccgacagcacagacagaatccctgctaccaatatggactccagtcatagtayaacgcttcagcctactgcaaatccaaacacaggtttggtggaagatttggacaggacaggacctctttcaatgacaacgcagcagagtaattctcagagc

SEQ ID NO: 6886 - DNA, 201 bp, Homo sapiens; identical to SEQ ID NO: 6876

SEQ ID NO: 6887 - DNA, 201 bp, Homo sapiens; identical to SEQ ID NO: 6877

SEQ ID NO: 6888 - DNA, 201 bp, Homo sapiens; identical to SEQ ID NO: 6878

SEQ ID NO: 6889 - DNA, 201 bp, Homo sapiens; identical to SEQ ID NO: 6879

SEQ ID NO: 6890 - DNA, 201 bp, Homo sapiens; identical to SEQ ID NO: 6880

SEQ ID NO: 6891 - DNA, 201 bp, Homo sapiens; identical to SEQ ID NO: 6881

SEQ ID NO: 6892 - DNA, 201 bp, Homo sapiens; identical to SEQ ID NO: 6882

SEQ ID NO: 6893 - DNA, 201 bp, Homo sapiens; identical to SEQ ID NO: 6873

SEQ ID NO: 6894 - DNA, 201 bp, Homo sapiens
aaggaacagtggtttggcaacagatggcatgagggatatcgccaaacacccagagaagactcccattcgacaacagggacagctgcagcctcagctcatamcagccatccaatgcaaggaaggacaacaccaagcccagaggacagttcctggactgatttcttcaacccaatctcacaccccatgggacgaggtcatcaa

SEQ ID NO: 6895 - DNA, 201 bp, Homo sapiens; identical to SEQ ID NO: 6874

SEQ ID NO: 6896 - DNA, 201 bp, Homo sapiens
gaggacagttcctggactgatttcttcaacccaatctcacaccccatgggacgaggtcatcaagcaggaagaaggatggatatggactccagtcatagtayaacgcttcagcctactgcaaatccaaacacaggtttggtggaagatttggacaggacaggacctctttcaatgacaacgcagcagagtaattctcagagc

SEQ ID NO: 6897 - DNA, 201 bp, Homo sapiens
tcaccgacagcacagacagaatccctgctaccactttgatgagcactagtgctacagcaactgagacagcaaccaagaggcaagaaacctgggattggttytcatggttgtttctaccatcagagtcaaagaatcatcttcacacaacaacacaaatggctggtacgtcttcaaataccatctcagcaggctgggagccaa

SEQ ID NO: 6898 - DNA, 201 bp, Homo sapiens
caagcacaatccaggcaactcctagtagtacaacggaagaaacagctacccagaaggaacagtggtttggcaacagatggcatgagggatatcgccaaacmcccagagaagactcccattcgacaacagggacagctgcagcctcagctcataccagccatccaatgcaaggaaggacaacaccaagcccagaggacagtt

SEQ ID NO: 6899 - DNA, 201 bp, Homo sapiens; identical to SEQ ID NO: 6876

SEQ ID NO: 6900 - DNA, 201 bp, Homo sapiens; identical to SEQ ID NO: 6877

SEQ ID NO: 6901 - DNA, 201 bp, Homo sapiens
tttctggatcaggcattgatgatgatgaagattttatctccagcaccatttcaaccacaccacgggcttttgaccacacaaaacagaaccaggactggacycagtggaacccaagccattcaaatccggaagtgctacttcagacaaccacaaggatgactgatgtagacagaaatggcaccactgcttatgaaggaaact

SEQ ID NO: 6902 - DNA, 201 bp, Homo sapiens
acaatccaggcaactcctagtagtacaacggaagaaacagctacccagaaggaacagtggtttggcaacagatggcatgagggatatcgccaaacacccaragaagactcccattcgacaacagggacagctgcagcctcagctcataccagccatccaatgcaaggaaggacaacaccaagcccagaggacagttcctgg

SEQ ID NO: 6903 - DNA, 201 bp, Homo sapiens
ccacaaggatgactgatgtagacagaaatggcaccactgcttatgaaggaaactggaacccagaagcacaccctcccctcattcaccatgagcatcatgargaagaagagaccccacattctacaagcacaatccaggcaactcctagtagtacaacggaagaaacagctacccagaaggaacagtggtttggcaacagat

SEQ ID NO: 6904 - DNA, 201 bp, Homo sapiens; identical to SEQ ID NO: 6878

SEQ ID NO: 6905 - DNA, 201 bp, Homo sapiens; identical to SEQ ID NO: 6879

SEQ ID NO: 6906 - DNA, 201 bp, Homo sapiens; identical to SEQ ID NO: 6880

SEQ ID NO: 6907 - DNA, 201 bp, Homo sapiens; identical to SEQ ID NO: 6882

SEQ ID NO: 6908 - DNA, 201 bp, Homo sapiens
aacccagaagcacaccctcccctcattcaccatgagcatcatgaggaagaagagaccccacattctacaagcacaatccaggcaactcctagtagtacaayggaagaaacagctacccagaaggaacagtggtttggcaacagatggcatgagggatatcgccaaacacccagagaagactcccattcgacaacagggaca

SEQ ID NO: 6909 - DNA, 201 bp, Homo sapiens; identical to SEQ ID NO: 6881

SEQ ID NO: 6910 - DNA, 201 bp, Homo sapiens; identical to SEQ ID NO: 6873

SEQ ID NO: 6911 - DNA, 201 bp, Homo sapiens
ggaaactggaacccagaagcacaccctcccctcattcaccatgagcatcatgaggaagaagagaccccacattctacaagcacaacagcctcagctcatamcagccatccaatgcaaggaaggacaacaccaagcccagaggacagttcctggactgatttcttcaacccaatctcacaccccatgggacgaggtcatcaa

SEQ ID NO: 6912 - DNA, 201 bp, Homo sapiens; identical to SEQ ID NO: 6874

SEQ ID NO: 6913 - DNA, 201 bp, Homo sapiens; identical to SEQ ID NO: 6896

SEQ ID NO: 6914 - DNA, 201 bp, Homo sapiens
gctcctccagtgaaaggagcagcacttcaggagctttgatgagcactagtgctacagcaactgagacagcaaccaagaggcaagaaacctgggattggttytcatggttgtttctaccatcagagtcaaagaatcatcttcacacaacaacacaaatggctggtacgtcttcaaataccatctcagcaggctgggagccaa

SEQ ID NO: 6915 - DNA, 201 bp, Homo sapiens; identical to SEQ ID NO: 6876

SEQ ID NO: 6916 - DNA, 201 bp, Homo sapiens; identical to SEQ ID NO: 6877

SEQ ID NO: 6917 - DNA, 201 bp, Homo sapiens; identical to SEQ ID NO: 6901

SEQ ID NO: 6918 - DNA, 201 bp, Homo sapiens; identical to SEQ ID NO: 6879

SEQ ID NO: 6919 - DNA, 201 bp, Homo sapiens
ccacaaggatgactgatgtagacagaaatggcaccactgcttatgaaggaaactggaacccagaagcacaccctcccctcattcaccatgagcatcatgargaagaagagaccccacattctacaagcacaacagcctcagctcataccagccatccaatgcaaggaaggacaacaccaagcccagaggacagttcctgga

SEQ ID NO: 6920 - DNA, 201 bp, Homo sapiens; identical to SEQ ID NO: 6878

SEQ ID NO: 6921 - DNA, 201 bp, Homo sapiens; identical to SEQ ID NO: 6880

SEQ ID NO: 6922 - DNA, 201 bp, Homo sapiens; identical to SEQ ID NO: 6882

SEQ ID NO: 6923 - DNA, 201 bp, Homo sapiens; identical to SEQ ID NO: 6881

SEQ ID NO: 6924 - DNA, 201 bp, Homo sapiens; identical to SEQ ID NO: 6873

SEQ ID NO: 6925 - DNA, 201 bp, Homo sapiens; identical to SEQ ID NO: 6874

SEQ ID NO: 6926 - DNA, 201 bp, Homo sapiens; identical to SEQ ID NO: 6877

SEQ ID NO: 6927 - DNA, 201 bp, Homo sapiens; identical to SEQ ID NO: 6878

SEQ ID NO: 6928 - DNA, 201 bp, Homo sapiens; identical to SEQ ID NO: 6879

SEQ ID NO: 6929 - DNA, 201 bp, Homo sapiens; identical to SEQ ID NO: 6880

SEQ ID NO: 6930 - DNA, 201 bp, Homo sapiens
gttggaaacataaccattacagggagctgggacacttaacagatgcaatgtgctactgattgtttcattgcgaatcttttttagcataaaattttctactytttcccccaccagctaaggacatttcccagggttaatagggcctggtccctgggaggaaatttgaatgggtccattttgcccttccatagcctaatccct

SEQ ID NO: 6931 - DNA, 201 bp, Homo sapiens; identical to SEQ ID NO: 6882

SEQ ID NO: 6932 - DNA, 201 bp, Homo sapiens; identical to SEQ ID NO: 6873

SEQ ID NO: 6933 - DNA, 201 bp, Homo sapiens; identical to SEQ ID NO: 6894

SEQ ID NO: 6934 - DNA, 201 bp, Homo sapiens; identical to SEQ ID NO: 6874

SEQ ID NO: 6935 - DNA, 201 bp, Homo sapiens; identical to SEQ ID NO: 6896

SEQ ID NO: 6936 - DNA, 201 bp, Homo sapiens; identical to SEQ ID NO: 6897

SEQ ID NO: 6937 - DNA, 201 bp, Homo sapiens; identical to SEQ ID NO: 6898

SEQ ID NO: 6938 - DNA, 201 bp, Homo sapiens; identical to SEQ ID NO: 6876

SEQ ID NO: 6939 - DNA, 201 bp, Homo sapiens; identical to SEQ ID NO: 6877

SEQ ID NO: 6940 - DNA, 201 bp, Homo sapiens; identical to SEQ ID NO: 6901

SEQ ID NO: 6941 - DNA, 201 bp, Homo sapiens; identical to SEQ ID NO: 6902

SEQ ID NO: 6942 - DNA, 201 bp, Homo sapiens; identical to SEQ ID NO: 6903

SEQ ID NO: 6943 - DNA, 201 bp, Homo sapiens; identical to SEQ ID NO: 6878

SEQ ID NO: 6944 - DNA, 201 bp, Homo sapiens; identical to SEQ ID NO: 6879

SEQ ID NO: 6945 - DNA, 201 bp, Homo sapiens; identical to SEQ ID NO: 6880

SEQ ID NO: 6946 - DNA, 201 bp, Homo sapiens; identical to SEQ ID NO: 6882

SEQ ID NO: 6947 - DNA, 201 bp, Homo sapiens; identical to SEQ ID NO: 6908

SEQ ID NO: 6948 - DNA, 201 bp, Homo sapiens; identical to SEQ ID NO: 6881

SEQ ID NO: 6949 - DNA, 201 bp, Homo sapiens; identical to SEQ ID NO: 6874

SEQ ID NO: 6950 - DNA, 201 bp, Homo sapiens; identical to SEQ ID NO: 6876

SEQ ID NO: 6951 - DNA, 201 bp, Homo sapiens; identical to SEQ ID NO: 6877

SEQ ID NO: 6952 - DNA, 201 bp, Homo sapiens; identical to SEQ ID NO: 6879

SEQ ID NO: 6953 - DNA, 201 bp, Homo sapiens
tggcttctaagacatttcccagggttaatagggcctggtccctgggaggaaatttgaatgggtccattttgcccttccatagcctaatccctgggcattgytttccactgaggttgggggttggggtgtactagttacacatcttcaacagaccccctctagaaatttttcagatgcttctgggagacacccaaagggtga

SEQ ID NO: 6954 - DNA, 201 bp, Homo sapiens; identical to SEQ ID NO: 6881

SEQ ID NO: 6955 - DNA, 201 bp, Homo sapiens; identical to SEQ ID NO: 6882

SEQ ID NO: 6956 - DNA, 201 bp, Homo sapiens; identical to SEQ ID NO: 6873

SEQ ID NO: 6957 - DNA, 201 bp, Homo sapiens; identical to SEQ ID NO: 6874

SEQ ID NO: 6958 - DNA, 201 bp, Homo sapiens; identical to SEQ ID NO: 6885

SEQ ID NO: 6959 - DNA, 201 bp, Homo sapiens; identical to SEQ ID NO: 6876

SEQ ID NO: 6960 - DNA, 201 bp, Homo sapiens; identical to SEQ ID NO: 6877

SEQ ID NO: 6961 - DNA, 201 bp, Homo sapiens; identical to SEQ ID NO: 6878

SEQ ID NO: 6962 - DNA, 201 bp, Homo sapiens; identical to SEQ ID NO: 6879

SEQ ID NO: 6963 - DNA, 201 bp, Homo sapiens; identical to SEQ ID NO: 6953

SEQ ID NO: 6964 - DNA, 201 bp, Homo sapiens; identical to SEQ ID NO: 6881

SEQ ID NO: 6965 - DNA, 201 bp, Homo sapiens; identical to SEQ ID NO: 6882

SEQ ID NO: 6966 - DNA, 201 bp, Homo sapiens; identical to SEQ ID NO: 6873

SEQ ID NO: 6967 - DNA, 201 bp, Homo sapiens; identical to SEQ ID NO: 6874

SEQ ID NO: 6968 - DNA, 201 bp, Homo sapiens
accttttctactgtacaccccatcccagacgaagacagtccctggatcaccgacagcacagacagaatccctgctaccaatatggactccagtcatagtayaacgcttcagcctactgcaaatccaaacacaggtttggtggaagatttggacaggacaggacctctttcaatgacaacgcgagaccaagacacattccac

SEQ ID NO: 6969 - DNA, 201 bp, Homo sapiens; identical to SEQ ID NO: 6876

SEQ ID NO: 6970 - DNA, 201 bp, Homo sapiens; identical to SEQ ID NO: 6877

SEQ ID NO: 6971 - DNA, 201 bp, Homo sapiens; identical to SEQ ID NO: 6878

SEQ ID NO: 6972 - DNA, 201 bp, Homo sapiens; identical to SEQ ID NO: 6879

SEQ ID NO: 6973 - DNA, 201 bp, Homo sapiens; identical to SEQ ID NO: 6880

SEQ ID NO: 6974 - DNA, 201 bp, Homo sapiens; identical to SEQ ID NO: 6881

SEQ ID NO: 6975 - DNA, 201 bp, Homo sapiens; identical to SEQ ID NO: 6882

SEQ ID NO: 6976 - DNA, 201 bp, Homo sapiens; identical to SEQ ID NO: 6873

SEQ ID NO: 6977 - DNA, 201 bp, Homo sapiens; identical to SEQ ID NO: 6911

SEQ ID NO: 6978 - DNA, 201 bp, Homo sapiens; identical to SEQ ID NO: 6874

SEQ ID NO: 6979 - DNA, 201 bp, Homo sapiens; identical to SEQ ID NO: 6896

SEQ ID NO: 6980 - DNA, 201 bp, Homo sapiens
tcaccgacagcacagacagaatccctgctaccactttgatgagcactagtgctacagcaactgagacagcaaccaagaggcaagaaacctgggattggttytcatggttgtttctaccatcagagtcaaagaatcatcttcacacaacaacacaaatggctgcaggctgggagccaaatgaagaaaatgaagatgaaagag

SEQ ID NO: 6981 - DNA, 201 bp, Homo sapiens; identical to SEQ ID NO: 6876

SEQ ID NO: 6982 - DNA, 201 bp, Homo sapiens; identical to SEQ ID NO: 6877

SEQ ID NO: 6983 - DNA, 201 bp, Homo sapiens; identical to SEQ ID NO: 6901

SEQ ID NO: 6984 - DNA, 201 bp, Homo sapiens; identical to SEQ ID NO: 6879

SEQ ID NO: 6985 - DNA, 201 bp, Homo sapiens; identical to SEQ ID NO: 6919

SEQ ID NO: 6986 - DNA, 201 bp, Homo sapiens; identical to SEQ ID NO: 6878

SEQ ID NO: 6987 - DNA, 201 bp, Homo sapiens; identical to SEQ ID NO: 6953

SEQ ID NO: 6988 - DNA, 201 bp, Homo sapiens; identical to SEQ ID NO: 6882

SEQ ID NO: 6989 - DNA, 201 bp, Homo sapiens; identical to SEQ ID NO: 6881

SEQ ID NO: 6990 - DNA, 201 bp, Homo sapiens; identical to SEQ ID NO: 6908

SEQ ID NO: 6991 - DNA, 201 bp, Homo sapiens; identical to SEQ ID NO: 6898

SEQ ID NO: 6992 - DNA, 201 bp, Homo sapiens; identical to SEQ ID NO: 6894

SEQ ID NO: 6993 - DNA, 201 bp, Homo sapiens
tcaccgacagcacagacagaatccctgctaccactttgatgagcactagtgctacagcaactgagacagcaaccaagaggcaagaagcctgggattggttytcatggttgtttctaccatcagagtcaaagaatcatcttcacacaacaacacaaatggctggtacgtcttcaaataccatctcagcaggctgggagccaa

SEQ ID NO: 6994 - DNA, 201 bp, Homo sapiens
tttctggatcaggcattgatgatgatgaagattttatctccagcaccatttcaaccacaccacgggcctttgaccacacaaaacagaaccaggactggacycagtggaacccaagccattcaaatccggaagtgctacttcagacaaccacaaggatgactgatgtagacagaaatggcaccactgcttatgaaggaaact

SEQ ID NO: 6995 - DNA, 201 bp, Homo sapiens; identical to SEQ ID NO: 6903

SEQ ID NO: 6996 - DNA, 201 bp, Homo sapiens; identical to SEQ ID NO: 6902

SEQ ID NO: 6997 - DNA, 201 bp, Homo sapiens
gttggaaacataaccattacagggagctgggacacttaacagatgcaatgtgctactgattgtttcattgcgaatcttttttagcataaaattttctactytttttgttttttgtgttttgttctttaaagtcaggtccaatttgtaaaaacagcattgctttgtaaattagggcccaattaataatcagcaagaatttga

SEQ ID NO: 6998 - DNA, 201 bp, Homo sapiens
acctgcaggtatgggttcatagaagggcatgtggtgattccccggatccaccccaactccatctgtgcagcaaacaacacaggggtgtacatcctcacatmcaacacctcccagtatgacacatattgcttcaatgcttcagctccacctgaagaagattgtacatcagtcacagacctgcccaatgcctttgatggacca

SEQ ID NO: 6999 - DNA, 201 bp, Homo sapiens
aaacataaccattacagggagctgggacacttaacagatgcaatgtgctactgattgtttcattgcgaatcttttttagcataaaattttctactcttttygttttttgtgttttgttctttaaagtcaggtccaatttgtaaaaacagcattgctttgtaaattagggcccaattaataatcagcaagaatttgatcgtt

SEQ ID NO: 7000 - DNA, 201 bp, Homo sapiens
tctgcaaggctttcaatagcaccttgcccacaatggcccagatggagaaagctctgagcatcggatttgagacctgcaggtatgggttcatagaagggcaygtggtgattccccggatccaccccaactccatctgtgcagcaaacaacacaggggtgtacatcctcacatacaacacctcccagtatgacacatattgct

SEQ ID NO: 7001 - DNA, 201 bp, Homo sapiens
ccatgtctgtgaagcacttgtggaccattcaagattgtggaagaatcactcaagagaaggagatagcaatatttgcagatatgcaaactggccccttgcakgcaaatcctggagcacgtcctggagcctttagaggagacggctgctgctgttccagtctctccttaggcagacttgagtttctacccactcttcccaagc

SEQ ID NO: 7002 - DNA, 201 bp, Homo sapiens
gtctgtgaagcacttgtggaccattcaagattgtggaagaatcactcaagagaaggagatagcaatatttgcagatatgcaaactggccccttgcatgcamatcctggagcacgtcctggagcctttagaggagacggctgctgctgttccagtctctccttaggcagacttgagtttctacccactcttcccaagcagcc

SEQ ID NO: 7003 - DNA, 201 bp, Homo sapiens
cccagacaaccagtagtcaccattccaagtgaggggtggctgcaactctacagccccgttcgtctctcctcactgtcaaagctgctgagaccccagactcracacttgaaagaaacccatgtctgtgaagcacttgtggaccattcaagattgtggaagaatcactcaagagaaggagatagcaatatttgcagatatgca

SEQ ID NO: 7004 - DNA, 201 bp, Homo sapiens
ttaggaatcattgaagttataaatctttggaatgagcaaactcagaatggtgctacttgaagactctggatctgctgacttcagaagacattttgtcaacytgagtcccttcaccattactgtggtcttacttctcagtgcctgttttgtcaccagttctcttggaggaacagacaaggagctgaggctagtggatggtga

SEQ ID NO: 7005 - DNA, 201 bp, Homo sapiens
ggtgtatatgagactttcaagggaattaaataaataaataagaatgttattgatttgagtttgctttaattacttgtccttaattctattaatttctaaaygggcttcctaattttttgtagagtttcctagatgtattataatgtgttttatttgacagtgtttcaatttgcatatacagtactgtatattttttcttat

SEQ ID NO: 7006 - DNA, 201 bp, Homo sapiens
tgtgttttatttgacagtgtttcaatttgcatatacagtactgtatattttttcttatttggtttgaataattttcctattaccaaataaaaataaatttwtttttactttagtttttctaagacaggaaaagttaatgatattgaagggtctgtaaataatatatggctaactttataaggcatgactcacaacgattct

SEQ ID NO: 7007 - DNA, 201 bp, Homo sapiens
atgtccaactgccgtcacagccattggtcgagttaacgccagtaagggatttggacacatctggcttgacagcgtttcttgccagggacatgaacctgctrtctggcaatgtaaacaccatgaatggggaaagcattattgcaatcacaatgaagatgctggcgtgacatgttctgatggatcagatctggagctaagact

SEQ ID NO: 7008 - DNA, 201 bp, Homo sapiens
aggatgctggagtgatttgctcaaagggagcagatctgagcctgagactggtagatggagtcactgaatgttcaggaagattagaagtgagattccaaggrgaatgggggacaatatgtgatgacggctgggacagttacgatgctgctgtggcatgcaagcaactgggatgtccaactgccgtcacagccattggtcgag

SEQ ID NO: 7009 - DNA, 201 bp, Homo sapiens
aatggacagatctgggctgaagaattccagtgtgagggacatgagtcccatctttcactctgcccagtagcaccccgcccagaaggaacttgtagccacarcagggatgttggagtagtctgctcaagatacacagaaattcgcttggtgaatggcaagaccccgtgtgagggcagagtggagctcaaaacgcttggtgcc

SEQ ID NO: 7010 - DNA, 201 bp, Homo sapiens
ggggggagctcactttggagagggaaatggacagatctgggctgaagaattccagtgtgagggacatgagtcccatctttcactctgcccagtagcacccygcccagaaggaacttgtagccacagcagggatgttggagtagtctgctcaagatacacagaaattcgcttggtgaatggcaagaccccgtgtgagggcag

SEQ ID NO: 7011 - DNA, 201 bp, Homo sapiens
gctcagcccacagggaacccagactggttggaggggacattccctgttctggacgtgttgaagtgaagcatggtgacacgtggggctccatctgtgattcrgacttctctctggaagctgccagcgttctatgcagggaattacagtgtggcacagttgtctctatcctggggggagctcactttggagagggaaatggac

SEQ ID NO: 7012 - DNA, 201 bp, Homo sapiens
ggctgtgcagacaaagggaaaatcaaccctgcatctttagacaaggccatgtccattcccatgtgggtggacaatgttcagtgtccaaaaggacctgacaygctgtggcagtgcccatcatctccatgggagaagagactggccagcccctcggaggagacctggatcacatgtgacaacaagataagacttcaggaagga

SEQ ID NO: 7013 - DNA, 201 bp, Homo sapiens
gttgttttctttagaagaacatttctagggaataatacaagaagatttaggaatcattgaagttataaatctttggaatgagcaaactcagaatggtgctrcttgaagactctggatctgctgacttcagaagacattttgtcaacctgagtcccttcaccattactgtggtcttacttctcagtgcctgttttgtcacca

SEQ ID NO: 7014 - DNA, 201 bp, Homo sapiens
ggcctgtgcagggcgtctggaagttttttacaatggagcttggggcactgttggcaagagtagcatgtctgaaaccactgtgggtgtggtgtgcaggcagytgggctgtgcagacaaagggaaaatcaaccctgcatctttagacaaggccatgtccattcccatgtgggtggacaatgttcagtgtccaaaaggacctga

SEQ ID NO: 7015 - DNA, 201 bp, Homo sapiens; identical to SEQ ID NO: 7004

SEQ ID NO: 7016 - DNA, 201 bp, Homo sapiens; identical to SEQ ID NO: 7005

SEQ ID NO: 7017 - DNA, 201 bp, Homo sapiens; identical to SEQ ID NO: 7006

SEQ ID NO: 7018 - DNA, 201 bp, Homo sapiens; identical to SEQ ID NO: 7007

SEQ ID NO: 7019 - DNA, 201 bp, Homo sapiens; identical to SEQ ID NO: 7008

SEQ ID NO: 7020 - DNA, 201 bp, Homo sapiens
ctgcccagtagcaccccgcccagaaggaacttgtagccacagcagggatgttggagtagtctgctcaagtaagacccagaaaacatctttaattggttctyatactgtgaaagggacagggttagggagtcatagctgtctttttctaaagccctgtctccttccaggatacacagaaattcgcttggtgaatggcaagac

SEQ ID NO: 7021 - DNA, 201 bp, Homo sapiens
aatggacagatctgggctgaagaattccagtgtgagggacatgagtcccatctttcactctgcccagtagcaccccgcccagaaggaacttgtagccacarcagggatgttggagtagtctgctcaagtaagacccagaaaacatctttaattggttctcatactgtgaaagggacagggttagggagtcatagctgtctt

SEQ ID NO: 7022 - DNA, 201 bp, Homo sapiens
ggggggagctcactttggagagggaaatggacagatctgggctgaagaattccagtgtgagggacatgagtcccatctttcactctgcccagtagcacccygcccagaaggaacttgtagccacagcagggatgttggagtagtctgctcaagtaagacccagaaaacatctttaattggttctcatactgtgaaagggac

SEQ ID NO: 7023 - DNA, 201 bp, Homo sapiens; identical to SEQ ID NO: 7011

SEQ ID NO: 7024 - DNA, 201 bp, Homo sapiens
ttgcctgaatgcagatgatctggacctaatgaattcctcagaaaattcccatgagtcagctgatttcagtgctgctgaactaatttctgtgtctaaatttmttcctatttctggaatggaaaaggaggccattctgagccacactgaaaaggaaaatgggaatttataacccagtgagttcagcctttaagataccttgat

SEQ ID NO: 7025 - DNA, 201 bp, Homo sapiens; identical to SEQ ID NO: 7012

SEQ ID NO: 7026 - DNA, 201 bp, Homo sapiens; identical to SEQ ID NO: 7013

SEQ ID NO: 7027 - DNA, 201 bp, Homo sapiens; identical to SEQ ID NO: 7014

SEQ ID NO: 7028 - DNA, 201 bp, Homo sapiens; identical to SEQ ID NO: 7004

SEQ ID NO: 7029 - DNA, 201 bp, Homo sapiens; identical to SEQ ID NO: 7005

SEQ ID NO: 7030 - DNA, 201 bp, Homo sapiens; identical to SEQ ID NO: 7006

SEQ ID NO: 7031 - DNA, 201 bp, Homo sapiens; identical to SEQ ID NO: 7007

SEQ ID NO: 7032 - DNA, 201 bp, Homo sapiens; identical to SEQ ID NO: 7008

SEQ ID NO: 7033 - DNA, 201 bp, Homo sapiens; identical to SEQ ID NO: 7009

SEQ ID NO: 7034 - DNA, 201 bp, Homo sapiens
tgaattcctcaggtctgtgggttcttggagggtctattgcccaggggttcagatcagtggctgcagttgaggcacagacattctactttgataaacagttwaaaaagtctaaaaatgtaataggaagcttagatgcatataatggacaagaatgactgaaaattattcttggagaatatcaaaattgcaatcatagggagg

SEQ ID NO: 7035 - DNA, 201 bp, Homo sapiens; identical to SEQ ID NO: 7010

SEQ ID NO: 7036 - DNA, 201 bp, Homo sapiens; identical to SEQ ID NO: 7011

SEQ ID NO: 7037 - DNA, 201 bp, Homo sapiens
aggatgactttactgggttggaagaaatatcccaaaacccattgtctttactccatgaagggtccctgaccttctgagaggggcctgcctcacttcttccrtccaaagaattatgcatctgctactgtgtcagggaacatatttaaggaacatgtactgttactgtgtcaggaaacatatttaagaaataggaaagacttt

SEQ ID NO: 7038 - DNA, 201 bp, Homo sapiens
aggtctggtttatttcccagtaattattttcttcctttcagaaaattcccatgagtcagctgatttcagtgctgctgaactaatttctgtgtctaaatttmttcctatttctggaatggaaaaggaggccattctgagccacactgaaaaggaaaatgggaatttataacccagtgagttcagcctttaagataccttgat

SEQ ID NO: 7039 - DNA, 201 bp, Homo sapiens; identical to SEQ ID NO: 7012

SEQ ID NO: 7040 - DNA, 201 bp, Homo sapiens; identical to SEQ ID NO: 7013

SEQ ID NO: 7041 - DNA, 201 bp, Homo sapiens; identical to SEQ ID NO: 7014

SEQ ID NO: 7042 - DNA, 201 bp, Homo sapiens; identical to SEQ ID NO: 7004

SEQ ID NO: 7043 - DNA, 201 bp, Homo sapiens; identical to SEQ ID NO: 7005

SEQ ID NO: 7044 - DNA, 201 bp, Homo sapiens; identical to SEQ ID NO: 7006

SEQ ID NO: 7045 - DNA, 201 bp, Homo sapiens; identical to SEQ ID NO: 7007

SEQ ID NO: 7046 - DNA, 201 bp, Homo sapiens; identical to SEQ ID NO: 7008

SEQ ID NO: 7047 - DNA, 201 bp, Homo sapiens; identical to SEQ ID NO: 7009

SEQ ID NO: 7048 - DNA, 201 bp, Homo sapiens; identical to SEQ ID NO: 7010

SEQ ID NO: 7049 - DNA, 201 bp, Homo sapiens; identical to SEQ ID NO: 7011

SEQ ID NO: 7050 - DNA, 201 bp, Homo sapiens; identical to SEQ ID NO: 7024

SEQ ID NO: 7051 - DNA, 201 bp, Homo sapiens; identical to SEQ ID NO: 7012

SEQ ID NO: 7052 - DNA, 201 bp, Homo sapiens; identical to SEQ ID NO: 7013

SEQ ID NO: 7053 - DNA, 201 bp, Homo sapiens; identical to SEQ ID NO: 7014

SEQ ID NO: 7054 - DNA, 201 bp, Homo sapiens; identical to SEQ ID NO: 7009

SEQ ID NO: 7055 - DNA, 201 bp, Homo sapiens; identical to SEQ ID NO: 7010

SEQ ID NO: 7056 - DNA, 201 bp, Homo sapiens; identical to SEQ ID NO: 7011

SEQ ID NO: 7057 - DNA, 201 bp, Homo sapiens; identical to SEQ ID NO: 7012

SEQ ID NO: 7058 - DNA, 201 bp, Homo sapiens; identical to SEQ ID NO: 7014

SEQ ID NO: 7059 - DNA, 201 bp, Homo sapiens; identical to SEQ ID NO: 7034

SEQ ID NO: 7060 - DNA, 201 bp, Homo sapiens; identical to SEQ ID NO: 7037

SEQ ID NO: 7061 - DNA, 201 bp, Homo sapiens; identical to SEQ ID NO: 7038

SEQ ID NO: 7062 - DNA, 201 bp, Homo sapiens; identical to SEQ ID NO: 7013

SEQ ID NO: 7063 - DNA, 201 bp, Homo sapiens; identical to SEQ ID NO: 7004

SEQ ID NO: 7064 - DNA, 201 bp, Homo sapiens; identical to SEQ ID NO: 7008

SEQ ID NO: 7065 - DNA, 201 bp, Homo sapiens; identical to SEQ ID NO: 7007

SEQ ID NO: 7066 - DNA, 201 bp, Homo sapiens
taccttacatggaaacgaagaaacaaaattcataaatttaaattcataaatttagctgaaagatactgattcaatttgtatacagtgaatataaatgagaygacagcaaaattttcatgaaatgtaaaatatttttatagtttgttcatactatatgaggttctattttaaatgactttctggattttaaaaaatttcttt

SEQ ID NO: 7067 - DNA, 201 bp, Homo sapiens
tctacaatataactacaaataaatacaaggcttttttagacaaacaaaatcaagtaaaatttggaagttatttaggatattcagtcggagctggtcatttycggagccagcatactaccgaagtagtcggaggagctcctcaacatgagcagattggtaaggcatatatattcagcattgatgaaaaagaactaaatatct

SEQ ID NO: 7068 - DNA, 201 bp, Homo sapiens
gggagcacccatgcagagcaccatcagagaggaaggaagagtgtttgtgtacatcaactctggctcgggagcagtaatgaatgcaatggaaacaaacctcrttggaagtgacaaatatgctgcaagatttggggaatctatagttaatcttggcgacattgacaatgatggctttgaagatgttgctatcggagctccaca

SEQ ID NO: 7069 - DNA, 201 bp, Homo sapiens
tcagaattatctaggttaaatattgatgtattatgatggttgcaaagtttttttgtgtgtccaataaacacattgtaaaaaaaagaatttgaattgatatytaaaaacagaatttgaattgatatttcatcttgacttttaaagccctagaggctaattgttagtaacatcaatttctattaggatatccgtttggccaca

SEQ ID NO: 7070 - DNA, 201 bp, Homo sapiens
acttcatatgtattatgtactatgtaaaatattgactatcacacaactatttccttggatgtaattctttgttaccctttacaagtataagtttacaagtataagtgttaccttacatggaaacgaagaaacaaaattcataaatttaaattcataaatttagctgaaagatactgattcaatttgtatacagtgaatata

SEQ ID NO: 7071 - DNA, 201 bp, Homo sapiens
gaaagatttctttatatgaagtccctgccactagccagccatcctaattgatgaaagttatctgttcacaggcctgcagtgatggtgaggaatgttctgaratttgcgaaggcatttgagtagtgaaatgtaagcacaaaacctcctgaacccagagtgtgtatacacaggaataaactttatgacatttatgtattttta

SEQ ID NO: 7072 - DNA, 201 bp, Homo sapiens
accttggtcctcatgtcatcagtaaacgaagtacagaggaattcccaccacttcagccaattcttcagcagaagaaagaaaaagacataatgaaaaaaacrataaactttgcaaggttttgtgcccatgaaaattgttctgctgatttacaggtttctgcaaagattgggtttttgaagccccatgaaaataaaacatatc

SEQ ID NO: 7073 - DNA, 201 bp, Homo sapiens
cgatttagaactgtcttctccaggatggtctctaaggaaatttacatttggttctttcctactcagaactactcagaaacaactatatatttcaggttatytgagcacagtgaaagcagagtactatggttgtccaacacaggcctctcagatacaaggggaacacaattacatattgggctagattttgcccagttcaaa

SEQ ID NO: 7074 - DNA, 201 bp, Homo sapiens
gtccagactactactggagaatgccactttgaaaattatcaaagagtgtgtgcattagagcagcaaaagagtgcaatgcagaccttgaaaggcatagtccrgttcttgtccaagactgataagaggctattgtactgcataaaagctgatccacattgtttaaatttcttgtgtaattttgggaaaatggaaagtggaaaa

SEQ ID NO: 7075 - DNA, 201 bp, Homo sapiens
acaaccattttttttcagcagactatgaatattatagtattataggccaaactggcaaacttcagactgaacatgtacactggtttgagcttagtgaaatkacttctggataattatttttttataattatggatttcaccatctttctttctgtatatatacatgtgtttttatgtaggtatatatttaccattcttcct

SEQ ID NO: 7076 - DNA, 201 bp, Homo sapiens
gccaattcttcagcagaagaaagaaaaagacataatgaaaaaaacgataaactttgcaaggttttgtgcccatgaaaattgttctgctgatttacaggttwctgcaaagattgggtttttgaagccccatgaaaataaaacatatcttgctgttgggagtatgaagacattgatgttgaatgtgtccttgtttaatgctgg

SEQ ID NO: 7077 - DNA, 201 bp, Homo sapiens
tggatgagacttcagcactcaagtttgaaataagagcaacaggttttccagagccaaatccaagagtaattgaactaaacaaggatgagaatgttgcgcaygttctactggaaggactacatcatcaaagacccaaacgttatttcaccatagtgattatttcaagtagcttgctacttggacttattgtacttctgttga

SEQ ID NO: 7078 - DNA, 201 bp, Homo sapiens
tgaagccccatgaaaataaaacatatcttgctgttgggagtatgaagacattgatgttgaatgtgtccttgtttaatgctggagatgatgcatatgaaacractctacatgtcaaactacccgtgggtctttatttcattaagattttagagctggaagagaagcaaataaactgtgaagtcacagataactctggcgtgg

SEQ ID NO: 7079 - DNA, 201 bp, Homo sapiens
tgttgatctcatatgttatgtggaaggctggcttctttaaaagacaatacaaatctatcctacaagaagaaaacagaagagacagttggagttatatcaayagtaaaagcaatgatgattaaggacttctttcaaattgagagaatggaaaacagactcaggttgtagtaaagaaatttaaaagacactgtttacaagaaa

SEQ ID NO: 7080 - DNA, 201 bp, Homo sapiens
cgcgagcacccgaagctcccggctggcggcagaaaccgggagtggggccgggcgagtgcgcggcatcccaggccggcccgaacgctccgcccgcggtgggmcgacttcccctcctcttccctctctccttcctttagcccgctggcgccggacacgctgcgcctcatctcttggggcgttcttccccgttggccaaccgtc

SEQ ID NO: 7081 - DNA, 201 bp, Homo sapiens
atttcaccatagtgattatttcaagtagcttgctacttggacttattgtacttctgttgatctcatatgttatgtggaaggctggcttctttaaaagacartacaaatctatcctacaagaagaaaacagaagagacagttggagttatatcaacagtaaaagcaatgatgattaaggacttctttcaaattgagagaatg

SEQ ID NO: 7082 - DNA, 201 bp, Homo sapiens; identical to SEQ ID NO: 7066

SEQ ID NO: 7083 - DNA, 201 bp, Homo sapiens; identical to SEQ ID NO: 7067

SEQ ID NO: 7084 - DNA, 201 bp, Homo sapiens; identical to SEQ ID NO: 7068

SEQ ID NO: 7085 - DNA, 201 bp, Homo sapiens; identical to SEQ ID NO: 7069

SEQ ID NO: 7086 - DNA, 201 bp, Homo sapiens; identical to SEQ ID NO: 7071

SEQ ID NO: 7087 - DNA, 201 bp, Homo sapiens; identical to SEQ ID NO: 7072

SEQ ID NO: 7088 - DNA, 201 bp, Homo sapiens; identical to SEQ ID NO: 7073

SEQ ID NO: 7089 - DNA, 201 bp, Homo sapiens; identical to SEQ ID NO: 7074

SEQ ID NO: 7090 - DNA, 201 bp, Homo sapiens; identical to SEQ ID NO: 7075

SEQ ID NO: 7091 - DNA, 201 bp, Homo sapiens; identical to SEQ ID NO: 7076

SEQ ID NO: 7092 - DNA, 201 bp, Homo sapiens; identical to SEQ ID NO: 7077

SEQ ID NO: 7093 - DNA, 201 bp, Homo sapiens; identical to SEQ ID NO: 7078

SEQ ID NO: 7094 - DNA, 201 bp, Homo sapiens; identical to SEQ ID NO: 7079

SEQ ID NO: 7095 - DNA, 201 bp, Homo sapiens; identical to SEQ ID NO: 7080

SEQ ID NO: 7096 - DNA, 201 bp, Homo sapiens; identical to SEQ ID NO: 7081

SEQ ID NO: 7097 - DNA, 201 bp, Homo sapiens; identical to SEQ ID NO: 7066

SEQ ID NO: 7098 - DNA, 201 bp, Homo sapiens; identical to SEQ ID NO: 7067

SEQ ID NO: 7099 - DNA, 201 bp, Homo sapiens; identical to SEQ ID NO: 7068

SEQ ID NO: 7100 - DNA, 201 bp, Homo sapiens; identical to SEQ ID NO: 7069

SEQ ID NO: 7101 - DNA, 201 bp, Homo sapiens; identical to SEQ ID NO: 7070

SEQ ID NO: 7102 - DNA, 201 bp, Homo sapiens; identical to SEQ ID NO: 7071

SEQ ID NO: 7103 - DNA, 201 bp, Homo sapiens; identical to SEQ ID NO: 7072

SEQ ID NO: 7104 - DNA, 201 bp, Homo sapiens; identical to SEQ ID NO: 7073

SEQ ID NO: 7105 - DNA, 201 bp, Homo sapiens; identical to SEQ ID NO: 7074

SEQ ID NO: 7106 - DNA, 201 bp, Homo sapiens; identical to SEQ ID NO: 7075

SEQ ID NO: 7107 - DNA, 201 bp, Homo sapiens; identical to SEQ ID NO: 7076

SEQ ID NO: 7108 - DNA, 201 bp, Homo sapiens; identical to SEQ ID NO: 7077

SEQ ID NO: 7109 - DNA, 201 bp, Homo sapiens; identical to SEQ ID NO: 7078

SEQ ID NO: 7110 - DNA, 201 bp, Homo sapiens; identical to SEQ ID NO: 7079

SEQ ID NO: 7111 - DNA, 201 bp, Homo sapiens; identical to SEQ ID NO: 7080

SEQ ID NO: 7112 - DNA, 201 bp, Homo sapiens; identical to SEQ ID NO: 7081

SEQ ID NO: 7113 - DNA, 201 bp, Homo sapiens; identical to SEQ ID NO: 7074

SEQ ID NO: 7114 - DNA, 201 bp, Homo sapiens; identical to SEQ ID NO: 7072

SEQ ID NO: 7115 - DNA, 201 bp, Homo sapiens; identical to SEQ ID NO: 7081

SEQ ID NO: 7116 - DNA, 201 bp, Homo sapiens; identical to SEQ ID NO: 7067

SEQ ID NO: 7117 - DNA, 201 bp, Homo sapiens
gccaattcttcagcagaagaaagaaaaagacataatgaaaaaaacaataaactttgcaaggttttgtgcccatgaaaattgttctgctgatttacaggttwctgcaaagattgggtttttgaagccccatgaaaataaaacatatcttgctgttgggagtatgaagacattgatgttgaatgtgtccttgtttaatgctgg

SEQ ID NO: 7118 - DNA, 201 bp, Homo sapiens; identical to SEQ ID NO: 7079

SEQ ID NO: 7119 - DNA, 201 bp, Homo sapiens; identical to SEQ ID NO: 7068

SEQ ID NO: 7120 - DNA, 201 bp, Homo sapiens; identical to SEQ ID NO: 7077

SEQ ID NO: 7121 - DNA, 201 bp, Homo sapiens; identical to SEQ ID NO: 7078

SEQ ID NO: 7122 - DNA, 201 bp, Homo sapiens
cgcgagcacccgaagctcccggctcggcggcagaaaccgggagtggggccgggcgagtgcgcggcatcccaggccggcccgaacgtccgcccgcggtgggmcgacttcccctcctcttccctctctccttcctttagcccgctggcgccggacacgctgcgcctcatctcttggggcgttcttccccgttggccaaccgtc

SEQ ID NO: 7123 - DNA, 201 bp, Homo sapiens
cacctcgggcccagataacaggataccgactgaccgtgggccttacccgaagaggacagcccaggcagtacaatgtgggtccctctgtctccaagtacccmctgaggaatctgcagcctgcatctgagtacaccgtatccctcgtggccataaagggcaaccaagagagccccaaagccactggagtctttaccacactgc

SEQ ID NO: 7124 - DNA, 201 bp, Homo sapiens
tcatcctgttggcactgatgaagaacccttacagttcagggttcctggaacttctaccagtgccactctgacaggcctcaccagaggtgccacctacaacrtcatagtggaggcactgaaagaccagcagaggcataaggttcgggaagaggttgttaccgtgggcaactctgtcaacgaaggcttgaaccaacctacgga

SEQ ID NO: 7125 - DNA, 201 bp, Homo sapiens
ttttaggcggaccacaccgcccacaacggccacccccataaggcataggccaagaccatacccgccgaatgtaggacaagaagctctctctcagacaaccrtctcatgggccccattccaggacacttctgagtacatcatttcatgtcatcctgttggcactgatgaagaacccttacagttcagggttcctggaacttc

SEQ ID NO: 7126 - DNA, 201 bp, Homo sapiens
acagtactcactttttccaaatgatcctagtaattgcctagaaatatctttctcttacctgttatttatcaatttttcccagtatttttatacggaaaaarttgtattgaaaacacttagtatgcagttgataagaggaatttggtataattatggtgggtgattattttttatactgtatgtgccaaagctttactactg

SEQ ID NO: 7127 - DNA, 201 bp, Homo sapiens
agtttgtcaatgaaactgattctactgtcctggtgagatggactccacctcgggcccagataacaggataccgactgaccgtgggccttacccgaagaggmcagcccaggcagtacaatgtgggtccctctgtctccaagtacccactgaggaatctgcagcctgcatctgagtacaccgtatccctcgtggccataaagg

SEQ ID NO: 7128 - DNA, 201 bp, Homo sapiens
ccgaaaatacattgtaaatgtctatcagatatctgaggatggggagcagagtttgatcctgtctacttcacaaacaacagcgcctgatgccccacctgacmcgactgtggaccaagttgatgacacctcaattgttgttcgctggagcagaccccaggctcccatcacagggtacagaatagtctattcgccatcagtaga

SEQ ID NO: 7129 - DNA, 201 bp, Homo sapiens
acagctcatccgtggttgtatcaggacttatggtggccaccaaatatgaagtgagtgtctatgctcttaaggacactttgacaagcagaccagctcagggwgttgtcaccactctggagaatgtcagcccaccaagaagggctcgtgtgacagatgctactgagaccaccatcaccattagctggagaaccaagactgaga

SEQ ID NO: 7130 - DNA, 201 bp, Homo sapiens
gcaaacttggtggcaacttgcctcccggtgcgggcgtctctcccccaccgtctcaacatgcttaggggtccggggcccgggctgctgctgctggccgtccwgtgcctggggacagcggtgccctccacgggagcctcgaagagcaagaggcaggctcagcaaatggttcagccccagtccccggtggctgtcagtcaaagc

SEQ ID NO: 7131 - DNA, 201 bp, Homo sapiens
ttcctggccgaaaatacattgtaaatgtctatcagatatctgaggatggggagcagagtttgatcctgtctacttcacaaacaacagcgcctgatgccccwcctgacccgactgtggaccaagttgatgacacctcaattgttgttcgctggagcagaccccaggctcccatcacagggtacagaatagtctattcgccat

SEQ ID NO: 7132 - DNA, 201 bp, Homo sapiens
agtgggaccgtcagggagaaaatggccagatgatgagctgcacatgtcttgggaacggaaaaggagaattcaagtgtgaccctcatgaggcaacgtgttaygatgatgggaagacataccacgtaggagaacagtggcagaaggaatatctcggtgccatttgctcctgcacatgctttggaggccagcggggctggcgct

SEQ ID NO: 7133 - DNA, 201 bp, Homo sapiens
cgagggacctggaagttgttgctgcgacccccaccagcctactgatcagctgggatgctcctgctgtcacagtgagatattacaggatcacttacggagaracaggaggaaatagccctgtccaggagttcactgtgcctgggagcaagtctacagctaccatcagcggccttaaacctggagttgattataccatcactg

SEQ ID NO: 7134 - DNA, 201 bp, Homo sapiens
tgtctctctgccaagatccatctaaactggagtgatgttagcagacccagcttagagttcttctttctttcttaagccctttgctctggaggaagttctcyagcttcagctcaactcacagcttctccaagcatcaccctgggagtttcctgagggttttctcataaatgagggctgcacattgcctgttctgcttcgaag

SEQ ID NO: 7135 - DNA, 201 bp, Homo sapiens
ctgaagagacttgctttgacaagtacactgggaacacttaccgagtgggtgacacttatgagcgtcctaaagactccatgatctgggactgtacctgcatyggggctgggcgagggagaataagctgtaccatcgcaaaccgctgccatgaagggggtcagtcctacaagattggtgacacctggaggagaccacatgaga

SEQ ID NO: 7136 - DNA, 201 bp, Homo sapiens
ttctactgtcctggtgagatggactccacctcgggcccagataacaggataccgactgaccgtgggccttacccgaagaggacagcccaggcagtacaatrtgggtccctctgtctccaagtacccactgaggaatctgcagcctgcatctgagtacaccgtatccctcgtggccataaagggcaaccaagagagccccaa

SEQ ID NO: 7137 - DNA, 201 bp, Homo sapiens
cctggaacttctaccagtgccactctgacaggcctcaccagaggtgccacctacaacatcatagtggaggcactgaaagaccagcagaggcataaggttcrggaagaggttgttaccgtgggcaactctgtcaacgaaggcttgaaccaacctacggatgactcgtgctttgacccctacacagtttcccattatgccgtt

SEQ ID NO: 7138 - DNA, 201 bp, Homo sapiens; identical to SEQ ID NO: 7135

SEQ ID NO: 7139 - DNA, 201 bp, Homo sapiens; identical to SEQ ID NO: 7130

SEQ ID NO: 7140 - DNA, 201 bp, Homo sapiens; identical to SEQ ID NO: 7123

SEQ ID NO: 7141 - DNA, 201 bp, Homo sapiens; identical to SEQ ID NO: 7124

SEQ ID NO: 7142 - DNA, 201 bp, Homo sapiens; identical to SEQ ID NO: 7125

SEQ ID NO: 7143 - DNA, 201 bp, Homo sapiens; identical to SEQ ID NO: 7127

SEQ ID NO: 7144 - DNA, 201 bp, Homo sapiens; identical to SEQ ID NO: 7129

SEQ ID NO: 7145 - DNA, 201 bp, Homo sapiens; identical to SEQ ID NO: 7133

SEQ ID NO: 7146 - DNA, 201 bp, Homo sapiens; identical to SEQ ID NO: 7126

SEQ ID NO: 7147 - DNA, 201 bp, Homo sapiens; identical to SEQ ID NO: 7128

SEQ ID NO: 7148 - DNA, 201 bp, Homo sapiens; identical to SEQ ID NO: 7130

SEQ ID NO: 7149 - DNA, 201 bp, Homo sapiens; identical to SEQ ID NO: 7131

SEQ ID NO: 7150 - DNA, 201 bp, Homo sapiens
gccctaaaggactggcattcactgatgtggatgtcgattccatcaaaattgcttgggaaagcccacaggggcaagtttccaggtacagggtgacctactckagccctgaggatggaatccatgagctattccctgcacctgatggtgaagaagacactgcagagctgcaaggcctcagaccgggttctgagtacacagtca

SEQ ID NO: 7151 - DNA, 201 bp, Homo sapiens; identical to SEQ ID NO: 7132

SEQ ID NO: 7152 - DNA, 201 bp, Homo sapiens; identical to SEQ ID NO: 7134

SEQ ID NO: 7153 - DNA, 201 bp, Homo sapiens; identical to SEQ ID NO: 7135

SEQ ID NO: 7154 - DNA, 201 bp, Homo sapiens; identical to SEQ ID NO: 7136

SEQ ID NO: 7155 - DNA, 201 bp, Homo sapiens; identical to SEQ ID NO: 7137

SEQ ID NO: 7156 - DNA, 201 bp, Homo sapiens; identical to SEQ ID NO: 7123

SEQ ID NO: 7157 - DNA, 201 bp, Homo sapiens; identical to SEQ ID NO: 7124

SEQ ID NO: 7158 - DNA, 201 bp, Homo sapiens; identical to SEQ ID NO: 7125

SEQ ID NO: 7159 - DNA, 201 bp, Homo sapiens; identical to SEQ ID NO: 7126

SEQ ID NO: 7160 - DNA, 201 bp, Homo sapiens; identical to SEQ ID NO: 7127

SEQ ID NO: 7161 - DNA, 201 bp, Homo sapiens
ccgaaaatacattgtaaatgtctatcagatatctgaggatggggagcagagtttgatcctgtctacttcacaaacaacagcgcctgatgccccacctgacmcgactgtggaccaagttgatgacacctcaattgttgttcgctggagcagaccccaggctcccatcacaggtcagctaaaatagtctattcgccatcagta

SEQ ID NO: 7162 - DNA, 201 bp, Homo sapiens; identical to SEQ ID NO: 7129

SEQ ID NO: 7163 - DNA, 201 bp, Homo sapiens; identical to SEQ ID NO: 7130

SEQ ID NO: 7164 - DNA, 201 bp, Homo sapiens
ttcctggccgaaaatacattgtaaatgtctatcagatatctgaggatggggagcagagtttgatcctgtctacttcacaaacaacagcgcctgatgccccwcctgacccgactgtggaccaagttgatgacacctcaattgttgttcgctggagcagaccccaggctcccatcacaggtcagctaaaatagtctattcgcc

SEQ ID NO: 7165 - DNA, 201 bp, Homo sapiens; identical to SEQ ID NO: 7132

SEQ ID NO: 7166 - DNA, 201 bp, Homo sapiens; identical to SEQ ID NO: 7133

SEQ ID NO: 7167 - DNA, 201 bp, Homo sapiens; identical to SEQ ID NO: 7134

SEQ ID NO: 7168 - DNA, 201 bp, Homo sapiens; identical to SEQ ID NO: 7135

SEQ ID NO: 7169 - DNA, 201 bp, Homo sapiens; identical to SEQ ID NO: 7136

SEQ ID NO: 7170 - DNA, 201 bp, Homo sapiens; identical to SEQ ID NO: 7137

SEQ ID NO: 7171 - DNA, 201 bp, Homo sapiens; identical to SEQ ID NO: 7123

SEQ ID NO: 7172 - DNA, 201 bp, Homo sapiens; identical to SEQ ID NO: 7127

SEQ ID NO: 7173 - DNA, 201 bp, Homo sapiens; identical to SEQ ID NO: 7128

SEQ ID NO: 7174 - DNA, 201 bp, Homo sapiens; identical to SEQ ID NO: 7130

SEQ ID NO: 7175 - DNA, 201 bp, Homo sapiens; identical to SEQ ID NO: 7129

SEQ ID NO: 7176 - DNA, 201 bp, Homo sapiens; identical to SEQ ID NO: 7150

SEQ ID NO: 7177 - DNA, 201 bp, Homo sapiens; identical to SEQ ID NO: 7131

SEQ ID NO: 7178 - DNA, 201 bp, Homo sapiens; identical to SEQ ID NO: 7133

SEQ ID NO: 7179 - DNA, 201 bp, Homo sapiens; identical to SEQ ID NO: 7135

SEQ ID NO: 7180 - DNA, 201 bp, Homo sapiens; identical to SEQ ID NO: 7136

SEQ ID NO: 7181 - DNA, 201 bp, Homo sapiens; identical to SEQ ID NO: 7123

SEQ ID NO: 7182 - DNA, 201 bp, Homo sapiens; identical to SEQ ID NO: 7124

SEQ ID NO: 7183 - DNA, 201 bp, Homo sapiens
cgaatatacaatttatgtcattgccctgaagaataatcagaagagcgagcccctgattggaaggaaaaagacaggacaagaagctctctctcagacaaccrtctcatgggccccattccaggacacttctgagtacatcatttcatgtcatcctgttggcactgatgaagaacccttacagttcagggttcctggaacttc

SEQ ID NO: 7184 - DNA, 201 bp, Homo sapiens; identical to SEQ ID NO: 7127

SEQ ID NO: 7185 - DNA, 201 bp, Homo sapiens; identical to SEQ ID NO: 7129

SEQ ID NO: 7186 - DNA, 201 bp, Homo sapiens; identical to SEQ ID NO: 7133

SEQ ID NO: 7187 - DNA, 201 bp, Homo sapiens; identical to SEQ ID NO: 7126

SEQ ID NO: 7188 - DNA, 201 bp, Homo sapiens; identical to SEQ ID NO: 7161

SEQ ID NO: 7189 - DNA, 201 bp, Homo sapiens; identical to SEQ ID NO: 7130

SEQ ID NO: 7190 - DNA, 201 bp, Homo sapiens; identical to SEQ ID NO: 7164

SEQ ID NO: 7191 - DNA, 201 bp, Homo sapiens; identical to SEQ ID NO: 7150

SEQ ID NO: 7192 - DNA, 201 bp, Homo sapiens; identical to SEQ ID NO: 7132

SEQ ID NO: 7193 - DNA, 201 bp, Homo sapiens; identical to SEQ ID NO: 7134

SEQ ID NO: 7194 - DNA, 201 bp, Homo sapiens; identical to SEQ ID NO: 7135

SEQ ID NO: 7195 - DNA, 201 bp, Homo sapiens; identical to SEQ ID NO: 7136

SEQ ID NO: 7196 - DNA, 201 bp, Homo sapiens; identical to SEQ ID NO: 7137

SEQ ID NO: 7197 - DNA, 201 bp, Homo sapiens; identical to SEQ ID NO: 7123

SEQ ID NO: 7198 - DNA, 201 bp, Homo sapiens; identical to SEQ ID NO: 7124

SEQ ID NO: 7199 - DNA, 201 bp, Homo sapiens
tcacatccccagggaagatgtagactatcacctgtacccacacggtccgggactcaatccaaatgcctctacaggacaagaagctctctctcagacaaccrtctcatgggccccattccaggacacttctgagtacatcatttcatgtcatcctgttggcactgatgaagaacccttacagttcagggttcctggaacttc

SEQ ID NO: 7200 - DNA, 201 bp, Homo sapiens; identical to SEQ ID NO: 7127

SEQ ID NO: 7201 - DNA, 201 bp, Homo sapiens; identical to SEQ ID NO: 7129

SEQ ID NO: 7202 - DNA, 201 bp, Homo sapiens
cataggccaagaccatacccgccgaatgtaggtgaggaaatccaaattggtcacatccccagggaagatgtagactatcacctgtacccacacggtccggkactcaatccaaatgcctctacaggacaagaagctctctctcagacaaccatctcatgggccccattccaggacacttctgagtacatcatttcatgtcat

SEQ ID NO: 7203 - DNA, 201 bp, Homo sapiens; identical to SEQ ID NO: 7133

SEQ ID NO: 7204 - DNA, 201 bp, Homo sapiens; identical to SEQ ID NO: 7126

SEQ ID NO: 7205 - DNA, 201 bp, Homo sapiens; identical to SEQ ID NO: 7128

SEQ ID NO: 7206 - DNA, 201 bp, Homo sapiens; identical to SEQ ID NO: 7130

SEQ ID NO: 7207 - DNA, 201 bp, Homo sapiens; identical to SEQ ID NO: 7131

SEQ ID NO: 7208 - DNA, 201 bp, Homo sapiens; identical to SEQ ID NO: 7150

SEQ ID NO: 7209 - DNA, 201 bp, Homo sapiens; identical to SEQ ID NO: 7132

SEQ ID NO: 7210 - DNA, 201 bp, Homo sapiens; identical to SEQ ID NO: 7134

SEQ ID NO: 7211 - DNA, 201 bp, Homo sapiens; identical to SEQ ID NO: 7135

SEQ ID NO: 7212 - DNA, 201 bp, Homo sapiens; identical to SEQ ID NO: 7136

SEQ ID NO: 7213 - DNA, 201 bp, Homo sapiens; identical to SEQ ID NO: 7137

SEQ ID NO: 7214 - DNA, 201 bp, Homo sapiens; identical to SEQ ID NO: 7135

SEQ ID NO: 7215 - DNA, 201 bp, Homo sapiens; identical to SEQ ID NO: 7130

SEQ ID NO: 7216 - DNA, 201 bp, Homo sapiens; identical to SEQ ID NO: 7123

SEQ ID NO: 7217 - DNA, 201 bp, Homo sapiens; identical to SEQ ID NO: 7126

SEQ ID NO: 7218 - DNA, 201 bp, Homo sapiens; identical to SEQ ID NO: 7127

SEQ ID NO: 7219 - DNA, 201 bp, Homo sapiens; identical to SEQ ID NO: 7128

SEQ ID NO: 7220 - DNA, 201 bp, Homo sapiens; identical to SEQ ID NO: 7129

SEQ ID NO: 7221 - DNA, 201 bp, Homo sapiens; identical to SEQ ID NO: 7130

SEQ ID NO: 7222 - DNA, 201 bp, Homo sapiens
gtgtttacactgtcaaggatgacaaggaaagtgtccctatctctgataccatcatcccagaggtgccccaactcactgacctaagctttgttgatataacygattcaagcatcggcctgaggtggaccccgctaaactcttccaccattattgggtaccgcatcacagtagttgcggcaggagaaggtatccctatttttg

SEQ ID NO: 7223 - DNA, 201 bp, Homo sapiens; identical to SEQ ID NO: 7150

SEQ ID NO: 7224 - DNA, 201 bp, Homo sapiens; identical to SEQ ID NO: 7131

SEQ ID NO: 7225 - DNA, 201 bp, Homo sapiens; identical to SEQ ID NO: 7132

SEQ ID NO: 7226 - DNA, 201 bp, Homo sapiens; identical to SEQ ID NO: 7133

SEQ ID NO: 7227 - DNA, 201 bp, Homo sapiens; identical to SEQ ID NO: 7134

SEQ ID NO: 7228 - DNA, 201 bp, Homo sapiens; identical to SEQ ID NO: 7135

SEQ ID NO: 7229 - DNA, 201 bp, Homo sapiens; identical to SEQ ID NO: 7136

SEQ ID NO: 7230 - DNA, 201 bp, Homo sapiens
cggcctggagtacaatgtcagtgtttacactgtcaaggatgacaaggaaagtgtccctatctctgataccatcatcccagaggtgccccaactcactgacytaagctttgttgatataaccgattcaagcatcggcctgaggtggaccccgctaaactcttccaccattattgggtaccgcatcacagtagttgcggcagg

SEQ ID NO: 7231 - DNA, 201 bp, Homo sapiens; identical to SEQ ID NO: 7123

SEQ ID NO: 7232 - DNA, 201 bp, Homo sapiens
tcatcctgttggcactgatgaagaacccttacagttcagggttcctggaacttctaccagtgccactctgacaggcctcaccagaggtgccacctacaacrtcatagtggaggcactgaaagaccagcagaggcataaggttcgggaagaggttgttaccgtgggcaactctggatggtgccatgacaatggtgtgaacta

SEQ ID NO: 7233 - DNA, 201 bp, Homo sapiens; identical to SEQ ID NO: 7183

SEQ ID NO: 7234 - DNA, 201 bp, Homo sapiens; identical to SEQ ID NO: 7127

SEQ ID NO: 7235 - DNA, 201 bp, Homo sapiens; identical to SEQ ID NO: 7129

SEQ ID NO: 7236 - DNA, 201 bp, Homo sapiens; identical to SEQ ID NO: 7133

SEQ ID NO: 7237 - DNA, 201 bp, Homo sapiens; identical to SEQ ID NO: 7126

SEQ ID NO: 7238 - DNA, 201 bp, Homo sapiens; identical to SEQ ID NO: 7161

SEQ ID NO: 7239 - DNA, 201 bp, Homo sapiens; identical to SEQ ID NO: 7130

SEQ ID NO: 7240 - DNA, 201 bp, Homo sapiens; identical to SEQ ID NO: 7164

SEQ ID NO: 7241 - DNA, 201 bp, Homo sapiens; identical to SEQ ID NO: 7150

SEQ ID NO: 7242 - DNA, 201 bp, Homo sapiens; identical to SEQ ID NO: 7132

SEQ ID NO: 7243 - DNA, 201 bp, Homo sapiens; identical to SEQ ID NO: 7134

SEQ ID NO: 7244 - DNA, 201 bp, Homo sapiens; identical to SEQ ID NO: 7135

SEQ ID NO: 7245 - DNA, 201 bp, Homo sapiens; identical to SEQ ID NO: 7136

SEQ ID NO: 7246 - DNA, 201 bp, Homo sapiens
cctggaacttctaccagtgccactctgacaggcctcaccagaggtgccacctacaacatcatagtggaggcactgaaagaccagcagaggcataaggttcrggaagaggttgttaccgtgggcaactctggatggtgccatgacaatggtgtgaactacaagattggagagaagtgggaccgtcagggagaaaatggccag

SEQ ID NO: 7247 - DNA, 201 bp, Homo sapiens; identical to SEQ ID NO: 7123

SEQ ID NO: 7248 - DNA, 201 bp, Homo sapiens; identical to SEQ ID NO: 7124

SEQ ID NO: 7249 - DNA, 201 bp, Homo sapiens; identical to SEQ ID NO: 7199

SEQ ID NO: 7250 - DNA, 201 bp, Homo sapiens; identical to SEQ ID NO: 7127

SEQ ID NO: 7251 - DNA, 201 bp, Homo sapiens; identical to SEQ ID NO: 7129

SEQ ID NO: 7252 - DNA, 201 bp, Homo sapiens; identical to SEQ ID NO: 7202

SEQ ID NO: 7253 - DNA, 201 bp, Homo sapiens; identical to SEQ ID NO: 7133

SEQ ID NO: 7254 - DNA, 201 bp, Homo sapiens; identical to SEQ ID NO: 7126

SEQ ID NO: 7255 - DNA, 201 bp, Homo sapiens; identical to SEQ ID NO: 7128

SEQ ID NO: 7256 - DNA, 201 bp, Homo sapiens; identical to SEQ ID NO: 7130

SEQ ID NO: 7257 - DNA, 201 bp, Homo sapiens; identical to SEQ ID NO: 7131

SEQ ID NO: 7258 - DNA, 201 bp, Homo sapiens; identical to SEQ ID NO: 7132

SEQ ID NO: 7259 - DNA, 201 bp, Homo sapiens; identical to SEQ ID NO: 7134

SEQ ID NO: 7260 - DNA, 201 bp, Homo sapiens; identical to SEQ ID NO: 7135

SEQ ID NO: 7261 - DNA, 201 bp, Homo sapiens; identical to SEQ ID NO: 7136

SEQ ID NO: 7262 - DNA, 201 bp, Homo sapiens; identical to SEQ ID NO: 7137

SEQ ID NO: 7263 - DNA, 201 bp, Homo sapiens; identical to SEQ ID NO: 7132

SEQ ID NO: 7264 - DNA, 201 bp, Homo sapiens; identical to SEQ ID NO: 7124

SEQ ID NO: 7265 - DNA, 201 bp, Homo sapiens; identical to SEQ ID NO: 7125

SEQ ID NO: 7266 - DNA, 201 bp, Homo sapiens; identical to SEQ ID NO: 7126

SEQ ID NO: 7267 - DNA, 201 bp, Homo sapiens; identical to SEQ ID NO: 7134

SEQ ID NO: 7268 - DNA, 201 bp, Homo sapiens; identical to SEQ ID NO: 7137

SEQ ID NO: 7269 - DNA, 201 bp, Homo sapiens; identical to SEQ ID NO: 7129

SEQ ID NO: 7270 - DNA, 201 bp, Homo sapiens; identical to SEQ ID NO: 7123

SEQ ID NO: 7271 - DNA, 201 bp, Homo sapiens; identical to SEQ ID NO: 7126

SEQ ID NO: 7272 - DNA, 201 bp, Homo sapiens; identical to SEQ ID NO: 7127

SEQ ID NO: 7273 - DNA, 201 bp, Homo sapiens; identical to SEQ ID NO: 7128

SEQ ID NO: 7274 - DNA, 201 bp, Homo sapiens; identical to SEQ ID NO: 7129

SEQ ID NO: 7275 - DNA, 201 bp, Homo sapiens; identical to SEQ ID NO: 7130

SEQ ID NO: 7276 - DNA, 201 bp, Homo sapiens; identical to SEQ ID NO: 7131

SEQ ID NO: 7277 - DNA, 201 bp, Homo sapiens; identical to SEQ ID NO: 7150

SEQ ID NO: 7278 - DNA, 201 bp, Homo sapiens; identical to SEQ ID NO: 7132

SEQ ID NO: 7279 - DNA, 201 bp, Homo sapiens; identical to SEQ ID NO: 7134

SEQ ID NO: 7280 - DNA, 201 bp, Homo sapiens; identical to SEQ ID NO: 7133

SEQ ID NO: 7281 - DNA, 201 bp, Homo sapiens; identical to SEQ ID NO: 7135

SEQ ID NO: 7282 - DNA, 201 bp, Homo sapiens; identical to SEQ ID NO: 7136

SEQ ID NO: 7283 - DNA, 201 bp, Homo sapiens; identical to SEQ ID NO: 7123

SEQ ID NO: 7284 - DNA, 201 bp, Homo sapiens; identical to SEQ ID NO: 7124

SEQ ID NO: 7285 - DNA, 201 bp, Homo sapiens; identical to SEQ ID NO: 7125

SEQ ID NO: 7286 - DNA, 201 bp, Homo sapiens; identical to SEQ ID NO: 7127

SEQ ID NO: 7287 - DNA, 201 bp, Homo sapiens; identical to SEQ ID NO: 7129

SEQ ID NO: 7288 - DNA, 201 bp, Homo sapiens; identical to SEQ ID NO: 7133

SEQ ID NO: 7289 - DNA, 201 bp, Homo sapiens; identical to SEQ ID NO: 7126

SEQ ID NO: 7290 - DNA, 201 bp, Homo sapiens; identical to SEQ ID NO: 7128

SEQ ID NO: 7291 - DNA, 201 bp, Homo sapiens; identical to SEQ ID NO: 7130

SEQ ID NO: 7292 - DNA, 201 bp, Homo sapiens; identical to SEQ ID NO: 7131

SEQ ID NO: 7293 - DNA, 201 bp, Homo sapiens; identical to SEQ ID NO: 7150

SEQ ID NO: 7294 - DNA, 201 bp, Homo sapiens; identical to SEQ ID NO: 7132

SEQ ID NO: 7295 - DNA, 201 bp, Homo sapiens; identical to SEQ ID NO: 7134

SEQ ID NO: 7296 - DNA, 201 bp, Homo sapiens; identical to SEQ ID NO: 7135

SEQ ID NO: 7297 - DNA, 201 bp, Homo sapiens; identical to SEQ ID NO: 7136

SEQ ID NO: 7298 - DNA, 201 bp, Homo sapiens; identical to SEQ ID NO: 7137

SEQ ID NO: 7299 - DNA, 201 bp, Homo sapiens
caaccacaagcaggagtgccactgccacgcgggctgggccccgccccactgcgcgaagctgctgactgaggtgcacgcagcgtccgggagcctccccgtcytcgtggtggtggttctggtgctcctggcagttgtgctggtcaccctggcaggcatcatcgtctaccgcaaagcccggagccgcatcctgagcaggaacgt

SEQ ID NO: 7300 - DNA, 201 bp, Homo sapiens
gcgcggcctcgggctctggctgctgggcgcgatgatgctgcctgcgattgcccccagccggccctgggccctcatggagcagtatgaggtcgtgttgccgyggcgtctgccaggcccccgagtccgccgagctctgccctcccacttgggcctgcacccagagagggtgagctacgtccttggggccacagggcacaactt

SEQ ID NO: 7301 - DNA, 201 bp, Homo sapiens
ccctgacctcagccacctggtgggcggccccgtgtgtgggaacctgtttgtggagcgtggggagcagtgcgactgcggcccccccgaggactgccggaacygctgctgcaactctaccacctgccagctggctgagggggcccagtgtgcgcacggtacctgctgccaggagtgcaaggtgaagccggctggtgagctgtg

SEQ ID NO: 7302 - DNA, 201 bp, Homo sapiens
ggctacacagagacctatacggctgccaatggctccgaggtgacggagcagcctcgcaggcaggaccactgcttctaccagggccacgtagaggggtaccyggactcagccgccagcctcagcacctgtgccggcctcaggggtttcttccaggtggggtcagacctgcacctgatcgagcccctggatgaaggtggcgag

SEQ ID NO: 7303 - DNA, 201 bp, Homo sapiens
cagtgactgcagccaggcctacctggagagctttttggagcggccgcagtcggtgtgcctcgccaacgcccctgacctcagccacctggtgggcggccccrtgtgtgggaacctgtttgtggagcgtggggagcagtgcgactgcggcccccccgaggactgccggaaccgctgctgcaactctaccacctgccagctggc

SEQ ID NO: 7304 - DNA, 201 bp, Homo sapiens
gaggaagcaaggagccggagctcccacagcaccctaggggggcacctgcgcctgtgtggaaatttggagaagttgcggcagagaagccatgcgttccagcrttccacggtccagctagtgccgctcagccctagaccctgactttgcaggctcagctgctgttctaacctcagtaatgcatctacctgagaggctcctgct

SEQ ID NO: 7305 - DNA, 201 bp, Homo sapiens
gaggccgccccctgctcctccggtcactgtgtccagcccacccttcccagttcctgtctacacccggcaggcaccaaagcaggtcatcaagccaacgttcrcacccccagtgcccccagtcaaacccggggctggtgcggccaaccctggtccagctgagggtgctgttggcccaaaggttgccctgaagccccccatcca

SEQ ID NO: 7306 - DNA, 201 bp, Homo sapiens
cgtctaccgcaaagcccggagccgcatcctgagcaggaacgtggctcccaagaccacaatggggcgctccaaccccctgttccaccaggctgccagccgcrtgccggccaagggcggggctccagccccatccaggggcccccaagagctggtccccaccacccacccgggccagcccgcccgacacccggcctcctcggt

SEQ ID NO: 7307 - DNA, 201 bp, Homo sapiens
tcggtggctctgaagaggccgccccctgctcctccggtcactgtgtccagcccacccttcccagttcctgtctacacccggcaggcaccaaagcaggtcaycaagccaacgttcgcacccccagtgcccccagtcaaacccggggctggtgcggccaaccctggtccagctgagggtgctgttggcccaaaggttgccctg

SEQ ID NO: 7308 - DNA, 201 bp, Homo sapiens
cctcccacttgggcctgcacccagagagggtgagctacgtccttggggccacagggcacaacttcaccctccacctgcggaagaacagggacctgctgggytccggctacacagagacctatacggctgccaatggctccgaggtgacggagcagcctcgcaggcaggaccactgcttctaccagggccacgtagaggggt

SEQ ID NO: 7309 - DNA, 201 bp, Homo sapiens
tggcccatgagatgggccacaacctgggcatggaccatgatgagaacgtccagggctgccgctgccaggaacgcttcgaggccggccgctgcatcatggcrggcagcattggctccagtttccccaggatgttcagtgactgcagccaggcctacctggagagctttttggagcggccgcagtcggtgtgcctcgccaacg

SEQ ID NO: 7310 - DNA, 201 bp, Homo sapiens
ccgggactactgtggggtttgccagggtgtccgccatgtgctcccacagctcaggggctgtgaaccaggaccacagcaagaaccccgtgggcgtggcctgyaccatggcccatgagatgggccacaacctgggcatggaccatgatgagaacgtccagggctgccgctgccaggaacgcttcgaggccggccgctgcatca

SEQ ID NO: 7311 - DNA, 201 bp, Homo sapiens
tgcggcagagaagccatgcgttccagcgttccacggtccagctagtgccgctcagccctagaccctgactttgcaggctcagctgctgttctaacctcagkaatgcatctacctgagaggctcctgctgtccacgccctcagccaattccttctccccgccttggccacgtgtagccccagctgtctgcaggcaccaggct

SEQ ID NO: 7312 - DNA, 201 bp, Homo sapiens
cactggagaacctcctgacctggcaggcacggcaacggacacggcggcacctgcatgacaacgtacagctcatcacgggtgtcgacttcaccgggactacygtggggtttgccagggtgtccgccatgtgctcccacagctcaggggctgtgaaccaggaccacagcaagaaccccgtgggcgtggcctgcaccatggccc

SEQ ID NO: 7313 - DNA, 201 bp, Homo sapiens
agccggagctcccacagcaccctaggggggcacctgcgcctgtgtggaaatttggagaagttgcggcagagaagccatgcgttccagcgttccacggtccrgctagtgccgctcagccctagaccctgactttgcaggctcagctgctgttctaacctcagtaatgcatctacctgagaggctcctgctgtccacgccctc

SEQ ID NO: 7314 - DNA, 201 bp, Homo sapiens
gtgaggaccagacaccactgattgcaggaatgtgttccctccccatggcaagatactacataattaaatatgcagaccagaaggctctatacacaagagayggccagctgctggtgggagatcctgttgcagacaactgctgtgcagagaagatctgcatacttcctaacagaggcttggcccgcaccaaggtccccattt

SEQ ID NO: 7315 - DNA, 201 bp, Homo sapiens
aacagagctggtagggagacaggaaactgcgttttagccttgtgcccccaaaccaagctcatcctgctcagggtctatggtaggcagaataatgtcccccraaatatgtccacatcctaatcccaagatctgtgcatatgttaccatacatgtccaaagaggttttgcaaatgtgattatgttaaggatcttgaaatgagg

SEQ ID NO: 7316 - DNA, 201 bp, Homo sapiens
ataattaaatatgcagaccagaaggctctatacacaagagatggccagctgctggtgggagatcctgttgcagacaactgctgtgcagagaagatctgcayacttcctaacagaggcttggcccgcaccaaggtccccattttcctggggatccagggagggagccgctgcctggcatgtgtggagacagaagaggggcct

SEQ ID NO: 7317 - DNA, 201 bp, Homo sapiens
aaggctctatacacaagagatggccagctgctggtgggagatcctgttgcagacaactgctgtgcagagaagatctgcatacttcctaacagaggcttggmccgcaccaaggtccccattttcctggggatccagggagggagccgctgcctggcatgtgtggagacagaagaggggccttccctacagctggaggatgtg

SEQ ID NO: 7318 - DNA, 201 bp, Homo sapiens
gctcaccaaggagagtgagccctcagcccgtaccaagttttactttgaacagagctggtagggagacaggaaactgcgttttagccttgtgcccccaaacyaagctcatcctgctcagggtctatggtaggcagaataatgtcccccgaaatatgtccacatcctaatcccaagatctgtgcatatgttaccatacatgtc

SEQ ID NO: 7319 - DNA, 201 bp, Homo sapiens
tggtgggagatcctgttgcagacaactgctgtgcagagaagatctgcatacttcctaacagaggcttggcccgcaccaaggtccccattttcctggggatycagggagggagccgctgcctggcatgtgtggagacagaagaggggccttccctacagctggaggatgtgaacattgaggaactgtacaaaggtggtgaag

SEQ ID NO: 7320 - DNA, 118 bp, Homo sapiens
gctgtggcctctcctagygaggggacatgactcctgcagaagtcctggctcaccgtccagtctgcatgcagggccaggccaggtgtgcccatgtccagttccttcctgcctgagcctt

SEQ ID NO: 7321 - DNA, 201 bp, Homo sapiens
agttccttcctgcctgagcctttacctgccaagagcctgcaacatggggttcccttgtcccttgactcttctctctcttccctcctagagaagatctgcayacttcctaacagaggcttggcccgcaccaaggtccccattttcctggggatccagggagggagccgctgcctggcatgtgtggagacagaagaggggcct

SEQ ID NO: 7322 - DNA, 109 bp, Homo sapiens
gctgtggcmtctcctagcgaggggacatgactcctgcagaagtcctggctcaccgtccagtctgcatgcagggccaggccaggtgtgcccatgtccagttccttcctgc

SEQ ID NO: 7323 - DNA, 201 bp, Homo sapiens
ttacctgccaagagcctgcaacatggggttcccttgtcccttgactcttctctctcttccctcctagagaagatctgcatacttcctaacagaggcttggmccgcaccaaggtccccattttcctggggatccagggagggagccgctgcctggcatgtgtggagacagaagaggggccttccctacagctggaggatgtg

SEQ ID NO: 7324 - DNA, 201 bp, Homo sapiens; identical to SEQ ID NO: 7318

SEQ ID NO: 7325 - DNA, 135 bp, Homo sapiens
gctgtggcctctcctagcgaggggacatgactccygcagaagtcctggctcaccgtccagtctgcatgcagggccaggccaggtgtgcccatgtccagttccttcctgcctgagcctttacctgccaagagcctg

SEQ ID NO: 7326 - DNA, 201 bp, Homo sapiens; identical to SEQ ID NO: 7315

SEQ ID NO: 7327 - DNA, 201 bp, Homo sapiens
ccttgtcccttgactcttctctctcttccctcctagagaagatctgcatacttcctaacagaggcttggcccgcaccaaggtccccattttcctggggatycagggagggagccgctgcctggcatgtgtggagacagaagaggggccttccctacagctggaggatgtgaacattgaggaactgtacaaaggtggtgaag

SEQ ID NO: 7328 - DNA, 201 bp, Homo sapiens
ggaattaagttgtggaacataagagtcaaggctcgtgtctgctgtgaactggagttgagggaatgtttggggatcccacctggtatcagtaagggaaccayggcgacggccagccttgcccatgtgaggcatttgctttgtcaggccttctcagtagtggagaagggaggaaggagaatgcagctctttcagtgctgtcta

SEQ ID NO: 7329 - DNA, 167 bp, Homo sapiens
tgagtagggggcctgcagtgtgctgtgacgcctgggaaggggattctaagccatttcccatcagccrtttactaagtagcctggggatcttgttaaaatgcagatcctgatagattagggctggggtgctgcccaagattctacatttctaagagtccctggatgac

SEQ ID NO: 7330 - DNA, 201 bp, Homo sapiens
ttttccagagtgtgggcattaccccaactgtctctgcagacggcttcctgcatgtttcccacaagcgctcagatggctgaattggcaagtctgtggtgctrctctttggggccacctcgttctttgcctttccctccccttagcgatgtgtcccatccgttgcctacagtcaagtcagtccacatgtttaggctaaggtgg

SEQ ID NO: 7331 - DNA, 201 bp, Homo sapiens
tacagtcaagtcagtccacatgtttaggctaaggtgggcatgaccgagtggccttcccccgggaagaccagtgtcgtaactggaattaagttgtggaacayaagagtcaaggctcgtgtctgctgtgaactggagttgagggaatgtttggggatcccacctggtatcagtaagggaaccatggcgacggccagccttgcc

SEQ ID NO: 7332 - DNA, 201 bp, Homo sapiens
tctttcacctgttttcttcctccagatacttactgaggcagaggagagtgggtggtgggaaaaaagagtgggttgggggtaaggagggaatcttttttttsacgcttttgctttaaaattcagagttggattggtcaggatttatgggctctttgccatgtaaatttttctcattctccaggttctagccctccaggttca

SEQ ID NO: 7333 - DNA, 201 bp, Homo sapiens
ctcagtccacgttgatttctcctcatctgaatcacaaaggagcaggcatggaagtgttctgagcagcaattttacttaccacacgagtgatggagatgcaytgctccttctctgaagggaatcccaaagccttgtgtctacagagaacctggagttcctgaacctgatgctgactagtgaggaaagatttttgttgttatt

SEQ ID NO: 7334 - DNA, 201 bp, Homo sapiens
ttttggaagcatattcttcatcaccgtcatcagcattgataggtacctggccatcgtcctggccgccaactccatgaacaaccggaccgtgcagcatggcrtcaccatcagcctaggcgtctgggcagcagccattttggtggcagcaccccagttcatgttcacaaagcagaaagaaaatgaatgccttggtgactaccc

SEQ ID NO: 7335 - DNA, 201 bp, Homo sapiens
tacaacgttatgattttcctggagacgcttaagctctatgacttctttcccagttgtgacatgaggaaggatctgaggctggccctcagtgtgactgagayggttgcatttagccattgttgcctgaatcctctcatctatgcatttgctggggagaagttcagaagatacctttaccacctgtatgggaaatgcctggct

SEQ ID NO: 7336 - DNA, 201 bp, Homo sapiens
aagcagaaatacatatttccaagaagttggatgggtgggtactattctgattacacaaaacaaatgccacacatcacccttaccatgtgcctgatccagcytctcccctgattacaccagcctcgtcttcattaagccctcttccatcatgtccccaaacctgcaagggctccccactgcctactgcatcgagtcaaaact

SEQ ID NO: 7337 - DNA, 201 bp, Homo sapiens
ccagacgctgttttcctgcaagaaccacaagaaagccaaagccattaaactgatccttctggtggtcatcgtgtttttcctcttctggacaccctacaacrttatgattttcctggagacgcttaagctctatgacttctttcccagttgtgacatgaggaaggatctgaggctggccctcagtgtgactgagacggttgc

SEQ ID NO: 7338 - DNA, 201 bp, Homo sapiens
ctgatgctgactagtgaggaaagatttttgttgttatttcttacaggcacaaaatgatggacccaatgcacacaaaacaaccctagagtgttgttgagaaytgtgctcaaaatttgaagaatgaacaaattgaactctttgaatgacaaagagtagacatttctcttactgcaaatgtcatcagaactttttggtttgcag

SEQ ID NO: 7339 - DNA, 201 bp, Homo sapiens
tctggcccgtgctccgcaatgtggaaacaaattttcttggcttcctactccccctgctcattatgagttattgctacttcagaatcatccagacgctgttytcctgcaagaaccacaagaaagccaaagccattaaactgatccttctggtggtcatcgtgtttttcctcttctggacaccctacaacgttatgattttcc

SEQ ID NO: 7340 - DNA, 201 bp, Homo sapiens
atcagaactttttggtttgcagatgacaaaaattcaactcagactagtttagttaaatgagggtggtgaatattgttcatattgtggcacaagcaaaaggrtgtctgagccctcaaagtgaggggaaaccagggcctgagccaagctagaattccctctctctgactctcaaatcttttagtcattatagatcccccagac

SEQ ID NO: 7341 - DNA, 201 bp, Homo sapiens
cgaggtcctccaggaaatctggcccgtgctccgcaatgtggaaacaaattttcttggcttcctactccccctgctcattatgagttattgctacttcagartcatccagacgctgttttcctgcaagaaccacaagaaagccaaagccattaaactgatccttctggtggtcatcgtgtttttcctcttctggacacccta

SEQ ID NO: 7342 - DNA, 201 bp, Homo sapiens; identical to SEQ ID NO: 7333

SEQ ID NO: 7343 - DNA, 201 bp, Homo sapiens; identical to SEQ ID NO: 7334

SEQ ID NO: 7344 - DNA, 201 bp, Homo sapiens; identical to SEQ ID NO: 7335

SEQ ID NO: 7345 - DNA, 201 bp, Homo sapiens; identical to SEQ ID NO: 7336

SEQ ID NO: 7346 - DNA, 201 bp, Homo sapiens; identical to SEQ ID NO: 7337

SEQ ID NO: 7347 - DNA, 201 bp, Homo sapiens; identical to SEQ ID NO: 7338

SEQ ID NO: 7348 - DNA, 201 bp, Homo sapiens; identical to SEQ ID NO: 7339

SEQ ID NO: 7349 - DNA, 201 bp, Homo sapiens; identical to SEQ ID NO: 7340

SEQ ID NO: 7350 - DNA, 201 bp, Homo sapiens; identical to SEQ ID NO: 7341

SEQ ID NO: 7351 - DNA, 201 bp, Homo sapiens
ggatgtgatgaagaaactcagcaacacttcgtaccagtttgctgctgttcagttttccacaagctacaaaacagaatttgatttctcagattatgttaaayggaaggaccctgatgctctgctgaagcatgtaaagcacatgttgctgttgaccaatacctttggtgccatcaattatgtcgcgacagaggtgttccggga

SEQ ID NO: 7352 - DNA, 201 bp, Homo sapiens
agtgtgaggcaaacttgagagtgtccttctctcctgcaagatccagagccctgcgtctaactgcttttgccagcctctctgtggagctgagcctgagtaayttggaagaagatgcttactgggtccagctggacctgcacttccccccgggactctccttccgcaaggtggagatgctgaagccccatagccagatacctg

SEQ ID NO: 7353 - DNA, 201 bp, Homo sapiens
atgcggccaaagacatcatccgctacatcatcgggattggaaagcattttcagaccaaggagagtcaggagaccctccacaaatttgcatcaaaacccgcragcgagtttgtgaaaattctggacacatttgagaagctgaaagatctattcactgagctgcagaagaagatctatgtcattgagggcacaagcaaacagg

SEQ ID NO: 7354 - DNA, 201 bp, Homo sapiens
gtagtctcaggacctagggatgttctggccctcacccctgccctgggatgtccacagatgcctccaccccccagaacctgtccttgcacactcccctgcastggagtccagtctcttctgctggcagaaagcaaatgtgacctgtgtcactacgtgactgtggcacacgccttgttcttggccaaagaccaaattccttgg

SEQ ID NO: 7355 - DNA, 201 bp, Homo sapiens
cattatcttgcaatgtgagctctcccatcttcaaagcaggccactcggttgctctgcagatgatgtttaatacactggtaaacagctcctggggggactckgttgaattgcacgccaatgtgacctgtaacaatgaggactcagacctcctggaggacaactcagccactaccatcatccccatcctgtaccccatcaaca

SEQ ID NO: 7356 - DNA, 201 bp, Homo sapiens
gtttaatacactggtaaacagctcctggggggactcggttgaattgcacgccaatgtgacctgtaacaatgaggactcagacctcctggaggacaactcarccactaccatcatccccatcctgtaccccatcaacatcctcatccaggaccaagaagactccacactctatgtcagtttcacccccaaaggccccaagat

SEQ ID NO: 7357 - DNA, 201 bp, Homo sapiens
tgttttttccctgtttaatgattgacgtacttagcagctatctctcagtgaactgtgagggtaaaggctatacttgtcttgttcaccttgggatgatgcckcatgatatgtcagggcgtgggacatctagtaggtgcttgacataatttcactgaattaatgacagagccagtgggaagatacagaaaaagaggggctggg

SEQ ID NO: 7358 - DNA, 201 bp, Homo sapiens
gcctcatgatatgtcagggcgtgggacatctagtaggtgcttgacataatttcactgaattaatgacagagccagtgggaagatacagaaaaagaggggckgggctgggcgcggtggttcacgcctgtaatcccagcactttgggaggccaaggagggtggatcacctgaggtcaggagttagaggccagcctggcgaaac

SEQ ID NO: 7359 - DNA, 201 bp, Homo sapiens
tcgatgcggccaaagacatcatccgctacatcatcgggattggaaagcattttcagaccaaggagagtcaggagaccctccacaaatttgcatcaaaaccygcgagcgagtttgtgaaaattctggacacatttgagaagctgaaagatctattcactgagctgcagaagaagatctatgtcattgagggcacaagcaaac

SEQ ID NO: 7360 - DNA, 201 bp, Homo sapiens
tcatttcccggtatgtgttcaagacctcatctcccccatcaatgtttccctgaatttctctctttgggaggaggaagggacaccgagggaccaaagggcgmagggcaaggacataccgcccatcctgagaccctccctgcactcggaaacctgggagatcccttttgagaagaactgtggggaggacaagaagtgtgaggc

SEQ ID NO: 7361 - DNA, 201 bp, Homo sapiens
ctgcactcggaaacctgggagatcccttttgagaagaactgtggggaggacaagaagtgtgaggcaaacttgagagtgtccttctctcctgcaagatccasagccctgcgtctaactgcttttgccagcctctctgtggagctgagcctgagtaacttggaagaagatgcttactgggtccagctggacctgcacttcccc

SEQ ID NO: 7362 - DNA, 201 bp, Homo sapiens
tggatgttttttccctgtttaatgattgacgtacttagcagctatctctcagtgaactgtgagggtaaaggctatacttgtcttgttcaccttgggatgaygcctcatgatatgtcagggcgtgggacatctagtaggtgcttgacataatttcactgaattaatgacagagccagtgggaagatacagaaaaagaggggc

SEQ ID NO: 7363 - DNA, 201 bp, Homo sapiens
gaccttggcaacagaccccacagatggaagcattttgtttgctgctgttcagttttccacaagctacaaaacagaatttgatttctcagattatgttaaayggaaggaccctgatgctctgctgaagcatgtaaagcacatgttgctgttgaccaatacctttggtgccatcaattatgtcgcgacagaggtgttccggga

SEQ ID NO: 7364 - DNA, 201 bp, Homo sapiens; identical to SEQ ID NO: 7352

SEQ ID NO: 7365 - DNA, 201 bp, Homo sapiens; identical to SEQ ID NO: 7353

SEQ ID NO: 7366 - DNA, 201 bp, Homo sapiens; identical to SEQ ID NO: 7354

SEQ ID NO: 7367 - DNA, 201 bp, Homo sapiens; identical to SEQ ID NO: 7355

SEQ ID NO: 7368 - DNA, 201 bp, Homo sapiens; identical to SEQ ID NO: 7356

SEQ ID NO: 7369 - DNA, 201 bp, Homo sapiens; identical to SEQ ID NO: 7357

SEQ ID NO: 7370 - DNA, 201 bp, Homo sapiens; identical to SEQ ID NO: 7358

SEQ ID NO: 7371 - DNA, 201 bp, Homo sapiens; identical to SEQ ID NO: 7359

SEQ ID NO: 7372 - DNA, 201 bp, Homo sapiens; identical to SEQ ID NO: 7361

SEQ ID NO: 7373 - DNA, 201 bp, Homo sapiens; identical to SEQ ID NO: 7362

SEQ ID NO: 7374 - DNA, 201 bp, Homo sapiens; identical to SEQ ID NO: 7351

SEQ ID NO: 7375 - DNA, 201 bp, Homo sapiens; identical to SEQ ID NO: 7352

SEQ ID NO: 7376 - DNA, 201 bp, Homo sapiens; identical to SEQ ID NO: 7353

SEQ ID NO: 7377 - DNA, 201 bp, Homo sapiens; identical to SEQ ID NO: 7354

SEQ ID NO: 7378 - DNA, 201 bp, Homo sapiens; identical to SEQ ID NO: 7355

SEQ ID NO: 7379 - DNA, 201 bp, Homo sapiens; identical to SEQ ID NO: 7356

SEQ ID NO: 7380 - DNA, 201 bp, Homo sapiens; identical to SEQ ID NO: 7357

SEQ ID NO: 7381 - DNA, 201 bp, Homo sapiens; identical to SEQ ID NO: 7358

SEQ ID NO: 7382 - DNA, 201 bp, Homo sapiens; identical to SEQ ID NO: 7359

SEQ ID NO: 7383 - DNA, 201 bp, Homo sapiens; identical to SEQ ID NO: 7360

SEQ ID NO: 7384 - DNA, 201 bp, Homo sapiens; identical to SEQ ID NO: 7361

SEQ ID NO: 7385 - DNA, 201 bp, Homo sapiens; identical to SEQ ID NO: 7362

SEQ ID NO: 7386 - DNA, 201 bp, Homo sapiens
gcgttcacactctctgcactacctcttcatgggtgcctcagagcaggaccttggtctttccttgtttgaagctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 7387 - DNA, 201 bp, Homo sapiens
tctgcactacctcttcatgggtgcctcagagcaggaccttggtctttccttgtttgaagctttgggctacgtggatgaccagctgttcgtgttctatgatsatgagagtcgccgtgtggagccccgaactccatgggtttccagtagaatttcaagccagatgtggctgcagctgagtcagagtctgaaagggtgggatca

SEQ ID NO: 7388 - DNA, 201 bp, Homo sapiens
accttaccagatttttacacatgtatctatgcattttctggacccgttcaacttttcctttgaatcctctctctgtgttacccagtaactcatctgtcacyaagccttggggattcttccatctgattgtgatgtgagttgcacagctatgaaggctgtacactgcacgaatggaagaggcacctgtcccagaaaaagcat

SEQ ID NO: 7389 - DNA, 201 bp, Homo sapiens
ggcccgcgagccaggccggcgcttctcctcctgatgcttttgcagaccgcggtcctgcaggggcgcttgctgcgttcacactctctgcactacctcttcaygggtgcctcagagcaggaccttggtctttccttgtttgaagctttgggctacgtggatgaccagctgttcgtgttctatgatcatgagagtcgccgtgtg

SEQ ID NO: 7390 - DNA, 201 bp, Homo sapiens
cctgcaggggcgcttgctgcgttcacactctctgcactacctcttcatgggtgcctcagagcaggaccttggtctttccttgtttgaagctttgggctacrtggatgaccagctgttcgtgttctatgatcatgagagtcgccgtgtggagccccgaactccatgggtttccagtagaatttcaagccagatgtggctgca

SEQ ID NO: 7391 - DNA, 111 bp, Homo sapiens
aagctgttatttaattagccagtgaaaaactattaacaacttgtctattacctgttagtattattgttgcattaaaaatgcatatactttaataaatgtayattgtattgt

SEQ ID NO: 7392 - DNA, 201 bp, Homo sapiens
gccaaggagttcgaacctaaagacgtattgcccaatggggatgggacctaccagggctggataaccttggctgtaccccctggggaagagcagagatataygtgccaggtggagcacccaggcctggatcagcccctcattgtgatctgggagccctcaccgtctggcaccctagtcattggagtcatcagtggaattgct

SEQ ID NO: 7393 - DNA, 201 bp, Homo sapiens
tgcactacctcttcatgggtgcctcagagcaggaccttggtctttccttgtttgaagctttgggctacgtggatgaccagctgttcgtgttctatgatcaygagagtcgccgtgtggagccccgaactccatgggtttccagtagaatttcaagccagatgtggctgcagctgagtcagagtctgaaagggtgggatcaca

SEQ ID NO: 7394 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggtgcctcctttggtgaaggtgacacatcatgtgacctc

SEQ ID NO: 7395 - DNA, 201 bp, Homo sapiens
tcatcagtggaattgctgtttttgtcgtcatcttgttcattggaattttgttcataatattaaggaagaggcagggttcaagaggagccatggggcactaygtcttagctgaacgtgagtgacacgcagcctgcagactcactgtgggaaggagacaaaactagagactcaaagagggagtgcatttatgagctcttcatg

SEQ ID NO: 7396 - DNA, 201 bp, Homo sapiens
aaggagttcgaacctaaagacgtattgcccaatggggatgggacctaccagggctggataaccttggctgtaccccctggggaagagcagagatatacgtvccaggtggagcacccaggcctggatcagcccctcattgtgatctgggagccctcaccgtctggcaccctagtcattggagtcatcagtggaattgctgtt

SEQ ID NO: 7397 - DNA, 201 bp, Homo sapiens
ctcagagcaggaccttggtctttccttgtttgaagctttgggctacgtggatgaccagctgttcgtgttctatgatcatgagagtcgccgtgtggagcccygaactccatgggtttccagtagaatttcaagccagatgtggctgcagctgagtcagagtctgaaagggtgggatcacatgttcactgttgacttctggac

SEQ ID NO: 7398 - DNA, 201 bp, Homo sapiens
ttgaatcctctctctgtgttacccagtaactcatctgtcaccaagccttggggattcttccatctgattgtgatgtgagttgcacagctatgaaggctgtrcactgcacgaatggaagaggcacctgtcccagaaaaagcatcatggctatctgtgggtagtatgatgggtgtttttagcaggtaggaggcaaatatcttg

SEQ ID NO: 7399 - DNA, 201 bp, Homo sapiens
ctacctcttcatgggtgcctcagagcaggaccttggtctttccttgtttgaagctttgggctacgtggatgaccagctgttcgtgttctatgatcatgagwgtcgccgtgtggagccccgaactccatgggtttccagtagaatttcaagccagatgtggctgcagctgagtcagagtctgaaagggtgggatcacatgtt

SEQ ID NO: 7400 - DNA, 201 bp, Homo sapiens
tgggagccctcaccgtctggcaccctagtcattggagtcatcagtggaattgctgtttttgtcgtcatcttgttcattggaattttgttcataatattaakgaagaggcagggttcaagaggagccatggggcactacgtcttagctgaacgtgagtgacacgcagcctgcagactcactgtgggaaggagacaaaactag

SEQ ID NO: 7401 - DNA, 201 bp, Homo sapiens
caccctgcccagccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttt

SEQ ID NO: 7402 - DNA, 201 bp, Homo sapiens; identical to SEQ ID NO: 7386

SEQ ID NO: 7403 - DNA, 201 bp, Homo sapiens
tctgcactacctcttcatgggtgcctcagagcaggaccttggtctttccttgtttgaagctttgggctacgtggatgaccagctgttcgtgttctatgatsatgagagtcgccgtgtggagccccgaactccatgggtttccagtagaatttcaagccagatgtggctgcagctgagtcagagtctgaaaggccgtcaaaa

SEQ ID NO: 7404 - DNA, 201 bp, Homo sapiens; identical to SEQ ID NO: 7389

SEQ ID NO: 7405 - DNA, 201 bp, Homo sapiens; identical to SEQ ID NO: 7390

SEQ ID NO: 7406 - DNA, 112 bp, Homo sapiens
aagctgttatttaattagccagtgaaaaactattaacaacttgtctattacctgttagtattattgttgcattaaaaatgcatatactttaataaatgtayattgtattgta

SEQ ID NO: 7407 - DNA, 201 bp, Homo sapiens
tgcactacctcttcatgggtgcctcagagcaggaccttggtctttccttgtttgaagctttgggctacgtggatgaccagctgttcgtgttctatgatcaygagagtcgccgtgtggagccccgaactccatgggtttccagtagaatttcaagccagatgtggctgcagctgagtcagagtctgaaaggccgtcaaaaga

SEQ ID NO: 7408 - DNA, 201 bp, Homo sapiens
ctcagagcaggaccttggtctttccttgtttgaagctttgggctacgtggatgaccagctgttcgtgttctatgatcatgagagtcgccgtgtggagcccygaactccatgggtttccagtagaatttcaagccagatgtggctgcagctgagtcagagtctgaaaggccgtcaaaagagtcttaatatatatatccagat

SEQ ID NO: 7409 - DNA, 201 bp, Homo sapiens
ctacctcttcatgggtgcctcagagcaggaccttggtctttccttgtttgaagctttgggctacgtggatgaccagctgttcgtgttctatgatcatgagwgtcgccgtgtggagccccgaactccatgggtttccagtagaatttcaagccagatgtggctgcagctgagtcagagtctgaaaggccgtcaaaagagtct

SEQ ID NO: 7410 - DNA, 201 bp, Homo sapiens
gttctatgatcatgagagtcgccgtgtggagccccgaactccatgggtttccagtagaatttcaagccagatgtggctgcagctgagtcagagtctgaaasgccgtcaaaagagtcttaatatatatatccagatggcatgtgtttactttatgttactacatgcacttggctgcataaatgtggtacaagcattctgtct

SEQ ID NO: 7411 - DNA, 201 bp, Homo sapiens
gagtctgaaaggccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttt

SEQ ID NO: 7412 - DNA, 201 bp, Homo sapiens; identical to SEQ ID NO: 7388

SEQ ID NO: 7413 - DNA, 201 bp, Homo sapiens; identical to SEQ ID NO: 7395

SEQ ID NO: 7414 - DNA, 201 bp, Homo sapiens; identical to SEQ ID NO: 7396

SEQ ID NO: 7415 - DNA, 111 bp, Homo sapiens; identical to SEQ ID NO: 7391

SEQ ID NO: 7416 - DNA, 201 bp, Homo sapiens; identical to SEQ ID NO: 7392

SEQ ID NO: 7417 - DNA, 201 bp, Homo sapiens; identical to SEQ ID NO: 7398

SEQ ID NO: 7418 - DNA, 201 bp, Homo sapiens; identical to SEQ ID NO: 7400

SEQ ID NO: 7419 - DNA, 201 bp, Homo sapiens; identical to SEQ ID NO: 7401

SEQ ID NO: 7420 - DNA, 201 bp, Homo sapiens
tggaagtacgggtatgatgggcaggaccaccttgaattctgccctgacacactggattggagagcagcagaacccagggcctggcccaccaagctggagtrggaaaggcacaagattcgggccaggcagaacagggcctacctggagagggactgccctgcacagctgcagcagttgctggagctggggagaggtgttttg

SEQ ID NO: 7421 - DNA, 201 bp, Homo sapiens; identical to SEQ ID NO: 7388

SEQ ID NO: 7422 - DNA, 201 bp, Homo sapiens; identical to SEQ ID NO: 7395

SEQ ID NO: 7423 - DNA, 201 bp, Homo sapiens; identical to SEQ ID NO: 7396

SEQ ID NO: 7424 - DNA, 111 bp, Homo sapiens; identical to SEQ ID NO: 7391

SEQ ID NO: 7425 - DNA, 201 bp, Homo sapiens; identical to SEQ ID NO: 7392

SEQ ID NO: 7426 - DNA, 201 bp, Homo sapiens; identical to SEQ ID NO: 7398

SEQ ID NO: 7427 - DNA, 201 bp, Homo sapiens; identical to SEQ ID NO: 7400

SEQ ID NO: 7428 - DNA, 201 bp, Homo sapiens; identical to SEQ ID NO: 7401

SEQ ID NO: 7429 - DNA, 201 bp, Homo sapiens
ctactggaagtacgggtatgatgggcaggaccaccttgaattctgccctgacacactggattggagagcagcagaacccagggcctggcccaccaagctgkagtgggaaaggcacaagattcgggccaggcagaacagggcctacctggagagggactgccctgcacagctgcagcagttgctggagctggggagaggtgt

SEQ ID NO: 7430 - DNA, 201 bp, Homo sapiens
ggccggcgcttctcctcctgatgcttttgcagaccgcggtcctgcaggggcgcttgctgcagtcccacaccctgcaggtcatcctgggctgtgaaatgcamgaagacaacagtaccgagggctactggaagtacgggtatgatgggcaggaccaccttgaattctgccctgacacactggattggagagcagcagaaccca

SEQ ID NO: 7431 - DNA, 201 bp, Homo sapiens; identical to SEQ ID NO: 7386

SEQ ID NO: 7432 - DNA, 201 bp, Homo sapiens; identical to SEQ ID NO: 7387

SEQ ID NO: 7433 - DNA, 201 bp, Homo sapiens; identical to SEQ ID NO: 7388

SEQ ID NO: 7434 - DNA, 201 bp, Homo sapiens; identical to SEQ ID NO: 7389

SEQ ID NO: 7435 - DNA, 201 bp, Homo sapiens; identical to SEQ ID NO: 7390

SEQ ID NO: 7436 - DNA, 111 bp, Homo sapiens; identical to SEQ ID NO: 7391

SEQ ID NO: 7437 - DNA, 201 bp, Homo sapiens; identical to SEQ ID NO: 7393

SEQ ID NO: 7438 - DNA, 201 bp, Homo sapiens; identical to SEQ ID NO: 7392

SEQ ID NO: 7439 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggagtcccacaccctgcaggtcatcctgggctgtgaaat

SEQ ID NO: 7440 - DNA, 201 bp, Homo sapiens; identical to SEQ ID NO: 7429

SEQ ID NO: 7441 - DNA, 201 bp, Homo sapiens
gggatcacatgttcactgttgacttctggactattatggaaaatcacaaccacagcaaggagtcccacaccctgcaggtcatcctgggctgtgaaatgcamgaagacaacagtaccgagggctactggaagtacgggtatgatgggcaggaccaccttgaattctgccctgacacactggattggagagcagcagaaccca

SEQ ID NO: 7442 - DNA, 201 bp, Homo sapiens; identical to SEQ ID NO: 7420

SEQ ID NO: 7443 - DNA, 201 bp, Homo sapiens; identical to SEQ ID NO: 7395

SEQ ID NO: 7444 - DNA, 201 bp, Homo sapiens; identical to SEQ ID NO: 7396

SEQ ID NO: 7445 - DNA, 201 bp, Homo sapiens; identical to SEQ ID NO: 7397

SEQ ID NO: 7446 - DNA, 201 bp, Homo sapiens; identical to SEQ ID NO: 7398

SEQ ID NO: 7447 - DNA, 201 bp, Homo sapiens; identical to SEQ ID NO: 7399

SEQ ID NO: 7448 - DNA, 201 bp, Homo sapiens; identical to SEQ ID NO: 7400

SEQ ID NO: 7449 - DNA, 201 bp, Homo sapiens; identical to SEQ ID NO: 7401

SEQ ID NO: 7450 - DNA, 201 bp, Homo sapiens; identical to SEQ ID NO: 7386

SEQ ID NO: 7451 - DNA, 201 bp, Homo sapiens; identical to SEQ ID NO: 7387

SEQ ID NO: 7452 - DNA, 201 bp, Homo sapiens; identical to SEQ ID NO: 7388

SEQ ID NO: 7453 - DNA, 201 bp, Homo sapiens; identical to SEQ ID NO: 7395

SEQ ID NO: 7454 - DNA, 201 bp, Homo sapiens; identical to SEQ ID NO: 7389

SEQ ID NO: 7455 - DNA, 201 bp, Homo sapiens; identical to SEQ ID NO: 7396

SEQ ID NO: 7456 - DNA, 201 bp, Homo sapiens; identical to SEQ ID NO: 7390

SEQ ID NO: 7457 - DNA, 201 bp, Homo sapiens; identical to SEQ ID NO: 7392

SEQ ID NO: 7458 - DNA, 201 bp, Homo sapiens; identical to SEQ ID NO: 7393

SEQ ID NO: 7459 - DNA, 201 bp, Homo sapiens; identical to SEQ ID NO: 7397

SEQ ID NO: 7460 - DNA, 201 bp, Homo sapiens; identical to SEQ ID NO: 7398

SEQ ID NO: 7461 - DNA, 201 bp, Homo sapiens; identical to SEQ ID NO: 7394

SEQ ID NO: 7462 - DNA, 201 bp, Homo sapiens; identical to SEQ ID NO: 7399

SEQ ID NO: 7463 - DNA, 201 bp, Homo sapiens; identical to SEQ ID NO: 7400

SEQ ID NO: 7464 - DNA, 201 bp, Homo sapiens; identical to SEQ ID NO: 7386

SEQ ID NO: 7465 - DNA, 201 bp, Homo sapiens; identical to SEQ ID NO: 7387

SEQ ID NO: 7466 - DNA, 201 bp, Homo sapiens; identical to SEQ ID NO: 7388

SEQ ID NO: 7467 - DNA, 201 bp, Homo sapiens; identical to SEQ ID NO: 7389

SEQ ID NO: 7468 - DNA, 201 bp, Homo sapiens; identical to SEQ ID NO: 7390

SEQ ID NO: 7469 - DNA, 111 bp, Homo sapiens; identical to SEQ ID NO: 7391

SEQ ID NO: 7470 - DNA, 201 bp, Homo sapiens; identical to SEQ ID NO: 7393

SEQ ID NO: 7471 - DNA, 201 bp, Homo sapiens; identical to SEQ ID NO: 7392

SEQ ID NO: 7472 - DNA, 201 bp, Homo sapiens; identical to SEQ ID NO: 7439

SEQ ID NO: 7473 - DNA, 201 bp, Homo sapiens; identical to SEQ ID NO: 7429

SEQ ID NO: 7474 - DNA, 201 bp, Homo sapiens; identical to SEQ ID NO: 7441

SEQ ID NO: 7475 - DNA, 201 bp, Homo sapiens; identical to SEQ ID NO: 7420

SEQ ID NO: 7476 - DNA, 201 bp, Homo sapiens; identical to SEQ ID NO: 7395

SEQ ID NO: 7477 - DNA, 201 bp, Homo sapiens; identical to SEQ ID NO: 7396

SEQ ID NO: 7478 - DNA, 201 bp, Homo sapiens; identical to SEQ ID NO: 7397

SEQ ID NO: 7479 - DNA, 201 bp, Homo sapiens; identical to SEQ ID NO: 7398

SEQ ID NO: 7480 - DNA, 201 bp, Homo sapiens; identical to SEQ ID NO: 7399

SEQ ID NO: 7481 - DNA, 201 bp, Homo sapiens; identical to SEQ ID NO: 7400

SEQ ID NO: 7482 - DNA, 201 bp, Homo sapiens; identical to SEQ ID NO: 7401

SEQ ID NO: 7483 - DNA, 201 bp, Homo sapiens; identical to SEQ ID NO: 7420

SEQ ID NO: 7484 - DNA, 201 bp, Homo sapiens; identical to SEQ ID NO: 7388

SEQ ID NO: 7485 - DNA, 201 bp, Homo sapiens; identical to SEQ ID NO: 7395

SEQ ID NO: 7486 - DNA, 201 bp, Homo sapiens; identical to SEQ ID NO: 7396

SEQ ID NO: 7487 - DNA, 111 bp, Homo sapiens; identical to SEQ ID NO: 7391

SEQ ID NO: 7488 - DNA, 201 bp, Homo sapiens; identical to SEQ ID NO: 7392

SEQ ID NO: 7489 - DNA, 201 bp, Homo sapiens; identical to SEQ ID NO: 7398

SEQ ID NO: 7490 - DNA, 201 bp, Homo sapiens; identical to SEQ ID NO: 7400

SEQ ID NO: 7491 - DNA, 201 bp, Homo sapiens; identical to SEQ ID NO: 7401

SEQ ID NO: 7492 - DNA, 201 bp, Homo sapiens; identical to SEQ ID NO: 7429

SEQ ID NO: 7493 - DNA, 201 bp, Homo sapiens; identical to SEQ ID NO: 7430

SEQ ID NO: 7494 - DNA, 201 bp, Homo sapiens
cccgcgagccaggccggcgcttctcctcctgatgcttttgcagaccgcggtcctgcaggggcgcttgctgcctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 7495 - DNA, 201 bp, Homo sapiens
gccggcgcttctcctcctgatgcttttgcagaccgcggtcctgcaggggcgcttgctgcctttgggctacgtggatgaccagctgttcgtgttctatgatsatgagagtcgccgtgtggagccccgaactccatgggtttccagtagaatttcaagccagatgtggctgcagctgagtcagagtctgaaagggtgggatca

SEQ ID NO: 7496 - DNA, 201 bp, Homo sapiens; identical to SEQ ID NO: 7388

SEQ ID NO: 7497 - DNA, 188 bp, Homo sapiens
atgggcccgcgagccaggccggcgcttctcctcctgatgcttttgcagaccgcggtcctgcaggggcgcttgctgcctttgggctacrtggatgaccagctgttcgtgttctatgatcatgagagtcgccgtgtggagccccgaactccatgggtttccagtagaatttcaagccagatgtggctgca

SEQ ID NO: 7498 - DNA, 111 bp, Homo sapiens; identical to SEQ ID NO: 7391

SEQ ID NO: 7499 - DNA, 201 bp, Homo sapiens
cggcgcttctcctcctgatgcttttgcagaccgcggtcctgcaggggcgcttgctgcctttgggctacgtggatgaccagctgttcgtgttctatgatcaygagagtcgccgtgtggagccccgaactccatgggtttccagtagaatttcaagccagatgtggctgcagctgagtcagagtctgaaagggtgggatcaca

SEQ ID NO: 7500 - DNA, 201 bp, Homo sapiens; identical to SEQ ID NO: 7392

SEQ ID NO: 7501 - DNA, 201 bp, Homo sapiens; identical to SEQ ID NO: 7439

SEQ ID NO: 7502 - DNA, 201 bp, Homo sapiens; identical to SEQ ID NO: 7429

SEQ ID NO: 7503 - DNA, 201 bp, Homo sapiens; identical to SEQ ID NO: 7441

SEQ ID NO: 7504 - DNA, 201 bp, Homo sapiens; identical to SEQ ID NO: 7420

SEQ ID NO: 7505 - DNA, 201 bp, Homo sapiens; identical to SEQ ID NO: 7395

SEQ ID NO: 7506 - DNA, 201 bp, Homo sapiens; identical to SEQ ID NO: 7396

SEQ ID NO: 7507 - DNA, 201 bp, Homo sapiens
tttgcagaccgcggtcctgcaggggcgcttgctgcctttgggctacgtggatgaccagctgttcgtgttctatgatcatgagagtcgccgtgtggagcccygaactccatgggtttccagtagaatttcaagccagatgtggctgcagctgagtcagagtctgaaagggtgggatcacatgttcactgttgacttctggac

SEQ ID NO: 7508 - DNA, 201 bp, Homo sapiens; identical to SEQ ID NO: 7398

SEQ ID NO: 7509 - DNA, 201 bp, Homo sapiens
gcttctcctcctgatgcttttgcagaccgcggtcctgcaggggcgcttgctgcctttgggctacgtggatgaccagctgttcgtgttctatgatcatgagwgtcgccgtgtggagccccgaactccatgggtttccagtagaatttcaagccagatgtggctgcagctgagtcagagtctgaaagggtgggatcacatgtt

SEQ ID NO: 7510 - DNA, 201 bp, Homo sapiens; identical to SEQ ID NO: 7400

SEQ ID NO: 7511 - DNA, 201 bp, Homo sapiens; identical to SEQ ID NO: 7401

SEQ ID NO: 7512 - DNA, 201 bp, Homo sapiens; identical to SEQ ID NO: 7386

SEQ ID NO: 7513 - DNA, 201 bp, Homo sapiens; identical to SEQ ID NO: 7387

SEQ ID NO: 7514 - DNA, 201 bp, Homo sapiens; identical to SEQ ID NO: 7388

SEQ ID NO: 7515 - DNA, 201 bp, Homo sapiens; identical to SEQ ID NO: 7389

SEQ ID NO: 7516 - DNA, 201 bp, Homo sapiens; identical to SEQ ID NO: 7390

SEQ ID NO: 7517 - DNA, 111 bp, Homo sapiens; identical to SEQ ID NO: 7391

SEQ ID NO: 7518 - DNA, 201 bp, Homo sapiens; identical to SEQ ID NO: 7392

SEQ ID NO: 7519 - DNA, 201 bp, Homo sapiens; identical to SEQ ID NO: 7393

SEQ ID NO: 7520 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggtgaccactctacggtgtcgggccttgaactactaccc

SEQ ID NO: 7521 - DNA, 201 bp, Homo sapiens; identical to SEQ ID NO: 7395

SEQ ID NO: 7522 - DNA, 201 bp, Homo sapiens; identical to SEQ ID NO: 7396

SEQ ID NO: 7523 - DNA, 201 bp, Homo sapiens; identical to SEQ ID NO: 7397

SEQ ID NO: 7524 - DNA, 201 bp, Homo sapiens; identical to SEQ ID NO: 7398

SEQ ID NO: 7525 - DNA, 201 bp, Homo sapiens; identical to SEQ ID NO: 7399

SEQ ID NO: 7526 - DNA, 201 bp, Homo sapiens; identical to SEQ ID NO: 7400

SEQ ID NO: 7527 - DNA, 201 bp, Homo sapiens; identical to SEQ ID NO: 7401

SEQ ID NO: 7528 - DNA, 201 bp, Homo sapiens; identical to SEQ ID NO: 7386

SEQ ID NO: 7529 - DNA, 201 bp, Homo sapiens; identical to SEQ ID NO: 7387

SEQ ID NO: 7530 - DNA, 201 bp, Homo sapiens; identical to SEQ ID NO: 7388

SEQ ID NO: 7531 - DNA, 201 bp, Homo sapiens; identical to SEQ ID NO: 7389

SEQ ID NO: 7532 - DNA, 201 bp, Homo sapiens; identical to SEQ ID NO: 7390

SEQ ID NO: 7533 - DNA, 201 bp, Homo sapiens; identical to SEQ ID NO: 7393

SEQ ID NO: 7534 - DNA, 201 bp, Homo sapiens; identical to SEQ ID NO: 7392

SEQ ID NO: 7535 - DNA, 201 bp, Homo sapiens; identical to SEQ ID NO: 7439

SEQ ID NO: 7536 - DNA, 201 bp, Homo sapiens; identical to SEQ ID NO: 7429

SEQ ID NO: 7537 - DNA, 201 bp, Homo sapiens; identical to SEQ ID NO: 7441

SEQ ID NO: 7538 - DNA, 201 bp, Homo sapiens; identical to SEQ ID NO: 7420

SEQ ID NO: 7539 - DNA, 201 bp, Homo sapiens; identical to SEQ ID NO: 7395

SEQ ID NO: 7540 - DNA, 201 bp, Homo sapiens; identical to SEQ ID NO: 7396

SEQ ID NO: 7541 - DNA, 201 bp, Homo sapiens; identical to SEQ ID NO: 7397

SEQ ID NO: 7542 - DNA, 201 bp, Homo sapiens; identical to SEQ ID NO: 7398

SEQ ID NO: 7543 - DNA, 201 bp, Homo sapiens; identical to SEQ ID NO: 7399

SEQ ID NO: 7544 - DNA, 201 bp, Homo sapiens; identical to SEQ ID NO: 7400

SEQ ID NO: 7545 - DNA, 201 bp, Homo sapiens; identical to SEQ ID NO: 7393

SEQ ID NO: 7546 - DNA, 201 bp, Homo sapiens; identical to SEQ ID NO: 7397

SEQ ID NO: 7547 - DNA, 201 bp, Homo sapiens; identical to SEQ ID NO: 7386

SEQ ID NO: 7548 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaaggaaggaagtgaaagttccagtcttcctggcaagggtaa

SEQ ID NO: 7549 - DNA, 201 bp, Homo sapiens; identical to SEQ ID NO: 7399

SEQ ID NO: 7550 - DNA, 201 bp, Homo sapiens; identical to SEQ ID NO: 7387

SEQ ID NO: 7551 - DNA, 201 bp, Homo sapiens
gtctgaaagggtgggatcacatgttcactgttgacttctggactattatggaaaatcacaaccacagcaaggaaggaagtgaaagttccagtcttcctggsaagggtaaacagatcccctctcctcatccttcctctttcctgtcaagtgcctcctttggtgaaggtgacacatcatgtgacctcttcagtgaccactcta

SEQ ID NO: 7552 - DNA, 201 bp, Homo sapiens; identical to SEQ ID NO: 7389

SEQ ID NO: 7553 - DNA, 201 bp, Homo sapiens; identical to SEQ ID NO: 7390

SEQ ID NO: 7554 - DNA, 201 bp, Homo sapiens
taagtcttcttagatataatgctaacttaacaaaaatgaagaacactttgatctcagcatcacaacaactgaaagctaaattggagttttttcacaaaagyattcagcttgacttggagagatacagcgagcagatgacgtatgggatatcttcagaaaaaatgctaaaagcatggaaagaaatggaagaaaaggccatcc

SEQ ID NO: 7555 - DNA, 201 bp, Homo sapiens
aaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgag

SEQ ID NO: 7556 - DNA, 201 bp, Homo sapiens
taagaagaaggatccaaagtgtatatttgcatgtgaagagatgtcaggagaagttcggtttagtagccatttacctcaaccaaatagcctttgtagtttartagtagaacccatggaaaactggctacagttgatgttgaattgggaccctcagcagagaggaggacctgttgaccttactttgaagcagccaagatgttt

SEQ ID NO: 7557 - DNA, 201 bp, Homo sapiens
aattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagt

SEQ ID NO: 7558 - DNA, 201 bp, Homo sapiens
ctttgatctcagcatcacaacaactgaaagctaaattggagttttttcacaaaagcattcagcttgacttggagagatacagcgagcagatgacgtatggratatcttcagaaaaaatgctaaaagcatggaaagaaatggaagaaaaggccatccactatgctgaggttggtgtcattggatacctggaggatcagatta

SEQ ID NO: 7559 - DNA, 201 bp, Homo sapiens
aatactgttctggaggagatctccgaaagctgctcaacaaaccagaaaattgttgtggacttaaagaaagccagatactttctttactaagtgatataggrtctgggattcgatatttgcatgaaaacaaaattatacatcgagatctaaaacctgaaaacatagttcttcaggatgttggtggaaagataatacataaaa

SEQ ID NO: 7560 - DNA, 201 bp, Homo sapiens
tgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggttt

SEQ ID NO: 7561 - DNA, 201 bp, Homo sapiens
tcattttaaattccactgaaaatttaacagtatccccttctcatcgaagggattgtgtatctgtgcttctaatattagttggctttcataaatcatgttgktgtgtgtatatgtatttaagatgtacatttaataatatcaaagagaagatgcctgttaatttataatgtatttgaaaattacatgttttttcatttgtaa

SEQ ID NO: 7562 - DNA, 201 bp, Homo sapiens
gcaaaatacagcttccaattatacagctgcgtaaagtgtgggctgaagcagtgcactatgtgtctggactaaaagaagactatagcaggctctttcagggrcaaagggcagcaatgttaagtcttcttagatataatgctaacttaacaaaaatgaagaacactttgatctcagcatcacaacaactgaaagctaaattgg

SEQ ID NO: 7563 - DNA, 201 bp, Homo sapiens
catgtgaagagatgtcaggagaagttcggtttagtagccatttacctcaaccaaatagcctttgtagtttagtagtagaacccatggaaaactggctacasttgatgttgaattgggaccctcagcagagaggaggacctgttgaccttactttgaagcagccaagatgttttgtattaatggatcacattttgaatttga

SEQ ID NO: 7564 - DNA, 201 bp, Homo sapiens
tcctggcatcataaggagttggtgtaatcattttaaattccactgaaaatttaacagtatccccttctcatcgaagggattgtgtatctgtgcttctaatmttagttggctttcataaatcatgttgttgtgtgtatatgtatttaagatgtacatttaataatatcaaagagaagatgcctgttaatttataatgtattt

SEQ ID NO: 7565 - DNA, 201 bp, Homo sapiens
tgtggaggctggacacacggccaccttgcgctgctcagccacaggcagccccgcgcccaccatccactggtccaagctgcgttccccactgccctggcagyaccggctggaaggtgacacactcatcataccccgggtagcccagcaggactcgggccagtacatctgcaatgccactagccctgctgggcacgctgaggc

SEQ ID NO: 7566 - DNA, 201 bp, Homo sapiens
cggcccgatgggcagccggccacacgcgagcacctcctgatggcactggccgacctggatgagctcctgatccgggccacgttctcctccgtgccgctggyggccagcatcagcgcagtcagcctggaggtcgcccagccggggccctcaaacagaccccgcgccctcgaggtggaggagtgccgctgcccgccaggctac

SEQ ID NO: 7567 - DNA, 201 bp, Homo sapiens
acagccaggtgccagggcccataggctgcaactgtgacccccaaggcagcgtcagcagccagtgtgatgctgctggtcagtgccagtgcaaggcccaggtrgaaggcctcacttgcagccactgccggccccaccacttccacctgagtgccagcaacccagacggctgcctgccctgcttctgtatgggcatcacccagc

SEQ ID NO: 7568 - DNA, 201 bp, Homo sapiens
tgtgctccacgtgcatgggggcggtgggcccagagtccaagtgagcccagagaggacccaggtccacgcaggccgcaccgtcaggctgtactgcagggctkcaggcgtgcctagcgccaccatcacctggaggaaggaagggggcagcctcccaccacaggcccggtcagagcgcacagacatcgcgacactgctcatccc

SEQ ID NO: 7569 - DNA, 201 bp, Homo sapiens
cgctgcagcgccacagggagccccacgcccaccctcgagtggacagggggccccggcggccagctccctgcgaaggcacaaatccacggcggcatcctgcrcctgccagctgtcgagcccacggatcaggcccagtacttgtgccgagcccacagcagcgctgggcagcaggtggccagggctgtgctccacgtgcatggg

SEQ ID NO: 7570 - DNA, 201 bp, Homo sapiens
agagcccagcactgatagggccccgcccaccgggccccgcccaccccaggccacatccccacccatctggaagtgaaggcccagggactcctccaacagamaacggacggacggatgccgctggtgctcaggaagagctagtgccttaggtgggggaaggcaggactcacgactgagagagagaggagggggatatgacca

SEQ ID NO: 7571 - DNA, 201 bp, Homo sapiens
tcctgatccgagcatcctacgcccagcagcccgctgagagcagggtctctggcatcagcatggacgtggctgtgcccgaggaaaccggccaggaccccgcrctggaagtggaacagtgctcctgcccacccgggtaccgtgggccgtcctgccaggactgtgacacaggctacacacgcacgcccagtggcctctacctgg

SEQ ID NO: 7572 - DNA, 201 bp, Homo sapiens
gaccccatcaatgacggcgagtggcaccgggtgacagcactgcgggagggccgcagaggttccatccaagtcgacggtgaggagctggtcagcggccggtscccaggtcccaacgtggcagtcaacgccaagggcagcgtctacatcggcggagcccctgacgtggccacgctgaccgggggcagattctcctcaggcatc

SEQ ID NO: 7573 - DNA, 201 bp, Homo sapiens
actgcgggagggccgcagaggttccatccaagtcgacggtgaggagctggtcagcggccggtccccaggtcccaacgtggcagtcaacgccaagggcagcrtctacatcggcggagcccctgacgtggccacgctgaccgggggcagattctcctcaggcatcacaggctgtgtcaagaacctggtgctgcactcggcccg

SEQ ID NO: 7574 - DNA, 201 bp, Homo sapiens
actcccgggccacgccccagcccgacaatgtcgagtatattattattaatattattatgaatttttgtaagaaaccgaggcgatgccacgctttgctgctmccgccctgggctggactggaggtgggcatgccaccctcacacacacagctgggcaaagccacaaggctggccagcaaggcaggttggatgggagtgggca

SEQ ID NO: 7575 - DNA, 201 bp, Homo sapiens
tggacgtggagttcaagccactcgcccctgacggggtcctgctgttcagcggggggaagagcgggcctgtggaggacttcgtgtccctggcgatggtgggyggccacctggagttccgctatgagttggggtcagggctggccgttctgcggagcgccgagccgctggccctgggccgctggcaccgtgtgtctgcagagc

SEQ ID NO: 7576 - DNA, 201 bp, Homo sapiens
ggcagcgtctacatcggcggagcccctgacgtggccacgctgaccgggggcagattctcctcaggcatcacaggctgtgtcaagaacctggtgctgcactyggcccgacccggcgccccgcccccacagcccctggacctgcagcaccgcgcccaggccggggccaacacacgcccctgcccctcgtaggcacctgcctgc

SEQ ID NO: 7577 - DNA, 201 bp, Homo sapiens
tgaacccacagcgaaacagccgcctgacaggagaattcactgtggaacccgtgcccgagggtgcccagctctcttttggcaactttgcccaactcggccaygagtccttctactggcagctgccggagacataccagggagacaaggtggcggcctacggtgggaagttgcgatacaccctctcctacacagcaggcccac

SEQ ID NO: 7578 - DNA, 201 bp, Homo sapiens
tggcactggcaggcatcgacaccctcctgatccgagcatcctacgcccagcagcccgctgagagcagggtctctggcatcagcatggacgtggctgtgccygaggaaaccggccaggaccccgcgctggaagtggaacagtgctcctgcccacccgggtaccgtgggccgtcctgccaggactgtgacacaggctacacac

SEQ ID NO: 7579 - DNA, 201 bp, Homo sapiens
gccccacattctctctcctcgtggagacgacatctttaccgccccggccagagacaaccatcatgcgacagccaccagtcacccacgctcctcagcccctrcttcccggttccgtcaggcccctgccctgtgggccccaggaggccgcatgccgcaatgggcactgcatccccagagactacctctgcgacggacaggagg

SEQ ID NO: 7580 - DNA, 201 bp, Homo sapiens
cttcacagtcaccgtcccgcccagtgaggggtcttcctaccgccttaggagcccggtcatctccatcgacccgcccagcagcaccgtgcagcagggccagratgccagcttcaagtgcctcatccatgacggggcagcccccatcagcctcgagtggaagacccggaaccaggagctggaggacaacgtccacatcagtcc

SEQ ID NO: 7581 - DNA, 201 bp, Homo sapiens
tggccacgctgaccgggggcagattctcctcaggcatcacaggctgtgtcaagaacctggtgctgcactcggcccgacccggcgccccgcccccacagccyctggacctgcagcaccgcgcccaggccggggccaacacacgcccctgcccctcgtaggcacctgcctgccccacacggactcccgggccacgccccagcc

SEQ ID NO: 7582 - DNA, 201 bp, Homo sapiens
aactggcggagttccgctgcagcgccacagggagccccacgcccaccctcgagtggacagggggccccggcggccagctccctgcgaaggcacaaatccayggcggcatcctgcgcctgccagctgtcgagcccacggatcaggcccagtacttgtgccgagcccacagcagcgctgggcagcaggtggccagggctgtgc

SEQ ID NO: 7583 - DNA, 201 bp, Homo sapiens
gttgtcctttcagcctcagatgccagcccaccgccggtcaagattgagtcctcatcgccttctgtgacagaagggcaaacactcgacctcaactgtgtggkggcagggtcagcccatgcccaggtcacctggtacaggcgagggggtagcctgcctccccacacccaggtgcacggctcccgtctgcggctcccccaggtc

SEQ ID NO: 7584 - DNA, 201 bp, Homo sapiens
gccggtccccaggtcccaacgtggcagtcaacgccaagggcagcgtctacatcggcggagcccctgacgtggccacgctgaccgggggcagattctcctcrggcatcacaggctgtgtcaagaacctggtgctgcactcggcccgacccggcgccccgcccccacagcccctggacctgcagcaccgcgcccaggccgggg

SEQ ID NO: 7585 - DNA, 201 bp, Homo sapiens
agcgtggaggcagcttacccagccggcaccagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacgtgcccagcgtctccccaccgatcaggatcgagt

SEQ ID NO: 7586 - DNA, 201 bp, Homo sapiens
tcaccatcgtgggcacccggcccagcaaccacggtacctaccgctgcgtggcctccaatgcctacggtgtggcccagagtgtggtgaacctcagtgtgcaygggccccctacagtgtccgtgctccccgagggccccgtgtgggtgaaagtgggaaaggctgtcaccctggagtgtgtcagtgccggggagccccgctcct

SEQ ID NO: 7587 - DNA, 201 bp, Homo sapiens
gcactgcgggagggccgcagaggttccatccaagtcgacggtgaggagctggtcagcggccggtccccaggtcccaacgtggcagtcaacgccaagggcarcgtctacatcggcggagcccctgacgtggccacgctgaccgggggcagattctcctcaggcatcacaggctgtgtcaagaacctggtgctgcactcggcc

SEQ ID NO: 7588 - DNA, 201 bp, Homo sapiens
gctcgtttttcagcacccccacccacctccacccagcccctggcacctcctctggcagactccccctcctaccacgtcctcctggcctgcattcccacccsctcctgccagcacacagcctggggtccctccctcaggggctgtaagggaaggcccaccccaactcttaccaggagctgctacaggcagagcccagcactg

SEQ ID NO: 7589 - DNA, 201 bp, Homo sapiens
caggaagagctagtgccttaggtgggggaaggcaggactcacgactgagagagagaggagggggatatgaccaccctgccccatctgcaggagcctgaagrtccagctcaagtgccatcctgccagtggcccccagactgtggggttgggacgcctggcctctgtgtcctagaagggaccctcctgtggtctttgtcttga

SEQ ID NO: 7590 - DNA, 201 bp, Homo sapiens
gtggtgcccgggcaggcccatgcccaggtcacgtggtacaagcgcgggggcagcctccccgcccggcaccagacccatggctcccagctgcggctccaccwcgtctcccctgccgactcaggcgagtatgtgtgtcgtgcagccagcggcccaggccctgagcaagaagcctccttcacagtcaccgtcccgcccagtgag

SEQ ID NO: 7591 - DNA, 201 bp, Homo sapiens
cgggggcagcctccccgcccggcaccagacccatggctcccagctgcggctccacctcgtctcccctgccgactcaggcgagtatgtgtgtcgtgcagccrgcggcccaggccctgagcaagaagcctccttcacagtcaccgtcccgcccagtgaggggtcttcctaccgccttaggagcccggtcatctccatcgaccc

SEQ ID NO: 7592 - DNA, 201 bp, Homo sapiens
agagcagcagctacgtgtgcgtctgcccagctggcttcaccgggagccgctgtgagcactcgcaggccctgcactgccatccagaggcctgtgggcccgaygccacctgtgtgaaccggcctgacggtcgaggctacacctgccgctgccacctgggccgctcggggttgcggtgtgaggaaggtgtgacagtgaccaccc

SEQ ID NO: 7593 - DNA, 201 bp, Homo sapiens
ctgagagcagcagctacgtgtgcgtctgcccagctggcttcaccgggagccgctgtgagcactcgcaggccctgcactgccatccagaggcctgtgggccsgacgccacctgtgtgaaccggcctgacggtcgaggctacacctgccgctgccacctgggccgctcggggttgcggtgtgaggaaggtgtgacagtgacca

SEQ ID NO: 7594 - DNA, 201 bp, Homo sapiens
cagccgatgggatgctgctgtacaatgggcagaagcgagtcccagggagccccaccaacctggccaaccggcagcccgacttcatctccttcggcctcgtkgggggaaggcccgagttccggttcgatgcaggctcaggcatggccaccatccgccatcccacaccactggccctgggccatttccacaccgtgaccctgc

SEQ ID NO: 7595 - DNA, 201 bp, Homo sapiens
tggagttcgaatgcctggcactgggtgaccccaagcctcaggtgacatggagcaaagttggagggcacctgcggccaggcattgtgcagagcggaggtgtygtcaggatcgcccacgtagagctggctgatgcgggacagtatcgctgcactgccaccaacgcagctggcaccacacaatcccacgtcctgctgcttgtgc

SEQ ID NO: 7596 - DNA, 201 bp, Homo sapiens
gggtggtgccctacttcacgcagaccccctactccttcctaccgctgcccaccatcaaggatgcctacaggaagttcgagatcaagatcaccttccggccygactcagccgatgggatgctgctgtacaatgggcagaagcgagtcccagggagccccaccaacctggccaaccggcagcccgacttcatctccttcggcc

SEQ ID NO: 7597 - DNA, 201 bp, Homo sapiens
gctctctccctgccacctccatcccagcagggtccacgcccaccgtgcaggtcacgcctcagctagagaccaagagcattggggccagcgttgagttccaytgtgctgtgcccagcgaccggggtacccagctccgttggttcaaggaagggggtcagctgcctccgggtcacagcgtgcaggatggggtgctccgaatcc

SEQ ID NO: 7598 - DNA, 201 bp, Homo sapiens
aaggccctcccggctctctccctgccacctccatcccagcagggtccacgcccaccgtgcaggtcacgcctcagctagagaccaagagcattggggccagygttgagttccactgtgctgtgcccagcgaccggggtacccagctccgttggttcaaggaagggggtcagctgcctccgggtcacagcgtgcaggatgggg

SEQ ID NO: 7599 - DNA, 201 bp, Homo sapiens
aaattcccggagaccaggttgtcagtgtggtgttcatcaaggagctggatggctgggtttttgtggagctggatgtgggctcggaagggaatgcggatggkgctcagattcaggagatgctgctcagggtcatctccagcggctctgtggcctcctacgtcacctctccccagggattccagttccgacgcctgggcacag

SEQ ID NO: 7600 - DNA, 201 bp, Homo sapiens
tggtagacacgctggagtcggagtacttgaaaattcccggagaccaggttgtcagtgtggtgttcatcaaggagctggatggctgggtttttgtggagctsgatgtgggctcggaagggaatgcggatggggctcagattcaggagatgctgctcagggtcatctccagcggctctgtggcctcctacgtcacctctcccc

SEQ ID NO: 7601 - DNA, 201 bp, Homo sapiens
aagccacaaggctggccagcaaggcaggttggatgggagtgggcacctcagaaagtcaccaggacttggggtcaggaacagtggctgggtgggcccagaastgcccccactgtccccctacccaccgatggagcccccagatagagctgggtggcctgtttctgcagcccttgggcagttctcactcctaggagagccaac

SEQ ID NO: 7602 - DNA, 201 bp, Homo sapiens
tgaggaccccatcaatgacggcgagtggcaccgggtgacagcactgcgggagggccgcagaggttccatccaagtcgacggtgaggagctggtcagcggcmggtccccaggtcccaacgtggcagtcaacgccaagggcagcgtctacatcggcggagcccctgacgtggccacgctgaccgggggcagattctcctcagg

SEQ ID NO: 7603 - DNA, 201 bp, Homo sapiens
gcagcggcccgatgggcagccagccacacgggagcacctgctgatggcactggcaggcatcgacaccctcctgatccgagcatcctacgcccagcagcccrctgagagcagggtctctggcatcagcatggacgtggctgtgcccgaggaaaccggccaggaccccgcgctggaagtggaacagtgctcctgcccacccgg

SEQ ID NO: 7604 - DNA, 201 bp, Homo sapiens
tctggaccctacttctggagcctcccttcacgcttcctgggggacaaggtgacctcctatggaggagagctgcgcttcacagtgacccagaggtcccagcygggctccacacccctgcacgggcagccgttggtggtgctgcaaggtaacaacatcatcctagagcaccatgtggcccaggagcccagccccggccagccc

SEQ ID NO: 7605 - DNA, 201 bp, Homo sapiens
gtgcttctgcatgggtgtcagtcgccactgcaccagctcttcatggagccgtgcccagttgcatggggcctctgaggagcctggtcacttcagcctgaccmacgccgcaagcacccacaccaccaacgagggcatcttctcccccacgcccggggaactgggattctcctccttccacagactcttatctggaccctactt

SEQ ID NO: 7606 - DNA, 201 bp, Homo sapiens
ctcacttccgcggctgtgtgggcgaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggattcaaaggag

SEQ ID NO: 7607 - DNA, 201 bp, Homo sapiens
ccgccgactcgggcgagtacgtgtgccgagtgttgggcagctccgtgcctctagaggcctctgtcctggtcaccattgagcctgcgggctcagtgcctgcwcttggggtcacccccacggtccggatcgagtcatcgtcttcgcaagtggccgaggggcagaccctggacctgaactgcctcgttgctggtcaggcccatg

SEQ ID NO: 7608 - DNA, 201 bp, Homo sapiens
ggcagaccctggatctgaagtgcgtggtgcccgggcaggcccacgcccaggtcacgtggcacaagcgtggaggaaacctccctgcccggcaccaggtccayggcccactgctgaggctgaaccaggtgtccccggctgactctggcgagtactcgtgccaagtgaccggaagctcaggcaccctggaggcatctgtcctgg

SEQ ID NO: 7609 - DNA, 201 bp, Homo sapiens
gtctgcggctcccccaggtctcaccagctgattctggagaatatgtgtgccgtgtggagaatggatcgggccccaaggaggcctccattactgtgtctgtrctccacggcacccattctggccccagctacaccccagtgcccggcagcacccggcccatccgcatcgagccctcctcctcacacgtggcggaagggcaga

SEQ ID NO: 7610 - DNA, 201 bp, Homo sapiens
gccatcccacaccactggccctgggccatttccacaccgtgaccctgctgcgcagcctcacccagggctccctgattgtgggtgacctggccccggtcaaygggacctcccagggcaagttccagggcctggatctgaacgaggaactctacctgggtggctatcctgactatggtgccatccccaaggcggggctgagca

SEQ ID NO: 7611 - DNA, 201 bp, Homo sapiens
tcaggctaccccactcctgacatcagctggagcaagctggatggcagcctgccacctgacagccgcctggagaacaacatgctgatgctgccctcagtccraccccaggacgcaggtacctacgtctgcaccgccactaaccgccagggcaaggtcaaagcctttgcccacctgcaggtgccagagcgggtggtgccctac

SEQ ID NO: 7612 - DNA, 201 bp, Homo sapiens
gtccgtgtgcctgctggttctgcagctgtcttcccctgcatagcctcaggctaccccactcctgacatcagctggagcaagctggatggcagcctgccacytgacagccgcctggagaacaacatgctgatgctgccctcagtccgaccccaggacgcaggtacctacgtctgcaccgccactaaccgccagggcaaggtc

SEQ ID NO: 7613 - DNA, 174 bp, Homo sapiens
agagaggagggggatatgaccaccctgccccatctgcaggagcctgaagatccagctcaagtgccatcctgccagtggcccccagactgtggggttgggaygcctggcctctgtgtcctagaagggaccctcctgtggtctttgtcttgatttttcttaataaacggtgctatc

SEQ ID NO: 7614 - DNA, 201 bp, Homo sapiens
cctccctgcccggcaccagacccacggctcgctgctgcggctgcaccaggtgaccccggccgactcaggcgagtatgtgtgccatgtggtgggcacctccrgccccctagaggcctcagtcctggtcaccatcgaagcctctgtcatccctggacccatcccacctgtcaggatcgagtcttcatcctccacagtggccga

SEQ ID NO: 7615 - DNA, 201 bp, Homo sapiens
cccggcccatccgcatcgagccctcctcctcacacgtggcggaagggcagaccctggatctgaactgcgtggtgcccgggcaggcccacgcccaggtcacrtggcacaagcgtgggggcagcctccctgcccggcaccagacccacggctcgctgctgcggctgcaccaggtgaccccggccgactcaggcgagtatgtgt

SEQ ID NO: 7616 - DNA, 201 bp, Homo sapiens
gggccagcaacggcatggaggcctccatcacggtcacagtaactgggacccagggggccaacttagcctaccctgccggcagcacccagcccatccgcatygagccctcctcctcgcaagtggcggaagggcagaccctggatctgaactgcgtggtgcccgggcagtcccatgcccaggtcacgtggcacaagcgtgggg

SEQ ID NO: 7617 - DNA, 201 bp, Homo sapiens
ggtgcccgggcaggcccatgcccaggtcacgtggtacaagcgcgggggcagcctccccgcccggcaccagacccatggctcccagctgcggctccacctcrtctcccctgccgactcaggcgagtatgtgtgtcgtgcagccagcggcccaggccctgagcaagaagcctccttcacagtcaccgtcccgcccagtgaggg

SEQ ID NO: 7618 - DNA, 201 bp, Homo sapiens
ccgctgcagcgccacagggagccccacgcccaccctcgagtggacagggggccccggcggccagctccctgcgaaggcacaaatccacggcggcatcctgygcctgccagctgtcgagcccacggatcaggcccagtacttgtgccgagcccacagcagcgctgggcagcaggtggccagggctgtgctccacgtgcatgg

SEQ ID NO: 7619 - DNA, 201 bp, Homo sapiens
ccgccccggccagagacaaccatcatgcgacagccaccagtcacccacgctcctcagcccctgcttcccggttccgtcaggcccctgccctgtgggccccrggaggccgcatgccgcaatgggcactgcatccccagagactacctctgcgacggacaggaggactgcgaggacggcagcgatgagctagactgtggcccc

SEQ ID NO: 7620 - DNA, 201 bp, Homo sapiens
agatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctgaattgccagcacaacacggaggggccacagtgcaacaagtgcaaggctggc

SEQ ID NO: 7621 - DNA, 201 bp, Homo sapiens
tgcccgggcagtcccatgcccaggtcacgtggcacaagcgtgggggcagcctccctgtccggcaccagacccacggctccctgctgagactctaccaagcrtcccccgccgactcgggcgagtacgtgtgccgagtgttgggcagctccgtgcctctagaggcctctgtcctggtcaccattgagcctgcgggctcagtgc

SEQ ID NO: 7622 - DNA, 201 bp, Homo sapiens
ccgagcccacagcagcgctgggcagcaggtggccagggctgtgctccacgtgcatgggggcggtgggcccagagtccaagtgagcccagagaggacccagrtccacgcaggccgcaccgtcaggctgtactgcagggctgcaggcgtgcctagcgccaccatcacctggaggaaggaagggggcagcctcccaccacaggc

SEQ ID NO: 7623 - DNA, 201 bp, Homo sapiens
ggcacaagcgcgggggcagcctcccggcccggcaccaggtgcatggctcgaggctacgcctgctccaggtgaccccagctgattcaggggagtacgtgtgycgtgtggtcggcagctcaggtacccaggaagcctcagtccttgtcaccatccagcagcgccttagtggctcccactcccagggtgtggcgtaccccgtcc

SEQ ID NO: 7624 - DNA, 201 bp, Homo sapiens
gatcacgggcaacaacatcatgctagtggcctcccagccagcgctgcagggccctgagaggaggagctacgagatcatgttccgagaggaattctggcgcyggcccgatgggcagccggccacacgcgagcacctcctgatggcactggccgacctggatgagctcctgatccgggccacgttctcctccgtgccgctggc

SEQ ID NO: 7625 - DNA, 201 bp, Homo sapiens
tgtgcagaccgtggtggttggccacgccgtggagttcgaatgcctggcactgggtgaccccaagcctcaggtgacatggagcaaagttggagggcacctgyggccaggcattgtgcagagcggaggtgtcgtcaggatcgcccacgtagagctggctgatgcgggacagtatcgctgcactgccaccaacgcagctggcac

SEQ ID NO: 7626 - DNA, 201 bp, Homo sapiens
ctccacccactttgcccctggggacttccaaggctttgccctggtgaacccacagcgaaacagccgcctgacaggagaattcactgtggaacccgtgcccragggtgcccagctctcttttggcaactttgcccaactcggccatgagtccttctactggcagctgccggagacataccagggagacaaggtggcggccta

SEQ ID NO: 7627 - DNA, 201 bp, Homo sapiens
atggccccaggggcccctcaggtccaagctgaagaagctgagctgactgtggaggctggacacacggccaccttgcgctgctcagccacaggcagccccgygcccaccatccactggtccaagctgcgttccccactgccctggcagcaccggctggaaggtgacacactcatcataccccgggtagcccagcaggactcg

SEQ ID NO: 7628 - DNA, 201 bp, Homo sapiens
acgagttggcccgtggcatgctggagccagtgcagcggccggacgtggtcctcgtgggtgccgggtaccgcctcctctcccgaggccacacacccacccamcctggtgctctgaaccagcgccaggtccagttctctgaggagcactgggtccatgagtctggccggccggtgcagcgcgcggagctgctgcaggtgctgc

SEQ ID NO: 7629 - DNA, 201 bp, Homo sapiens
gcagcggggacttccagatggtttatttccgagccctggtgaatttcactcgctccatcgagtacagccctcagctggaggatgcaggctccagagagttycgagaggtgtccgaggctgtggtagacacgctggagtcggagtacttgaaaattcccggagaccaggttgtcagtgtggtgttcatcaaggagctggatg

SEQ ID NO: 7630 - DNA, 201 bp, Homo sapiens
cccggatcagcagcacccctgccaagttggagcagcggacatatgggctcatggacagccacgcggtgctgcagatttcatcagctaaaccatcagatgcrggcacttatgtgtgccttgctcagaatgcactaggcacagcacagaagcaggtggaggtgatcgtggacacgggcgccatggccccaggggcccctcagg

SEQ ID NO: 7631 - DNA, 201 bp, Homo sapiens
cgcccctggctactatggcaaccccagccagggccagccatgccagagagacagccaggtgccagggcccataggctgcaactgtgacccccaaggcagcrtcagcagccagtgtgatgctgctggtcagtgccagtgcaaggcccaggtggaaggcctcacttgcagccactgccggccccaccacttccacctgagtgc

SEQ ID NO: 7632 - DNA, 201 bp, Homo sapiens
tccatgagtctggccggccggtgcagcgcgcggagctgctgcaggtgctgcagagcctggaggccgtgctcatccagaccgtgtacaacaccaagatggcyagcgtgggacttagcgacatcgccatggataccaccgtcacccatgccaccagccatggccgtgcccacagtgtggaggagtgcagatgccccattggct

SEQ ID NO: 7633 - DNA, 201 bp, Homo sapiens
caacaaggtggactcctatggcggctccctgcgttacaacgtgcgctacgagttggcccgtggcatgctggagccagtgcagcggccggacgtggtcctcrtgggtgccgggtaccgcctcctctcccgaggccacacacccacccaacctggtgctctgaaccagcgccaggtccagttctctgaggagcactgggtcca

SEQ ID NO: 7634 - DNA, 201 bp, Homo sapiens
cacggatggccaagccacatgtgacgcctgtgccccaggctacactggccgccgctgtgagagctgtgcccccggatacgagggcaaccccatccagcccrgcgggaagtgcaggcccgtcaaccaggagattgtgcgctgtgacgagcgtggcagcatggggacctccggggaggcctgccgctgtaagaacaatgtggt

SEQ ID NO: 7635 - DNA, 201 bp, Homo sapiens
accgccccggccagagacaaccatcatgcgacagccaccagtcacccacgctcctcagcccctgcttcccggttccgtcaggcccctgccctgtgggcccmaggaggccgcatgccgcaatgggcactgcatccccagagactacctctgcgacggacaggaggactgcgaggacggcagcgatgagctagactgtggccc

SEQ ID NO: 7636 - DNA, 201 bp, Homo sapiens
ctgaggacatagagaccgtcacagcaagccaaatgcgctggacacattcgtacctttctgatgatgaggacatgctggctgacagcatctcaggagacgamctgggcagtggggacctgggcagcggggacttccagatggtttatttccgagccctggtgaatttcactcgctccatcgagtacagccctcagctggagg

SEQ ID NO: 7637 - DNA, 201 bp, Homo sapiens
gctgcggctgcaccatgtgtccccggccgactcgggtgaatacgtgtgccgggtgatgggcagctctggccccctggaggcctcagtcctggtcaccatcraagcctctggctcaagtgctgtccacgtccccgccccaggtggagccccacccatccgcatcgagccctcctcctcccgagtggcagaagggcagaccct

SEQ ID NO: 7638 - DNA, 201 bp, Homo sapiens
cagctggagcaagctggatggcagcctgccacctgacagccgcctggagaacaacatgctgatgctgccctcagtccgaccccaggacgcaggtacctacrtctgcaccgccactaaccgccagggcaaggtcaaagcctttgcccacctgcaggtgccagagcgggtggtgccctacttcacgcagaccccctactcctt

SEQ ID NO: 7639 - DNA, 201 bp, Homo sapiens
tgtcagtgccggggagccccgctcctctgctcgttggacccggatcagcagcacccctgccaagttggagcagcggacatatgggctcatggacagccacrcggtgctgcagatttcatcagctaaaccatcagatgcgggcacttatgtgtgccttgctcagaatgcactaggcacagcacagaagcaggtggaggtgat

SEQ ID NO: 7640 - DNA, 201 bp, Homo sapiens
ctgggtacctgtgaacgctgcagctgccatggccactcagaggcctgcgagccagaaacaggtgcctgccagggctgccagcatcacacggagggccctcrgtgtgagcagtgccagccaggatactacggggacgcccagcgggggacaccacaggactgccagctgtgcccctgctacggagaccctgctgccggccag

SEQ ID NO: 7641 - DNA, 201 bp, Homo sapiens
agggactcctccaacagacaacggacggacggatgccgctggtgctcaggaagagctagtgccttaggtgggggaaggcaggactcacgactgagagagasaggagggggatatgaccaccctgccccatctgcaggagcctgaagatccagctcaagtgccatcctgccagtggcccccagactgtggggttgggacgcc

SEQ ID NO: 7642 - DNA, 201 bp, Homo sapiens
tggagtatcgctgtgaccggcggcccgactgcagggacatgtctgatgagctcaattgtgaggagccagtcctgggtatcagccccacattctctctcctygtggagacgacatctttaccgccccggccagagacaaccatcatgcgacagccaccagtcacccacgctcctcagcccctgcttcccggttccgtcaggc

SEQ ID NO: 7643 - DNA, 201 bp, Homo sapiens
cgcagcccggcacgccacccctctcctccacgcagctgcagatcgacccatccctgcacgagttccagctagtcgacctgtcccgccgcttcctcgtccaygactccttctgggctctgcctgaacagttcctgggcaacaaggtggactcctatggcggctccctgcgttacaacgtgcgctacgagttggcccgtggca

SEQ ID NO: 7644 - DNA, 201 bp, Homo sapiens
cacaagcgcgggggcagcctcccggcccggcaccaggtgcatggctcgaggctacgcctgctccaggtgaccccagctgattcaggggagtacgtgtgccrtgtggtcggcagctcaggtacccaggaagcctcagtccttgtcaccatccagcagcgccttagtggctcccactcccagggtgtggcgtaccccgtccgc

SEQ ID NO: 7645 - DNA, 201 bp, Homo sapiens
ccggcccggcaccaggtgcatggctcgaggctacgcctgctccaggtgaccccagctgattcaggggagtacgtgtgccgtgtggtcggcagctcaggtayccaggaagcctcagtccttgtcaccatccagcagcgccttagtggctcccactcccagggtgtggcgtaccccgtccgcatcgagtcctcctcagcctcc

SEQ ID NO: 7646 - DNA, 201 bp, Homo sapiens
cactgccctggcagcaccggctggaaggtgacacactcatcataccccgggtagcccagcaggactcgggccagtacatctgcaatgccactagccctgcygggcacgctgaggccaccatcatcctgcacgtggagagcccaccatatgccaccacggtcccagagcacgcttcggtgcaggcaggggagacggtgcagc

SEQ ID NO: 7647 - DNA, 201 bp, Homo sapiens; identical to SEQ ID NO: 7565

SEQ ID NO: 7648 - DNA, 201 bp, Homo sapiens; identical to SEQ ID NO: 7566

SEQ ID NO: 7649 - DNA, 201 bp, Homo sapiens; identical to SEQ ID NO: 7567

SEQ ID NO: 7650 - DNA, 201 bp, Homo sapiens; identical to SEQ ID NO: 7568

SEQ ID NO: 7651 - DNA, 201 bp, Homo sapiens; identical to SEQ ID NO: 7569

SEQ ID NO: 7652 - DNA, 201 bp, Homo sapiens; identical to SEQ ID NO: 7571

SEQ ID NO: 7653 - DNA, 201 bp, Homo sapiens; identical to SEQ ID NO: 7572

SEQ ID NO: 7654 - DNA, 201 bp, Homo sapiens; identical to SEQ ID NO: 7573

SEQ ID NO: 7655 - DNA, 201 bp, Homo sapiens; identical to SEQ ID NO: 7574

SEQ ID NO: 7656 - DNA, 201 bp, Homo sapiens; identical to SEQ ID NO: 7575

SEQ ID NO: 7657 - DNA, 201 bp, Homo sapiens; identical to SEQ ID NO: 7576

SEQ ID NO: 7658 - DNA, 201 bp, Homo sapiens; identical to SEQ ID NO: 7577

SEQ ID NO: 7659 - DNA, 201 bp, Homo sapiens; identical to SEQ ID NO: 7578

SEQ ID NO: 7660 - DNA, 201 bp, Homo sapiens; identical to SEQ ID NO: 7579

SEQ ID NO: 7661 - DNA, 201 bp, Homo sapiens; identical to SEQ ID NO: 7580

SEQ ID NO: 7662 - DNA, 201 bp, Homo sapiens; identical to SEQ ID NO: 7581

SEQ ID NO: 7663 - DNA, 201 bp, Homo sapiens; identical to SEQ ID NO: 7582

SEQ ID NO: 7664 - DNA, 201 bp, Homo sapiens; identical to SEQ ID NO: 7583

SEQ ID NO: 7665 - DNA, 201 bp, Homo sapiens; identical to SEQ ID NO: 7584

SEQ ID NO: 7666 - DNA, 201 bp, Homo sapiens; identical to SEQ ID NO: 7585

SEQ ID NO: 7667 - DNA, 201 bp, Homo sapiens; identical to SEQ ID NO: 7586

SEQ ID NO: 7668 - DNA, 201 bp, Homo sapiens; identical to SEQ ID NO: 7587

SEQ ID NO: 7669 - DNA, 201 bp, Homo sapiens; identical to SEQ ID NO: 7590

SEQ ID NO: 7670 - DNA, 201 bp, Homo sapiens; identical to SEQ ID NO: 7591

SEQ ID NO: 7671 - DNA, 201 bp, Homo sapiens; identical to SEQ ID NO: 7592

SEQ ID NO: 7672 - DNA, 201 bp, Homo sapiens; identical to SEQ ID NO: 7593

SEQ ID NO: 7673 - DNA, 201 bp, Homo sapiens; identical to SEQ ID NO: 7594

SEQ ID NO: 7674 - DNA, 201 bp, Homo sapiens; identical to SEQ ID NO: 7595

SEQ ID NO: 7675 - DNA, 201 bp, Homo sapiens; identical to SEQ ID NO: 7596

SEQ ID NO: 7676 - DNA, 201 bp, Homo sapiens; identical to SEQ ID NO: 7597

SEQ ID NO: 7677 - DNA, 201 bp, Homo sapiens; identical to SEQ ID NO: 7598

SEQ ID NO: 7678 - DNA, 201 bp, Homo sapiens; identical to SEQ ID NO: 7599

SEQ ID NO: 7679 - DNA, 201 bp, Homo sapiens; identical to SEQ ID NO: 7600

SEQ ID NO: 7680 - DNA, 201 bp, Homo sapiens; identical to SEQ ID NO: 7601

SEQ ID NO: 7681 - DNA, 201 bp, Homo sapiens; identical to SEQ ID NO: 7602

SEQ ID NO: 7682 - DNA, 201 bp, Homo sapiens; identical to SEQ ID NO: 7603

SEQ ID NO: 7683 - DNA, 201 bp, Homo sapiens; identical to SEQ ID NO: 7604

SEQ ID NO: 7684 - DNA, 201 bp, Homo sapiens; identical to SEQ ID NO: 7605

SEQ ID NO: 7685 - DNA, 201 bp, Homo sapiens; identical to SEQ ID NO: 7606

SEQ ID NO: 7686 - DNA, 201 bp, Homo sapiens; identical to SEQ ID NO: 7607

SEQ ID NO: 7687 - DNA, 201 bp, Homo sapiens; identical to SEQ ID NO: 7608

SEQ ID NO: 7688 - DNA, 201 bp, Homo sapiens; identical to SEQ ID NO: 7609

SEQ ID NO: 7689 - DNA, 201 bp, Homo sapiens; identical to SEQ ID NO: 7610

SEQ ID NO: 7690 - DNA, 201 bp, Homo sapiens; identical to SEQ ID NO: 7611

SEQ ID NO: 7691 - DNA, 201 bp, Homo sapiens; identical to SEQ ID NO: 7612

SEQ ID NO: 7692 - DNA, 181 bp, Homo sapiens
gctacctgagacgggcatcgcaggagtctctgccacccactcaggattgggaattgtctttagtgccggctgtggagcaaaaggcagctcacccctgggaygcctggcctctgtgtcctagaagggaccctcctgtggtctttgtcttgatttttcttaataaacggtgctatccccgcca

SEQ ID NO: 7693 - DNA, 201 bp, Homo sapiens; identical to SEQ ID NO: 7614

SEQ ID NO: 7694 - DNA, 201 bp, Homo sapiens; identical to SEQ ID NO: 7615

SEQ ID NO: 7695 - DNA, 201 bp, Homo sapiens; identical to SEQ ID NO: 7616

SEQ ID NO: 7696 - DNA, 201 bp, Homo sapiens; identical to SEQ ID NO: 7617

SEQ ID NO: 7697 - DNA, 201 bp, Homo sapiens; identical to SEQ ID NO: 7618

SEQ ID NO: 7698 - DNA, 201 bp, Homo sapiens; identical to SEQ ID NO: 7619

SEQ ID NO: 7699 - DNA, 201 bp, Homo sapiens; identical to SEQ ID NO: 7620

SEQ ID NO: 7700 - DNA, 201 bp, Homo sapiens; identical to SEQ ID NO: 7621

SEQ ID NO: 7701 - DNA, 201 bp, Homo sapiens; identical to SEQ ID NO: 7622

SEQ ID NO: 7702 - DNA, 201 bp, Homo sapiens; identical to SEQ ID NO: 7623

SEQ ID NO: 7703 - DNA, 201 bp, Homo sapiens; identical to SEQ ID NO: 7624

SEQ ID NO: 7704 - DNA, 201 bp, Homo sapiens; identical to SEQ ID NO: 7625

SEQ ID NO: 7705 - DNA, 201 bp, Homo sapiens; identical to SEQ ID NO: 7626

SEQ ID NO: 7706 - DNA, 201 bp, Homo sapiens; identical to SEQ ID NO: 7627

SEQ ID NO: 7707 - DNA, 201 bp, Homo sapiens; identical to SEQ ID NO: 7628

SEQ ID NO: 7708 - DNA, 201 bp, Homo sapiens; identical to SEQ ID NO: 7630

SEQ ID NO: 7709 - DNA, 201 bp, Homo sapiens; identical to SEQ ID NO: 7629

SEQ ID NO: 7710 - DNA, 201 bp, Homo sapiens; identical to SEQ ID NO: 7631

SEQ ID NO: 7711 - DNA, 201 bp, Homo sapiens; identical to SEQ ID NO: 7632

SEQ ID NO: 7712 - DNA, 201 bp, Homo sapiens; identical to SEQ ID NO: 7633

SEQ ID NO: 7713 - DNA, 201 bp, Homo sapiens; identical to SEQ ID NO: 7634

SEQ ID NO: 7714 - DNA, 201 bp, Homo sapiens; identical to SEQ ID NO: 7635

SEQ ID NO: 7715 - DNA, 201 bp, Homo sapiens; identical to SEQ ID NO: 7636

SEQ ID NO: 7716 - DNA, 201 bp, Homo sapiens; identical to SEQ ID NO: 7637

SEQ ID NO: 7717 - DNA, 201 bp, Homo sapiens; identical to SEQ ID NO: 7638

SEQ ID NO: 7718 - DNA, 201 bp, Homo sapiens; identical to SEQ ID NO: 7639

SEQ ID NO: 7719 - DNA, 201 bp, Homo sapiens; identical to SEQ ID NO: 7640

SEQ ID NO: 7720 - DNA, 201 bp, Homo sapiens; identical to SEQ ID NO: 7642

SEQ ID NO: 7721 - DNA, 201 bp, Homo sapiens; identical to SEQ ID NO: 7643

SEQ ID NO: 7722 - DNA, 201 bp, Homo sapiens; identical to SEQ ID NO: 7644

SEQ ID NO: 7723 - DNA, 201 bp, Homo sapiens; identical to SEQ ID NO: 7645

SEQ ID NO: 7724 - DNA, 201 bp, Homo sapiens; identical to SEQ ID NO: 7646

SEQ ID NO: 7725 - DNA, 201 bp, Homo sapiens; identical to SEQ ID NO: 7565

SEQ ID NO: 7726 - DNA, 201 bp, Homo sapiens; identical to SEQ ID NO: 7566

SEQ ID NO: 7727 - DNA, 201 bp, Homo sapiens; identical to SEQ ID NO: 7567

SEQ ID NO: 7728 - DNA, 201 bp, Homo sapiens; identical to SEQ ID NO: 7568

SEQ ID NO: 7729 - DNA, 201 bp, Homo sapiens; identical to SEQ ID NO: 7569

SEQ ID NO: 7730 - DNA, 201 bp, Homo sapiens; identical to SEQ ID NO: 7571

SEQ ID NO: 7731 - DNA, 201 bp, Homo sapiens; identical to SEQ ID NO: 7572

SEQ ID NO: 7732 - DNA, 201 bp, Homo sapiens; identical to SEQ ID NO: 7573

SEQ ID NO: 7733 - DNA, 201 bp, Homo sapiens; identical to SEQ ID NO: 7574

SEQ ID NO: 7734 - DNA, 201 bp, Homo sapiens; identical to SEQ ID NO: 7575

SEQ ID NO: 7735 - DNA, 201 bp, Homo sapiens; identical to SEQ ID NO: 7576

SEQ ID NO: 7736 - DNA, 201 bp, Homo sapiens; identical to SEQ ID NO: 7577

SEQ ID NO: 7737 - DNA, 201 bp, Homo sapiens; identical to SEQ ID NO: 7578

SEQ ID NO: 7738 - DNA, 201 bp, Homo sapiens; identical to SEQ ID NO: 7579

SEQ ID NO: 7739 - DNA, 201 bp, Homo sapiens; identical to SEQ ID NO: 7580

SEQ ID NO: 7740 - DNA, 201 bp, Homo sapiens; identical to SEQ ID NO: 7581

SEQ ID NO: 7741 - DNA, 201 bp, Homo sapiens; identical to SEQ ID NO: 7582

SEQ ID NO: 7742 - DNA, 201 bp, Homo sapiens; identical to SEQ ID NO: 7583

SEQ ID NO: 7743 - DNA, 201 bp, Homo sapiens; identical to SEQ ID NO: 7584

SEQ ID NO: 7744 - DNA, 201 bp, Homo sapiens; identical to SEQ ID NO: 7585

SEQ ID NO: 7745 - DNA, 201 bp, Homo sapiens; identical to SEQ ID NO: 7586

SEQ ID NO: 7746 - DNA, 201 bp, Homo sapiens; identical to SEQ ID NO: 7587

SEQ ID NO: 7747 - DNA, 201 bp, Homo sapiens; identical to SEQ ID NO: 7590

SEQ ID NO: 7748 - DNA, 201 bp, Homo sapiens; identical to SEQ ID NO: 7591

SEQ ID NO: 7749 - DNA, 201 bp, Homo sapiens; identical to SEQ ID NO: 7592

SEQ ID NO: 7750 - DNA, 201 bp, Homo sapiens; identical to SEQ ID NO: 7593

SEQ ID NO: 7751 - DNA, 201 bp, Homo sapiens; identical to SEQ ID NO: 7594

SEQ ID NO: 7752 - DNA, 201 bp, Homo sapiens; identical to SEQ ID NO: 7595

SEQ ID NO: 7753 - DNA, 201 bp, Homo sapiens; identical to SEQ ID NO: 7596

SEQ ID NO: 7754 - DNA, 201 bp, Homo sapiens; identical to SEQ ID NO: 7597

SEQ ID NO: 7755 - DNA, 201 bp, Homo sapiens; identical to SEQ ID NO: 7598

SEQ ID NO: 7756 - DNA, 201 bp, Homo sapiens
ctgggcagtggggacctgggcagcggggacttccagatggggagctggatggctgggtttttgtggagctggatgtgggctcggaagggaatgcggatggkgctcagattcaggagatgctgctcagggtcatctccagcggctctgtggcctcctacgtcacctctccccagggattccagttccgacgcctgggcacag

SEQ ID NO: 7757 - DNA, 201 bp, Homo sapiens
atgctggctgacagcatctcaggagacgacctgggcagtggggacctgggcagcggggacttccagatggggagctggatggctgggtttttgtggagctsgatgtgggctcggaagggaatgcggatggggctcagattcaggagatgctgctcagggtcatctccagcggctctgtggcctcctacgtcacctctcccc

SEQ ID NO: 7758 - DNA, 201 bp, Homo sapiens; identical to SEQ ID NO: 7601

SEQ ID NO: 7759 - DNA, 201 bp, Homo sapiens; identical to SEQ ID NO: 7602

SEQ ID NO: 7760 - DNA, 201 bp, Homo sapiens; identical to SEQ ID NO: 7603

SEQ ID NO: 7761 - DNA, 201 bp, Homo sapiens; identical to SEQ ID NO: 7604

SEQ ID NO: 7762 - DNA, 201 bp, Homo sapiens; identical to SEQ ID NO: 7605

SEQ ID NO: 7763 - DNA, 201 bp, Homo sapiens; identical to SEQ ID NO: 7606

SEQ ID NO: 7764 - DNA, 201 bp, Homo sapiens; identical to SEQ ID NO: 7607

SEQ ID NO: 7765 - DNA, 201 bp, Homo sapiens; identical to SEQ ID NO: 7608

SEQ ID NO: 7766 - DNA, 201 bp, Homo sapiens; identical to SEQ ID NO: 7609

SEQ ID NO: 7767 - DNA, 201 bp, Homo sapiens; identical to SEQ ID NO: 7610

SEQ ID NO: 7768 - DNA, 201 bp, Homo sapiens; identical to SEQ ID NO: 7611

SEQ ID NO: 7769 - DNA, 201 bp, Homo sapiens; identical to SEQ ID NO: 7612

SEQ ID NO: 7770 - DNA, 181 bp, Homo sapiens; identical to SEQ ID NO: 7692

SEQ ID NO: 7771 - DNA, 201 bp, Homo sapiens; identical to SEQ ID NO: 7614

SEQ ID NO: 7772 - DNA, 201 bp, Homo sapiens; identical to SEQ ID NO: 7615

SEQ ID NO: 7773 - DNA, 201 bp, Homo sapiens; identical to SEQ ID NO: 7616

SEQ ID NO: 7774 - DNA, 201 bp, Homo sapiens; identical to SEQ ID NO: 7617

SEQ ID NO: 7775 - DNA, 201 bp, Homo sapiens; identical to SEQ ID NO: 7619

SEQ ID NO: 7776 - DNA, 201 bp, Homo sapiens; identical to SEQ ID NO: 7618

SEQ ID NO: 7777 - DNA, 201 bp, Homo sapiens; identical to SEQ ID NO: 7620

SEQ ID NO: 7778 - DNA, 201 bp, Homo sapiens; identical to SEQ ID NO: 7621

SEQ ID NO: 7779 - DNA, 201 bp, Homo sapiens; identical to SEQ ID NO: 7622

SEQ ID NO: 7780 - DNA, 201 bp, Homo sapiens; identical to SEQ ID NO: 7623

SEQ ID NO: 7781 - DNA, 201 bp, Homo sapiens; identical to SEQ ID NO: 7624

SEQ ID NO: 7782 - DNA, 201 bp, Homo sapiens; identical to SEQ ID NO: 7625

SEQ ID NO: 7783 - DNA, 201 bp, Homo sapiens; identical to SEQ ID NO: 7626

SEQ ID NO: 7784 - DNA, 201 bp, Homo sapiens; identical to SEQ ID NO: 7627

SEQ ID NO: 7785 - DNA, 201 bp, Homo sapiens; identical to SEQ ID NO: 7628

SEQ ID NO: 7786 - DNA, 201 bp, Homo sapiens; identical to SEQ ID NO: 7630

SEQ ID NO: 7787 - DNA, 201 bp, Homo sapiens; identical to SEQ ID NO: 7631

SEQ ID NO: 7788 - DNA, 201 bp, Homo sapiens
tccatgagtctggccggccggtgcagcgcgcggagctgctgcaggtgctgcagagcctggaggccgtgctcatccagaccgtgtacaacaccaagatggcyagcgtgggacttagcgacatcgccatggataccaccgtcacccatgccaccagccatggccgtgcccacagtgtggaggagtgcaggtgcctgagccggc

SEQ ID NO: 7789 - DNA, 201 bp, Homo sapiens; identical to SEQ ID NO: 7633

SEQ ID NO: 7790 - DNA, 201 bp, Homo sapiens; identical to SEQ ID NO: 7634

SEQ ID NO: 7791 - DNA, 201 bp, Homo sapiens; identical to SEQ ID NO: 7635

SEQ ID NO: 7792 - DNA, 201 bp, Homo sapiens
ctgaggacatagagaccgtcacagcaagccaaatgcgctggacacattcgtacctttctgatgatgaggacatgctggctgacagcatctcaggagacgamctgggcagtggggacctgggcagcggggacttccagatggggagctggatggctgggtttttgtggagctggatgtgggctcggaagggaatgcggatgg

SEQ ID NO: 7793 - DNA, 201 bp, Homo sapiens; identical to SEQ ID NO: 7637

SEQ ID NO: 7794 - DNA, 201 bp, Homo sapiens; identical to SEQ ID NO: 7638

SEQ ID NO: 7795 - DNA, 201 bp, Homo sapiens; identical to SEQ ID NO: 7640

SEQ ID NO: 7796 - DNA, 201 bp, Homo sapiens; identical to SEQ ID NO: 7639

SEQ ID NO: 7797 - DNA, 201 bp, Homo sapiens; identical to SEQ ID NO: 7642

SEQ ID NO: 7798 - DNA, 201 bp, Homo sapiens; identical to SEQ ID NO: 7643

SEQ ID NO: 7799 - DNA, 201 bp, Homo sapiens; identical to SEQ ID NO: 7644

SEQ ID NO: 7800 - DNA, 201 bp, Homo sapiens; identical to SEQ ID NO: 7645

SEQ ID NO: 7801 - DNA, 201 bp, Homo sapiens; identical to SEQ ID NO: 7646

SEQ ID NO: 7802 - DNA, 201 bp, Homo sapiens
tgtggaggctggacacacggccaccttgcgctgctcagccacaggcagccccgcgcgcaccatccactggtccaagctgcgttccccactgccctggcagyaccggctggaaggtgacacactcatcataccccgggtagcccagcaggactcgggccagtacatctgcaatgccactagccctgccgggcacgctgaggc

SEQ ID NO: 7803 - DNA, 201 bp, Homo sapiens; identical to SEQ ID NO: 7577

SEQ ID NO: 7804 - DNA, 201 bp, Homo sapiens; identical to SEQ ID NO: 7631

SEQ ID NO: 7805 - DNA, 201 bp, Homo sapiens; identical to SEQ ID NO: 7571

SEQ ID NO: 7806 - DNA, 201 bp, Homo sapiens; identical to SEQ ID NO: 7603

SEQ ID NO: 7807 - DNA, 201 bp, Homo sapiens; identical to SEQ ID NO: 7604

SEQ ID NO: 7808 - DNA, 201 bp, Homo sapiens; identical to SEQ ID NO: 7605

SEQ ID NO: 7809 - DNA, 201 bp, Homo sapiens; identical to SEQ ID NO: 7634

SEQ ID NO: 7810 - DNA, 201 bp, Homo sapiens; identical to SEQ ID NO: 7596

SEQ ID NO: 7811 - DNA, 201 bp, Homo sapiens; identical to SEQ ID NO: 7567

SEQ ID NO: 7812 - DNA, 201 bp, Homo sapiens; identical to SEQ ID NO: 7599

SEQ ID NO: 7813 - DNA, 201 bp, Homo sapiens; identical to SEQ ID NO: 7600

SEQ ID NO: 7814 - DNA, 201 bp, Homo sapiens; identical to SEQ ID NO: 7610

SEQ ID NO: 7815 - DNA, 201 bp, Homo sapiens; identical to SEQ ID NO: 7628

SEQ ID NO: 7816 - DNA, 201 bp, Homo sapiens; identical to SEQ ID NO: 7643

SEQ ID NO: 7817 - DNA, 201 bp, Homo sapiens; identical to SEQ ID NO: 7579

SEQ ID NO: 7818 - DNA, 201 bp, Homo sapiens; identical to SEQ ID NO: 7629

SEQ ID NO: 7819 - DNA, 201 bp, Homo sapiens; identical to SEQ ID NO: 7632

SEQ ID NO: 7820 - DNA, 201 bp, Homo sapiens; identical to SEQ ID NO: 7633

SEQ ID NO: 7821 - DNA, 201 bp, Homo sapiens; identical to SEQ ID NO: 7636

SEQ ID NO: 7822 - DNA, 201 bp, Homo sapiens
cgggggcagcctccccgcccggcaccagacccatggctcccagctgcggctccaccacgtctcccctgccgactcaggcgagtatgtgtgtcgtgcagccrgcggcccaggccctgagcaagaagcctccttcacagtcaccgtcccgcccagtgaggggtcttcctaccgccttaggagcccggtcatctcgatcgaccc

SEQ ID NO: 7823 - DNA, 201 bp, Homo sapiens
tggacgtggagttcaagccactcgcccctgacggggtcctgctgttcagcggggggaagagcgggcctgtggaggacttcgtgtccctggcgatggtgggyggccacctggagttccgctatgagttggggtcagggctggccgttctgcggacggccgagccgctggccctgggccgctggcaccgtgtgtctgcagagc

SEQ ID NO: 7824 - DNA, 201 bp, Homo sapiens
agagcagcagctatgtgtgcgtctgcccagctggcttcaccgggagccgctgtgagcactcgcaggccctgcactgccatccagaggcctgtgggcccgaygccacctgtgtgaaccggcctgacggtcgaggctacacctgccgctgccacctgggccgctcggggttgcggtgtgaggaaggtgtgacagtgaccaccc

SEQ ID NO: 7825 - DNA, 201 bp, Homo sapiens
ctgagagcagcagctatgtgtgcgtctgcccagctggcttcaccgggagccgctgtgagcactcgcaggccctgcactgccatccagaggcctgtgggccsgacgccacctgtgtgaaccggcctgacggtcgaggctacacctgccgctgccacctgggccgctcggggttgcggtgtgaggaaggtgtgacagtgacca

SEQ ID NO: 7826 - DNA, 201 bp, Homo sapiens; identical to SEQ ID NO: 7619

SEQ ID NO: 7827 - DNA, 201 bp, Homo sapiens
agatgccccattggctattctggcttgtcctgcgagagctgtgatgcccacttcactcgggtgcctggtgggccctacctgggcacctgctctggttgcarttgcaatggccatgccagctcctgtgaccctgtgtatggccactgcctgaattgccagcacaacacggaggggccacagtgcaagaagtgcaaggctggc

SEQ ID NO: 7828 - DNA, 201 bp, Homo sapiens
cagctggagcaagctggatggcagcctgccacctgacagccgcctggagaacaacatgctgatgctgccctcagtccaaccccaggacgcaggtacctacrtctgcaccgccactaaccgccagggcaaggtcaaagcctttgcccacctgcaggtgccagagcgggtggtgccctacttcacgcagaccccctactcctt

SEQ ID NO: 7829 - DNA, 201 bp, Homo sapiens
actgcgggagggccgcagaggttccatccaagtcgacggtgaggagctggtcagcggccggtccccaggtcccaacgtggcagtcaacgccaagggcagcrtctacatcggcggagcccctgacgtggccacgctgaccgggggcagattctcctcgggcatcacaggctgtgtcaagaacctggtgctgcactcggcccg

SEQ ID NO: 7830 - DNA, 201 bp, Homo sapiens
actcccgggccacgccccagcccgacaatgtcgagtatattattattaatattattatgaatttttgtaagaaaccgagcgatgccacgctttgctcgtamcgccctgggctggactggaggtgggcatgccaccctcacacacacagctgggcaaagccacaaggctggccagcaaggcaggttggatgggagtgggcac

SEQ ID NO: 7831 - DNA, 201 bp, Homo sapiens
ggcagcatctacatcggcggagcccctgacgtggccacgctgaccgggggcagattctcctcgggcatcacaggctgtgtcaagaacctggtgctgcactyggcccgacccggcgccccgcccccacagcccctggacctgcagcaccgcgcccaggccggggccaacacacgcccctgcccctcgtaggcacctgcctgc

SEQ ID NO: 7832 - DNA, 201 bp, Homo sapiens
gctctctccctgccacctccatcccagcagggtccacgcccaccgtgcaggtcacgcctcagctagagaccaagagcattggggccagcgttgagttccaytgtgctgtgcccagcgaccggggtacccagctccgttggttcaaggaagggggtcagctgcctcccggtcacagcgtgcaggatggggtgctccgaatcc

SEQ ID NO: 7833 - DNA, 201 bp, Homo sapiens
aaggccctcccggctctctccctgccacctccatcccagcagggtccacgcccaccgtgcaggtcacgcctcagctagagaccaagagcattggggccagygttgagttccattgtgctgtgcccagcgaccggggtacccagctccgttggttcaaggaagggggtcagctgcctcccggtcacagcgtgcaggatgggg

SEQ ID NO: 7834 - DNA, 201 bp, Homo sapiens
atggccccaggggcccctcaggtccaagctgaagaagctgagctgactgtggaggctggacacacggccaccttgcgctgctcagccacaggcagccccgygcgcaccatccactggtccaagctgcgttccccactgccctggcagcaccggctggaaggtgacacactcatcataccccgggtagcccagcaggactcg

SEQ ID NO: 7835 - DNA, 201 bp, Homo sapiens
cccggatcagcagcacccctgccaagttggagcagcggacatatgggctcatggacagccacacggtgctgcagatttcatcagctaaaccatcagatgcrggcacttatgtgtgccttgctcagaatgcactaggcacagcacagaagcaggtggaggtgatcgtggacacgggcgccatggccccaggggcccctcagg

SEQ ID NO: 7836 - DNA, 201 bp, Homo sapiens
cttcacagtcaccgtcccgcccagtgaggggtcttcctaccgccttaggagcccggtcatctcgatcgacccgcccagcagcaccgtgcagcagggccagratgccagcttcaagtgcctcatccatgacggggcagcccccatcagcctcgagtggaagacccggaaccaggagctggaggacaacgtccacatcagtcc

SEQ ID NO: 7837 - DNA, 201 bp, Homo sapiens; identical to SEQ ID NO: 7608

SEQ ID NO: 7838 - DNA, 201 bp, Homo sapiens; identical to SEQ ID NO: 7621

SEQ ID NO: 7839 - DNA, 201 bp, Homo sapiens
gccggtccccaggtcccaacgtggcagtcaacgccaagggcagcatctacatcggcggagcccctgacgtggccacgctgaccgggggcagattctcctcrggcatcacaggctgtgtcaagaacctggtgctgcactcggcccgacccggcgccccgcccccacagcccctggacctgcagcaccgcgcccaggccgggg

SEQ ID NO: 7840 - DNA, 201 bp, Homo sapiens
gcactgcgggagggccgcagaggttccatccaagtcgacggtgaggagctggtcagcggccggtccccaggtcccaacgtggcagtcaacgccaagggcarcatctacatcggcggagcccctgacgtggccacgctgaccgggggcagattctcctcgggcatcacaggctgtgtcaagaacctggtgctgcactcggcc

SEQ ID NO: 7841 - DNA, 201 bp, Homo sapiens
tgaggaccccatcaatgacggcgagtggcaccgggtgacagcactgcgggagggccgcagaggttccatccaagtcgacggtgaggagctggtcagcggcmggtccccaggtcccaacgtggcagtcaacgccaagggcagcatctacatcggcggagcccctgacgtggccacgctgaccgggggcagattctcctcggg

SEQ ID NO: 7842 - DNA, 201 bp, Homo sapiens
ctcacttccgcggctgtgtgggcgaggtgtcagtgaatggcaaacggctggacctcacctacagtttcctaggcagccagggcatcgggcaatgctatgayagctccccatgtgagcgccagccttgccaacatggtgccacgtgcatgcccgctggcgagtatgagttccagtgcctgtgtcgagatggaatcaaaggag

SEQ ID NO: 7843 - DNA, 201 bp, Homo sapiens; identical to SEQ ID NO: 7611

SEQ ID NO: 7844 - DNA, 201 bp, Homo sapiens
gtccgtgtgcctgctggttctgcagctgtcttcccctgcatagcctcaggctaccccactcctgacatcagctggagcaagctggatggcagcctgccacytgacagccgcctggagaacaacatgctgatgctgccctcagtccaaccccaggacgcaggtacctacgtctgcaccgccactaaccgccagggcaaggtc

SEQ ID NO: 7845 - DNA, 201 bp, Homo sapiens
agcgtggaggcagcttacccagccggcaccagatcgtgggctcccggctgcggatccctcaggtgactccggcagactcgggcgagtacgtgtgtcacgtmagtaacggtgcaggctcccgggagacctcgctcatcgtcaccatccagggcagcggttcctcccacgtgcccagagtctccccaccgatcaggatcgagt

SEQ ID NO: 7846 - DNA, 201 bp, Homo sapiens; identical to SEQ ID NO: 7614

SEQ ID NO: 7847 - DNA, 201 bp, Homo sapiens; identical to SEQ ID NO: 7615

SEQ ID NO: 7848 - DNA, 201 bp, Homo sapiens; identical to SEQ ID NO: 7622

SEQ ID NO: 7849 - DNA, 201 bp, Homo sapiens; identical to SEQ ID NO: 7594

SEQ ID NO: 7850 - DNA, 201 bp, Homo sapiens; identical to SEQ ID NO: 7595

SEQ ID NO: 7851 - DNA, 201 bp, Homo sapiens; identical to SEQ ID NO: 7601

SEQ ID NO: 7852 - DNA, 201 bp, Homo sapiens; identical to SEQ ID NO: 7625

SEQ ID NO: 7853 - DNA, 201 bp, Homo sapiens; identical to SEQ ID NO: 7623

SEQ ID NO: 7854 - DNA, 201 bp, Homo sapiens; identical to SEQ ID NO: 7644

SEQ ID NO: 7855 - DNA, 201 bp, Homo sapiens; identical to SEQ ID NO: 7645

SEQ ID NO: 7856 - DNA, 201 bp, Homo sapiens
gttgtcctttcagcctcagatgccagccaaccgccggtcaagattgagtcctcatcgccttctgtgacagaagggcaaacactcgacctcaactgtgtggkggcagggtcagcccatgcccaggtcacctggtacaggcgagggggtagcctgcctcaccacacccaggtgcacggctcccgtctgcggctcccccaggtc

SEQ ID NO: 7857 - DNA, 201 bp, Homo sapiens
gtctgcggctcccccaggtctcaccagctgattctggagagtatgtgtgccgtgtggagaatggatcgggccccaaggaggcctccattactgtgtctgtrctccacggcacccattctggccccagctacaccccagtgcccggcagcacccggcccatccgcatcgagccctcctcctcacacgtggcggaagggcaga

SEQ ID NO: 7858 - DNA, 201 bp, Homo sapiens; identical to SEQ ID NO: 7635

SEQ ID NO: 7859 - DNA, 201 bp, Homo sapiens
gctgcggctgcaccatgtgtccccggccgactcgggtgaatacgtgtgccgggtgatgggcagctctggccccctggaggcctcagtcctcgtcaccatcraagcctctggctcaagtgctgtccacgtccccgccccaggtggagccccacccatccgcatcgagccctcctcctcccgagtggcagaagggcagaccct

SEQ ID NO: 7860 - DNA, 201 bp, Homo sapiens; identical to SEQ ID NO: 7639

SEQ ID NO: 7861 - DNA, 201 bp, Homo sapiens; identical to SEQ ID NO: 7568

SEQ ID NO: 7862 - DNA, 201 bp, Homo sapiens; identical to SEQ ID NO: 7569

SEQ ID NO: 7863 - DNA, 201 bp, Homo sapiens
gaccccatcaatgacggcgagtggcaccgggtgacagcactgcgggagggccgcagaggttccatccaagtcgacggtgaggagctggtcagcggccggtscccaggtcccaacgtggcagtcaacgccaagggcagcatctacatcggcggagcccctgacgtggccacgctgaccgggggcagattctcctcgggcatc

SEQ ID NO: 7864 - DNA, 201 bp, Homo sapiens; identical to SEQ ID NO: 7582

SEQ ID NO: 7865 - DNA, 201 bp, Homo sapiens; identical to SEQ ID NO: 7566

SEQ ID NO: 7866 - DNA, 201 bp, Homo sapiens
tggccacgctgaccgggggcagattctcctcgggcatcacaggctgtgtcaagaacctggtgctgcactcggcccgacccggcgccccgcccccacagccyctggacctgcagcaccgcgcccaggccggggccaacacacgcccctgcccctcgtaggcacctgcctgccccacacggactcccgggccacgccccagcc

SEQ ID NO: 7867 - DNA, 201 bp, Homo sapiens
tcaccatcgtgggcacccggcccagcaaccacggtacctaccgctgcgtggcctccaatgcctacggtgtggcccagagtgtggtgaacctcagtgtgcaygggccccctacagtgtccgtgctccccgagggccccgtgtgggtgaaagtgggaaaggccgtcaccctggagtgtgtcagtgccggggagccccgctcct

SEQ ID NO: 7868 - DNA, 201 bp, Homo sapiens
gtggtgcccgggcaggcccatgcccaggtcacgtggtacaagcgcgggggcagcctccccgcccggcaccagacccatggctcccagctgcggctccaccwcgtctcccctgccgactcaggcgagtatgtgtgtcgtgcagccggcggcccaggccctgagcaagaagcctccttcacagtcaccgtcccgcccagtgag

SEQ ID NO: 7869 - DNA, 201 bp, Homo sapiens
ccgccgactcgggcgagtacgtgtgccgagtgttgggcagctccgtgcctctagaggcctctgtcctggtcaccattgagcctgcgggctcagtgcctgcwcttggggtcacccccacggtccggatcgagtcatcgtcttcgcaagtggcagaggggcagaccctggacctgaactgcctcgttgctggtcaggcccatg

SEQ ID NO: 7870 - DNA, 201 bp, Homo sapiens; identical to SEQ ID NO: 7616

SEQ ID NO: 7871 - DNA, 201 bp, Homo sapiens; identical to SEQ ID NO: 7618

SEQ ID NO: 7872 - DNA, 201 bp, Homo sapiens; identical to SEQ ID NO: 7640

SEQ ID NO: 7873 - DNA, 201 bp, Homo sapiens
ggtgcccgggcaggcccatgcccaggtcacgtggtacaagcgcgggggcagcctccccgcccggcaccagacccatggctcccagctgcggctccaccacrtctcccctgccgactcaggcgagtatgtgtgtcgtgcagccggcggcccaggccctgagcaagaagcctccttcacagtcaccgtcccgcccagtgaggg

SEQ ID NO: 7874 - DNA, 201 bp, Homo sapiens; identical to SEQ ID NO: 7578

SEQ ID NO: 7875 - DNA, 201 bp, Homo sapiens
gatcacgggcaacaacatcatgctagtggcctcccagccagcgctgcagggccctgagaggaggagctacgagatcatgttccgagaggaattctggcgcyggcccgatgggcagccggccacacgcgagcacctcctgatggcactggccgacctggatgagctcctgatccgggccacgttctcctccgtgccgctggt

SEQ ID NO: 7876 - DNA, 201 bp, Homo sapiens; identical to SEQ ID NO: 7626

SEQ ID NO: 7877 - DNA, 201 bp, Homo sapiens; identical to SEQ ID NO: 7642

SEQ ID NO: 7878 - DNA, 201 bp, Homo sapiens; identical to SEQ ID NO: 7646

SEQ ID NO: 7879 - DNA, 201 bp, Homo sapiens
ggcggagctggtggattcggtcctggatgtggtgcggaaggagtgtgaaaactgcgactgcctgcagggcttccagctgacccactcgctggggggcggcmcgggctccggcatgggcacgttgctcatcagcaaggtgcgtgaggagtatcccgaccgcatcatgaacaccttcagcgtcgtgccctcacccaaggtgtc

SEQ ID NO: 7880 - DNA, 201 bp, Homo sapiens
ccagcagtgtctaaacccccggagccatcttgctgccgacaccctgctttcccctcgccctagggctcccttgccgccctcctgcagtatttatggcctcrtcctccccacctaggccacgtgtgagctgctcctgtctctgtcttattgcagctccaggcctgacgttttacggttttgttttttactggtttgtgttta

SEQ ID NO: 7881 - DNA, 201 bp, Homo sapiens
ggcctgacaatttcatctttggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcacgggctccggcatgggcacgttgctcatca

SEQ ID NO: 7882 - DNA, 201 bp, Homo sapiens
gtgtccgagtaccagcagtaccaggacgccacggccgaggaagagggcgagatgtacgaagacgacgaggaggagtcggaggcccagggccccaagtgaarctgctcgcagctggagtgagaggcaggtggcggccggggccgaagccagcagtgtctaaacccccggagccatcttgctgccgacaccctgctttcccct

SEQ ID NO: 7883 - DNA, 201 bp, Homo sapiens
cggaggcccagggccccaagtgaagctgctcgcagctggagtgagaggcaggtggcggccggggccgaagccagcagtgtctaaacccccggagccatctygctgccgacaccctgctttcccctcgccctagggctcccttgccgccctcctgcagtatttatggcctcgtcctccccacctaggccacgtgtgagctgc

SEQ ID NO: 7884 - DNA, 201 bp, Homo sapiens
acatgatggccgcctgcgacccgcgccacggccgctacctgacggtggccaccgtgttccggggccgcatgtccatgaaggaggtggacgagcagatgctrgccatccagagcaagaacagcagctacttcgtggagtggatccccaacaacgtgaaggtggccgtgtgtgacatcccgccccgcggcctcaagatgtcct

SEQ ID NO: 7885 - DNA, 201 bp, Homo sapiens
tccaccagctggtggagaacacggatgagacctactgcatcgacaacgaggcgctctacgacatctgcttccgcaccctcaagctggccacgcccacctayggggacctcaaccacctggtatcggccaccatgagcggagtcaccacctccttgcgcttcccgggccagctcaacgctgacctgcgcaagctggccgtca

SEQ ID NO: 7886 - DNA, 201 bp, Homo sapiens; identical to SEQ ID NO: 7879

SEQ ID NO: 7887 - DNA, 201 bp, Homo sapiens; identical to SEQ ID NO: 7881

SEQ ID NO: 7888 - DNA, 201 bp, Homo sapiens; identical to SEQ ID NO: 7880

SEQ ID NO: 7889 - DNA, 201 bp, Homo sapiens; identical to SEQ ID NO: 7882

SEQ ID NO: 7890 - DNA, 201 bp, Homo sapiens; identical to SEQ ID NO: 7884

SEQ ID NO: 7891 - DNA, 201 bp, Homo sapiens; identical to SEQ ID NO: 7885

SEQ ID NO: 7892 - DNA, 201 bp, Homo sapiens; identical to SEQ ID NO: 7883

SEQ ID NO: 7893 - DNA, 201 bp, Homo sapiens; identical to SEQ ID NO: 7879

SEQ ID NO: 7894 - DNA, 201 bp, Homo sapiens
cgggctgcggtgctgcagcagctggacaatgtcattgacgtgatcacctgcagctccatgctgtccagcctctgcttcctgggcgccatcgccgtggaccrctacatctccatcttctacgcactgcgctaccacagcatcgtgaccctgccgcgggcgcggcgagccgttgcggccatctgggtggccagtgtcgtcttc

SEQ ID NO: 7895 - DNA, 201 bp, Homo sapiens
acctctttctcgccctcatcatctgcaatgccatcatcgaccccctcatctacgccttccacagccaggagctccgcaggacgctcaaggaggtgctgacrtgctcctgctctcaggaccgtgccctcgtcagctgggatgtgaagtctctgggtggaagtgtgtgccaagagctactcccacagcagccccaggagaagg

SEQ ID NO: 7896 - DNA, 201 bp, Homo sapiens
caatgtcattgacgtgatcacctgcagctccatgctgtccagcctctgcttcctgggcgccatcgccgtggaccgctacatctccatcttctacgcactgygctaccacagcatcgtgaccctgccgcgggcgcggcgagccgttgcggccatctgggtggccagtgtcgtcttcagcacgctcttcatcgcctactacga

SEQ ID NO: 7897 - DNA, 201 bp, Homo sapiens
ggtggtggccaccatcgccaagaaccggaacctgcactcacccatgtactgcttcatctgctgcctggccttgtcggacctgctggtgagcgggagcaacrtgctggagacggccgtcatcctcctgctggaggccggtgcactggtggcccgggctgcggtgctgcagcagctggacaatgtcattgacgtgatcacctg

SEQ ID NO: 7898 - DNA, 201 bp, Homo sapiens
tctcacactcatcgtcctctgccccgagcaccccacgtgcggctgcatcttcaagaacttcaacctctttctcgccctcatcatctgcaatgccatcatcsaccccctcatctacgccttccacagccaggagctccgcaggacgctcaaggaggtgctgacatgctcctgctctcaggaccgtgccctcgtcagctggga

SEQ ID NO: 7899 - DNA, 201 bp, Homo sapiens
atcgccgtggaccgctacatctccatcttctacgcactgcgctaccacagcatcgtgaccctgccgcgggcgcggcgagccgttgcggccatctgggtggmcagtgtcgtcttcagcacgctcttcatcgcctactacgaccacgtggccgtcctgctgtgcctcgtggtcttcttcctggctatgctggtgctcatggcc

SEQ ID NO: 7900 - DNA, 201 bp, Homo sapiens
ctccatgctgtccagcctctgcttcctgggcgccatcgccgtggaccgctacatctccatcttctacgcactgcgctaccacagcatcgtgaccctgccgygggcgcggcgagccgttgcggccatctgggtggccagtgtcgtcttcagcacgctcttcatcgcctactacgaccacgtggccgtcctgctgtgcctcgt

SEQ ID NO: 7901 - DNA, 201 bp, Homo sapiens
ccggctccacaagaggcagcgcccggtccaccagggctttggccttaaaggcgctgtcaccctcaccatcctgctgggcattttcttcctctgctggggcyccttcttcctgcatctcacactcatcgtcctctgccccgagcaccccacgtgcggctgcatcttcaagaacttcaacctctttctcgccctcatcatctg

SEQ ID NO: 7902 - DNA, 201 bp, Homo sapiens
gccccgagcaccccacgtgcggctgcatcttcaagaacttcaacctctttctcgccctcatcatctgcaatgccatcatcgaccccctcatctacgccttycacagccaggagctccgcaggacgctcaaggaggtgctgacatgctcctgctctcaggaccgtgccctcgtcagctgggatgtgaagtctctgggtggaa

SEQ ID NO: 7903 - DNA, 201 bp, Homo sapiens
tgggcgccatcgccgtggaccgctacatctccatcttctacgcactgcgctaccacagcatcgtgaccctgccgcgggcgcggcgagccgttgcggccatytgggtggccagtgtcgtcttcagcacgctcttcatcgcctactacgaccacgtggccgtcctgctgtgcctcgtggtcttcttcctggctatgctggtgc

SEQ ID NO: 7904 - DNA, 201 bp, Homo sapiens
tccagcctctgcttcctgggcgccatcgccgtggaccgctacatctccatcttctacgcactgcgctaccacagcatcgtgaccctgccgcgggcgcggcragccgttgcggccatctgggtggccagtgtcgtcttcagcacgctcttcatcgcctactacgaccacgtggccgtcctgctgtgcctcgtggtcttcttc

SEQ ID NO: 7905 - DNA, 201 bp, Homo sapiens
tgtacgtccacatgctggcccgggcctgccagcacgcccagggcatcgcccggctccacaagaggcagcgcccggtccaccagggctttggccttaaaggygctgtcaccctcaccatcctgctgggcattttcttcctctgctggggccccttcttcctgcatctcacactcatcgtcctctgccccgagcaccccacgt

SEQ ID NO: 7906 - DNA, 201 bp, Homo sapiens; identical to SEQ ID NO: 7882

SEQ ID NO: 7907 - DNA, 201 bp, Homo sapiens
gggctccctcaactccacccccacagccatcccccagctggggctggctgccaaccagacaggagcccggtgcctggaggtgtccatctctgacgggctcytcctcagcctggggctggtgagcttggtggagaacgcgctggtggtggccaccatcgccaagaaccggaacctgcactcacccatgtactgcttcatctg

SEQ ID NO: 7908 - DNA, 201 bp, Homo sapiens
gctggtgagcttggtggagaacgcgctggtggtggccaccatcgccaagaaccggaacctgcactcacccatgtactgcttcatctgctgcctggccttgycggacctgctggtgagcgggagcaacgtgctggagacggccgtcatcctcctgctggaggccggtgcactggtggcccgggctgcggtgctgcagcagct

SEQ ID NO: 7909 - DNA, 201 bp, Homo sapiens
ggctgccaaccagacaggagcccggtgcctggaggtgtccatctctgacgggctcttcctcagcctggggctggtgagcttggtggagaacgcgctggtgktggccaccatcgccaagaaccggaacctgcactcacccatgtactgcttcatctgctgcctggccttgtcggacctgctggtgagcgggagcaacgtgct

SEQ ID NO: 7910 - DNA, 201 bp, Homo sapiens
tgagcttggtggagaacgcgctggtggtggccaccatcgccaagaaccggaacctgcactcacccatgtactgcttcatctgctgcctggccttgtcggamctgctggtgagcgggagcaacgtgctggagacggccgtcatcctcctgctggaggccggtgcactggtggcccgggctgcggtgctgcagcagctggaca

SEQ ID NO: 7911 - DNA, 201 bp, Homo sapiens
catcgccgtggaccgctacatctccatcttctacgcactgcgctaccacagcatcgtgaccctgccgcgggcgcggcgagccgttgcggccatctgggtgkccagtgtcgtcttcagcacgctcttcatcgcctactacgaccacgtggccgtcctgctgtgcctcgtggtcttcttcctggctatgctggtgctcatggc

SEQ ID NO: 7912 - DNA, 201 bp, Homo sapiens
gctggtggtggccaccatcgccaagaaccggaacctgcactcacccatgtactgcttcatctgctgcctggccttgtcggacctgctggtgagcgggagcracgtgctggagacggccgtcatcctcctgctggaggccggtgcactggtggcccgggctgcggtgctgcagcagctggacaatgtcattgacgtgatcac

SEQ ID NO: 7913 - DNA, 201 bp, Homo sapiens; identical to SEQ ID NO: 7883

SEQ ID NO: 7914 - DNA, 201 bp, Homo sapiens
gtgatcacctgcagctccatgctgtccagcctctgcttcctgggcgccatcgccgtggaccgctacatctccatcttctacgcactgcgctaccacagcaycgtgaccctgccgcgggcgcggcgagccgttgcggccatctgggtggccagtgtcgtcttcagcacgctcttcatcgcctactacgaccacgtggccgtc

SEQ ID NO: 7915 - DNA, 201 bp, Homo sapiens
aggcagcgcccggtccaccagggctttggccttaaaggcgctgtcaccctcaccatcctgctgggcattttcttcctctgctggggccccttcttcctgcmtctcacactcatcgtcctctgccccgagcaccccacgtgcggctgcatcttcaagaacttcaacctctttctcgccctcatcatctgcaatgccatcatc

SEQ ID NO: 7916 - DNA, 201 bp, Homo sapiens; identical to SEQ ID NO: 7881

SEQ ID NO: 7917 - DNA, 201 bp, Homo sapiens; identical to SEQ ID NO: 7880

SEQ ID NO: 7918 - DNA, 201 bp, Homo sapiens
ctcacccatgtactgcttcatctgctgcctggccttgtcggacctgctggtgagcgggagcaacgtgctggagacggccgtcatcctcctgctggaggccrgtgcactggtggcccgggctgcggtgctgcagcagctggacaatgtcattgacgtgatcacctgcagctccatgctgtccagcctctgcttcctgggcgc

SEQ ID NO: 7919 - DNA, 201 bp, Homo sapiens; identical to SEQ ID NO: 7884

SEQ ID NO: 7920 - DNA, 201 bp, Homo sapiens; identical to SEQ ID NO: 7885

SEQ ID NO: 7921 - DNA, 201 bp, Homo sapiens
tcattgacgtgatcacctgcagctccatgctgtccagcctctgcttcctgggcgccatcgccgtggaccgctacatctccatcttctacgcactgcgctamcacagcatcgtgaccctgccgcgggcgcggcgagccgttgcggccatctgggtggccagtgtcgtcttcagcacgctcttcatcgcctactacgaccacg

SEQ ID NO: 7922 - DNA, 124 bp, Homo sapiens
ctggggcggggccgtggatgccacgttcccatgcctgtgtcctggggcggggccgtggatgccacgttcccatgtctgtgtcctggggcggggccgtggaygcgccacagaaacaggagggcct

SEQ ID NO: 7923 - DNA, 201 bp, Homo sapiens
attcacccaggatcccctcaggaggcagagcctcgctctgctgtgaccccaagttctcaagaccctgtccagagccctcgtcctgagcactcagcagcatsggctcagggaagccacggcgggtcagagtggggccggcaacaactgggccaagggtcactacacggagggggcggagctggtggattcggtcctggatgt

SEQ ID NO: 7924 - DNA, 201 bp, Homo sapiens; identical to SEQ ID NO: 7879

SEQ ID NO: 7925 - DNA, 201 bp, Homo sapiens
ggctcagggaagccacggcgggtcagagtggggccggcaacaactgggccaagggtcactacacggagggggcggagctggtggattcggtcctggatgtrgtgcggaaggagtgtgaaaactgcgactgcctgcagggcttccagctgacccactcgctggggggcggcacgggctccggcatgggcacgttgctcatca

SEQ ID NO: 7926 - DNA, 201 bp, Homo sapiens; identical to SEQ ID NO: 7880

SEQ ID NO: 7927 - DNA, 201 bp, Homo sapiens
ggtggctgtttgggctcctggcactgccagtcggaaggaaggtatgctggagcaggagggctgatccattcacccaggatcccctcaggaggcagagcctygctctgctgtgaccccaagttctcaagaccctgtccagagccctcgtcctgagcactcagcagcatcggctcagggaagccacggcgggtcagagtgggg

SEQ ID NO: 7928 - DNA, 201 bp, Homo sapiens; identical to SEQ ID NO: 7882

SEQ ID NO: 7929 - DNA, 201 bp, Homo sapiens; identical to SEQ ID NO: 7885

SEQ ID NO: 7930 - DNA, 201 bp, Homo sapiens; identical to SEQ ID NO: 7884

SEQ ID NO: 7931 - DNA, 201 bp, Homo sapiens; identical to SEQ ID NO: 7883

SEQ ID NO: 7932 - DNA, 201 bp, Homo sapiens
tcggaaggaaggtatgctggagcaggagggctgatccattcacccaggatcccctcaggaggcagagcctcgctctgctgtgaccccaagttctcaagacyctgtccagagccctcgtcctgagcactcagcagcatcggctcagggaagccacggcgggtcagagtggggccggcaacaactgggccaagggtcactaca

SEQ ID NO: 7933 - DNA, 182 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 7934 - DNA, 201 bp, Homo sapiens
aagggagcttctgtgcatcgcctgagagcagcagggatgacttccaggagggaagggagggcattgtggcccggctaacagagagcctgttcctggacctkctcggagaggagaatgggggcttttgccagcaggacatgggggagtcatgccttcttccaccttcgggaagtacgagtgctcacatgccctgggatgagt

SEQ ID NO: 7935 - DNA, 201 bp, Homo sapiens
gggaagggagggcattgtggcccggctaacagagagcctgttcctggacctgctcggagaggagaatgggggcttttgccagcaggacatgggggagtcaygccttcttccaccttcgggaagtacgagtgctcacatgccctgggatgagttcccaagtgcagggcccaaggaggcacctccctggggcaaggagcagcc

SEQ ID NO: 7936 - DNA, 181 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 7937 - DNA, 201 bp, Homo sapiens
gaagggagggcattgtggcccggctaacagagagcctgttcctggacctgctcggagaggagaatgggggcttttgccagcaggacatgggggagtcatgycttcttccaccttcgggaagtacgagtgctcacatgccctgggatgagttcccaagtgcagggcccaaggaggcacctccctggggcaaggagcagcctc

SEQ ID NO: 7938 - DNA, 201 bp, Homo sapiens
gccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctgctcggagaggagaatgggggcttttgccagcaggacatgggggagtcatgccttctt

SEQ ID NO: 7939 - DNA, 201 bp, Homo sapiens
atgtctccgacactctgctgctgacctggagcaacccgtatccccctgacaattacctgtataatcatctcacctatgcagtcaacatttggagtgaaaaygacccggcagatttcagaatctataacgtgacctacctagaaccctccctccgcatcgcagccagcaccctgaagtctgggatttcctacagggcacggg

SEQ ID NO: 7940 - DNA, 201 bp, Homo sapiens
gggagggcattgtggcccggctaacagagagcctgttcctggacctgctcggagaggagaatgggggcttttgccagcaggacatgggggagtcatgcctycttccaccttcgggaagtacgagtgctcacatgccctgggatgagttcccaagtgcagggcccaaggaggcacctccctggggcaaggagcagcctctcc

SEQ ID NO: 7941 - DNA, 201 bp, Homo sapiens
tgagccagaaacctgggagcagatcctccgccgaaatgtcctccagcatggggcagctgcagcccccgtctcggcccccaccagtggctatcaggagtttrtacatgcggtggagcagggtggcacccaggccagtgcggtggtgggcttgggtcccccaggagaggctggttacaaggccttctcaagcctgcttgccag

SEQ ID NO: 7942 - DNA, 201 bp, Homo sapiens
ggagcttctgtgcatcgcctgagagcagcagggatgacttccaggagggaagggagggcattgtggcccggctaacagagagcctgttcctggacctgctyggagaggagaatgggggcttttgccagcaggacatgggggagtcatgccttcttccaccttcgggaagtacgagtgctcacatgccctgggatgagttcc

SEQ ID NO: 7943 - DNA, 201 bp, Homo sapiens
agggcattgtggcccggctaacagagagcctgttcctggacctgctcggagaggagaatgggggcttttgccagcaggacatgggggagtcatgccttctyccaccttcgggaagtacgagtgctcacatgccctgggatgagttcccaagtgcagggcccaaggaggcacctccctggggcaaggagcagcctctccacc

SEQ ID NO: 7944 - DNA, 201 bp, Homo sapiens
ccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctggg

SEQ ID NO: 7945 - DNA, 201 bp, Homo sapiens
caaaatcgtgaactttgtctccgtgggacccacatacatgagggtctcttaggtgcatgtcctcttgttgctgagtctgcagatgaggactagggcttatycatgcctgggaaatgccacctcctggaaggcagccaggctggcagatttccaaaagacttgaagaaccatggtatgaaggtgattggccccactgacgtt

SEQ ID NO: 7946 - DNA, 201 bp, Homo sapiens
aactatacactggacctgtgggctgggcagcagctgctgtggaagggctccttcaagcccagcgagcatgtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 7947 - DNA, 201 bp, Homo sapiens
  misc_feature (1)...(201): n = A,T,C or G, or insertion/deletion polymorphism (see Tables 1-2)
ctctacttgcgagtggaagatgaatggtcccaccaattgcagcaccgagctccgcctgttgtaccagctggtttttctgctctccgaagcccacacgtgtntccctgagaacaacggaggcgcggggtgcgtgtgccacctgctcatggatgacgtggtcagtgcggataactatacactggacctgtgggctgggcagca

SEQ ID NO: 7948 - DNA, 201 bp, Homo sapiens
gagggtctcttaggtgcatgtcctcttgttgctgagtctgcagatgaggactagggcttatccatgcctgggaaatgccacctcctggaaggcagccaggstggcagatttccaaaagacttgaagaaccatggtatgaaggtgattggccccactgacgttggcctaacactgggctgcagagactggaccccgcccagc

SEQ ID NO: 7949 - DNA, 201 bp, Homo sapiens
gcattgtcatcctggccgtctgcctgttgtgctatgtcagcatcaccaagattaagaaagaatggtgggatcagattcccaacccagcccgcagccgcctsgtggctataataatccaggatgctcaggggtcacagtgggagaagcggtcccgaggccaggaaccagccaagtgcccacactggaagaattgtcttacca

SEQ ID NO: 7950 - DNA, 201 bp, Homo sapiens
aggatgctcaggggtcacagtgggagaagcggtcccgaggccaggaaccagccaagtgcccacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 7951 - DNA, 201 bp, Homo sapiens
ctgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtga

SEQ ID NO: 7952 - DNA, 201 bp, Homo sapiens
catcctgcccctggcaatgctcagagctcaagccagacccccaaaatcgtgaactttgtctccgtgggacccacatacatgagggtctcttaggtgcatgycctcttgttgctgagtctgcagatgaggactagggcttatccatgcctgggaaatgccacctcctggaaggcagccaggctggcagatttccaaaagact

SEQ ID NO: 7953 - DNA, 201 bp, Homo sapiens
tccatcctgcccctggcaatgctcagagctcaagccagacccccaaaatcgtgaactttgtctccgtgggacccacatacatgagggtctcttaggtgcaygtcctcttgttgctgagtctgcagatgaggactagggcttatccatgcctgggaaatgccacctcctggaaggcagccaggctggcagatttccaaaaga

SEQ ID NO: 7954 - DNA, 201 bp, Homo sapiens
caggtggggttccactggaggccagtctgtgtccggcctccctggcaccctcgggcatctcagagaagagtaaatcctcatcatccttccatcctgccccyggcaatgctcagagctcaagccagacccccaaaatcgtgaactttgtctccgtgggacccacatacatgagggtctcttaggtgcatgtcctcttgttgc

SEQ ID NO: 7955 - DNA, 201 bp, Homo sapiens
agcaacagaggacatgaaaaattgctgtgactaaagcagggacaatttgctgccaaacacccatgcccagctgtatggctgggggctcctcgtatgcatgsaacccccagaataaatatgctcagccaccctgtgggccgggcaatccagacagcaggcataaggcaccagttaccctgcatgttggcccagacctcaggt

SEQ ID NO: 7956 - DNA, 201 bp, Homo sapiens
gactaaagcagggacaatttgctgccaaacacccatgcccagctgtatggctgggggctcctcgtatgcatggaacccccagaataaatatgctcagccaycctgtgggccgggcaatccagacagcaggcataaggcaccagttaccctgcatgttggcccagacctcaggtgctagggaaggcgggaaccttgggttga

SEQ ID NO: 7957 - DNA, 201 bp, Homo sapiens
ccccaacctgagccagaaacctgggagcagatcctccgccgaaatgtcctccagcatggggcagctgcagcccccgtctcggcccccaccagtggctatcrggagtttgtacatgcggtggagcagggtggcacccaggccagtgcggtggtgggcttgggtcccccaggagaggctggttacaaggccttctcaagcctg

SEQ ID NO: 7958 - DNA, 201 bp, Homo sapiens
ccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcat

SEQ ID NO: 7959 - DNA, 201 bp, Homo sapiens
aagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagct

SEQ ID NO: 7960 - DNA, 201 bp, Homo sapiens
gtggcccggctaacagagagcctgttcctggacctgctcggagaggagaatgggggcttttgccagcaggacatgggggagtcatgccttcttccaccttygggaagtacgagtgctcacatgccctgggatgagttcccaagtgcagggcccaaggaggcacctccctggggcaaggagcagcctctccacctggagcca

SEQ ID NO: 7961 - DNA, 201 bp, Homo sapiens
ttcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatggaacccccagaataaatatgctcagcc

SEQ ID NO: 7962 - DNA, 201 bp, Homo sapiens
ttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatga

SEQ ID NO: 7963 - DNA, 201 bp, Homo sapiens
ctcgccccctacaacccccctgagggccccagacccctctccaggtggggttccactggaggccagtctgtgtccggcctccctggcaccctcgggcatcycagagaagagtaaatcctcatcatccttccatcctgcccctggcaatgctcagagctcaagccagacccccaaaatcgtgaactttgtctccgtgggacc

SEQ ID NO: 7964 - DNA, 201 bp, Homo sapiens
cgaggagggatgagaaagtttatctgccctctcacaggactgtggcccatcaacactctgaaatgtacacccagagtatgtccttttgctggaatcttagraaatggagccgtacgctatacgacttttgaatatcccaacacgatcagtttttcttgtaacactgggttttatctgaatggcgctgattctgccaagtgc

SEQ ID NO: 7965 - DNA, 201 bp, Homo sapiens
gaatggaatgctacatggtgataaagtttctttcttctgcaaaaataaggaaaagaagtgtagctatacagaggatgctcagtgtatagatggcactatcraagtccccaaatgcttcaaggaacacagttctctggctttttggaaaactgatgcatccgatgtaaagccatgctaaggtggttttcagattccacataa

SEQ ID NO: 7966 - DNA, 157 bp, Homo sapiens
cagacgaaaaccactttggtagtgccagtgtgactcatccacaatgatttctccagygctcatcttgttctcgagttttctctgccatgttgctattgcaggacggacctgtcccaagccagatgatttaccattttccacagtggtcccgttaaaa

SEQ ID NO: 7967 - DNA, 185 bp, Homo sapiens
tcgaagtccccaaatgcttcaaggaacacagttctctggctttttggaaaactgatgcatccgatgtaaagccatgctaaggtggttttcagattccacayaaaatgtcacacttgtttcttgttcatccaaggaacctaattgaaatttaaaaataaagctactgaatttattgccgcacccat

SEQ ID NO: 7968 - DNA, 106 bp, Homo sapiens
cagacraaaaccactttggtagtgccagtgtgactcatccacaatgatttctccagtgctcatcttgttctcgagttttctctgccatgttgctattgcaggacgg

SEQ ID NO: 7969 - DNA, 201 bp, Homo sapiens
cttttgaatatcccaacacgatcagtttttcttgtaacactgggttttatctgaatggcgctgattctgccaagtgcactgaggaaggaaaatggagcccrgagcttcctgtctgtgctcccatcatctgccctccaccatccatacctacgtttgcaacacttcgtgtttataagccatcagctggaaacaattccctct

SEQ ID NO: 7970 - DNA, 201 bp, Homo sapiens
acatggtgataaagtttctttcttctgcaaaaataaggaaaagaagtgtagctatacagaggatgctcagtgtatagatggcactatcgaagtccccaaakgcttcaaggaacacagttctctggctttttggaaaactgatgcatccgatgtaaagccatgctaaggtggttttcagattccacataaaatgtcacactt

SEQ ID NO: 7971 - DNA, 201 bp, Homo sapiens
tggctgccatgatggatattctctggatggcccggaagaaatagaatgtaccaaactgggaaactggtctgccatgccaagttgtaaagcatcttgtaaaktacctgtgaaaaaagccactgtggtgtaccaaggagagagagtaaagattcaggaaaaatttaagaatggaatgctacatggtgataaagtttctttctt

SEQ ID NO: 7972 - DNA, 112 bp, Homo sapiens
cagacgaaaacmactttggtagtgccagtgtgactcatccacaatgatttctccagtgctcatcttgttctcgagttttctctgccatgttgctattgcaggacggacctgt

SEQ ID NO: 7973 - DNA, 201 bp, Homo sapiens
ctccagtgctcatcttgttctcgagttttctctgccatgttgctattgcaggacggacctgtcccaagccagatgatttaccattttccacagtggtcccrttaaaaacattctatgagccaggagaagagattacgtattcctgcaagccgggctatgtgtcccgaggagggatgagaaagtttatctgccctctcacag

SEQ ID NO: 7974 - DNA, 201 bp, Homo sapiens
aataaggaaaagaagtgtagctatacagaggatgctcagtgtatagatggcactatcgaagtccccaaatgcttcaaggaacacagttctctggctttttsgaaaactgatgcatccgatgtaaagccatgctaaggtggttttcagattccacataaaatgtcacacttgtttcttgttcatccaaggaacctaattgaa

SEQ ID NO: 7975 - DNA, 201 bp, Homo sapiens; identical to SEQ ID NO: 7964

SEQ ID NO: 7976 - DNA, 201 bp, Homo sapiens
aagcaatcctcctgcctcagcctccggagtagctgggattacagcagacgaaaaccactttggtagtgccagtgtgactcatccacaatgatttctccagygctcatcttgttctcgagttttctctgccatgttgctattgcaggacggacctgtcccaagccagatgatttaccattttccacagtggtcccgttaaaa

SEQ ID NO: 7977 - DNA, 201 bp, Homo sapiens
aagtggcatgatcttggttcactgcaaccactgcctcccaggttcaagcaatcctcctgcctcagcctccggagtagctgggattacagcagacgaaaacmactttggtagtgccagtgtgactcatccacaatgatttctccagtgctcatcttgttctcgagttttctctgccatgttgctattgcaggacggacctgt

SEQ ID NO: 7978 - DNA, 201 bp, Homo sapiens; identical to SEQ ID NO: 7973

SEQ ID NO: 7979 - DNA, 201 bp, Homo sapiens
ggagtgaagtggcatgatcttggttcactgcaaccactgcctcccaggttcaagcaatcctcctgcctcagcctccggagtagctgggattacagcagacraaaaccactttggtagtgccagtgtgactcatccacaatgatttctccagtgctcatcttgttctcgagttttctctgccatgttgctattgcaggacgg

SEQ ID NO: 7980 - DNA, 201 bp, Homo sapiens
cttttgaatatcccaacacgatcagtttttcttgtaacactgggttttatctgaatggcgctgattctgccaagtgcactgaggaaggaaaatggagcccrgagcttcctgtctgtgctcgtaagtctgtgggcaaggtgatcagctggtttgcccagaacctttctggttttagcactcaaagtctcacatctggaatct

SEQ ID NO: 7981 - DNA, 201 bp, Homo sapiens
ggaaggacgttcttatgttccccaacttgtgatttatacatctttgaccaggaggcccaggcatttcaatactaattatagttcttcaacatgtcagtgargtctgtctttagcaaaagcaagaggagggcaggtgcagtggttcacgcctgtaatgccagcactttgggagtccgaggagggtggctcacctgaggtcag

SEQ ID NO: 7982 - DNA, 201 bp, Homo sapiens; identical to SEQ ID NO: 7964

SEQ ID NO: 7983 - DNA, 201 bp, Homo sapiens; identical to SEQ ID NO: 7965

SEQ ID NO: 7984 - DNA, 201 bp, Homo sapiens; identical to SEQ ID NO: 7976

SEQ ID NO: 7985 - DNA, 185 bp, Homo sapiens; identical to SEQ ID NO: 7967

SEQ ID NO: 7986 - DNA, 201 bp, Homo sapiens; identical to SEQ ID NO: 7979

SEQ ID NO: 7987 - DNA, 201 bp, Homo sapiens; identical to SEQ ID NO: 7969

SEQ ID NO: 7988 - DNA, 201 bp, Homo sapiens; identical to SEQ ID NO: 7970

SEQ ID NO: 7989 - DNA, 201 bp, Homo sapiens; identical to SEQ ID NO: 7971

SEQ ID NO: 7990 - DNA, 201 bp, Homo sapiens; identical to SEQ ID NO: 7977

SEQ ID NO: 7991 - DNA, 201 bp, Homo sapiens; identical to SEQ ID NO: 7973

SEQ ID NO: 7992 - DNA, 201 bp, Homo sapiens; identical to SEQ ID NO: 7974

SEQ ID NO: 7993 - DNA, 201 bp, Homo sapiens
ggttggcgtgggagccagcctagggcttcgggtcgcggcagcgctgaccgccatggacaagcccctgggtcgctgcgtgggccacgccctggaggtggagraggcgctgctctgcatggacggcgcaggcccgccagacttaagggacctggtcaccacgctcgggggcgccctgctctggctcagcggacacgcggggac

SEQ ID NO: 7994 - DNA, 201 bp, Homo sapiens
gcttcgaacccggctgctgatcacaggcctgttcggggctggactcggtggggcctggctggccctgagggctgagaaggagaggctgcagcagcaaaagygaacagaagccctgcgccaggcagctgtgggccagggcgacttccacctgctggatcacagaggccgggctcgctgcaaggctgacttccggggccagtg

SEQ ID NO: 7995 - DNA, 201 bp, Homo sapiens
tggccctgagggctgagaaggagaggctgcagcagcaaaagcgaacagaagccctgcgccaggcagctgtgggccagggcgacttccacctgctggatcayagaggccgggctcgctgcaaggctgacttccggggccagtgggtgctgatgtactttggcttcactcactgccctgacatctgcccagacgagctggaga

SEQ ID NO: 7996 - DNA, 201 bp, Homo sapiens
cccagacgagctggagaagctggtgcaggtggtgcggcagctggaagcagagcctggtttgcctccagtgcagcctgtcttcatcactgtggaccccgagygggacgacgttgaagccatggcccgctacgtccaggacttccacccaagactgttgggtctgaccggctccaccaaacaggttgcccaggctagtcacag

SEQ ID NO: 7997 - DNA, 201 bp, Homo sapiens
gggtgtgggtgacaaggtcagcctggtcctcgcacctgccctggcggcatgtggctgcaaggtgccaatgatcagcggacgtggtctggggcacacaggargcaccttggataagctggagtctattcctggattcaatgtcatccagagcccagagcagatgcaagtgctgctggaccaggcgggctgctgtatcgtggg

SEQ ID NO: 7998 - DNA, 201 bp, Homo sapiens
gcttgtggacaagcattccacagggggtgtgggtgacaaggtcagcctggtcctcgcacctgccctggcggcatgtggctgcaaggtgccaatgatcagcrgacgtggtctggggcacacaggaggcaccttggataagctggagtctattcctggattcaatgtcatccagagcccagagcagatgcaagtgctgctgga

SEQ ID NO: 7999 - DNA, 201 bp, Homo sapiens
gtgccaatgatcagcggacgtggtctggggcacacaggaggcaccttggataagctggagtctattcctggattcaatgtcatccagagcccagagcagakgcaagtgctgctggaccaggcgggctgctgtatcgtgggtcagagtgagcagctggttcctgcggacggaatcctatatgcagccagagatgtgacagcc

SEQ ID NO: 8000 - DNA, 201 bp, Homo sapiens
gagcagctggttcctgcggacggaatcctatatgcagccagagatgtgacagccaccgtggacagcctgccactcatcacagcctccattctcagtaagaractcgtggaggggctgtccgctctggtggtggacgttaagttcggaggggccgccgtcttccccaaccaggagcaggcccgggagctggcaaagacgctg

SEQ ID NO: 8001 - DNA, 201 bp, Homo sapiens
aagggagccagggacttcccgacccttcgccagagcccaagcagctcccggagctgatccgcatgaagcgagacggaggccgcctgagcgaagcggacatsaggggcttcgtggccgctgtggtgaatgggagcgcgcagggcgcacagatcggggccatgctgatggccatccgacttcggggcatggatctggaggaga

SEQ ID NO: 8002 - DNA, 201 bp, Homo sapiens
gcgccgtgggaccccctggctccgcgtgcaccgggacggccccgcgctcagcggcccgcagagccgcgccctgcaggaggcgctcgtactctccgaccgcrcgccattcgccgccccctcgcccttcgcagagctcgttctgccgccgcagcaataaagctcctttgccgcgaaaccttgtcagtgcttgggcgggagcgg

SEQ ID NO: 8003 - DNA, 201 bp, Homo sapiens
ggaccccctggctccgcgtgcaccgggacggccccgcgctcagcggcccgcagagccgcgccctgcaggaggcgctcgtactctccgaccgcgcgccattygccgccccctcgcccttcgcagagctcgttctgccgccgcagcaataaagctcctttgccgcgaaaccttgtcagtgcttgggcgggagcggaaggatcc

SEQ ID NO: 8004 - DNA, 201 bp, Homo sapiens
ctccgcgtgcaccgggacggccccgcgctcagcggcccgcagagccgcgccctgcaggaggcgctcgtactctccgaccgcgcgccattcgccgccccctygcccttcgcagagctcgttctgccgccgcagcaataaagctcctttgccgcgaaaccttgtcagtgcttgggcgggagcggaaggatccagggctgcgga

SEQ ID NO: 8005 - DNA, 201 bp, Homo sapiens
tgccgctggcgctggtgctgcacgagctcggggccgggcgcagccgcgctggggagccgctccgcctgggggtgggcgcagagctgctggtcgacgtgggwcagaggctgcgccgtgggaccccctggctccgcgtgcaccgggacggccccgcgctcagcggcccgcagagccgcgccctgcaggaggcgctcgtactct

SEQ ID NO: 8006 - DNA, 201 bp, Homo sapiens
cggaaggatccagggctgcggaggcgggggccgtctcgatgaacacgtgacccccggcgggctccgccttccgcgcacgcgctgagagcctgtcagcagcscagggagctggaggtcggcgcttcctctcgtgcttggtccactgacgcgcggccccgccgcgaggagcatcagatccatgctgctgctgactcggagccc

SEQ ID NO: 8007 - DNA, 201 bp, Homo sapiens
gttggcgtgggagccagcctagggcttcgggtcgcggcagcgctgaccgccatggacaagcccctgggtcgctgcgtgggccacgccctggaggtggaggmggcgctgctctgcatggacggcgcaggcccgccagacttaagggacctggtcaccacgctcgggggcgccctgctctggctcagcggacacgcggggact

SEQ ID NO: 8008 - DNA, 201 bp, Homo sapiens
ggtccactgacgcgcggccccgccgcgaggagcatcagatccatgctgctgctgactcggagccccacagcttggcacaggctctctcagctcaagcctcsggtcctccctgggaccctgggaggccaggccctgcatctgaggtcctggcttttgtcaaggcagggccctgcagagacaggtgggcagggccagccccag

SEQ ID NO: 8009 - DNA, 201 bp, Homo sapiens
cccgctacgtccaggacttccacccaagactgttgggtctgaccggctccaccaaacaggttgcccaggctagtcacagttaccgcgtgtactacaatgcmggccccaaggatgaggaccaggactacatcgtggaccactccattgccatctacctgctcaaccctgacggcctcttcacggattactacggccggagca

SEQ ID NO: 8010 - DNA, 201 bp, Homo sapiens
agctcccggagctgatccgcatgaagcgagacggaggccgcctgagcgaagcggacatcaggggcttcgtggccgctgtggtgaatgggagcgcgcagggygcacagatcggggccatgctgatggccatccgacttcggggcatggatctggaggagacctcggtgctgacccaggccctggctcagtcgggacagcagc

SEQ ID NO: 8011 - DNA, 201 bp, Homo sapiens
tcgggtcctccctgggaccctgggaggccaggccctgcatctgaggtcctggcttttgtcaaggcagggccctgcagagacaggtgggcagggccagcccyagggccctgggcttcgaacccggctgctgatcacaggcctgttcggggctggactcggtggggcctggctggccctgagggctgagaaggagaggctgca

SEQ ID NO: 8012 - DNA, 201 bp, Homo sapiens
tgctctgcatggacggcgcaggcccgccagacttaagggacctggtcaccacgctcgggggcgccctgctctggctcagcggacacgcggggactcaggcycagggcgctgcccgggtggccgcggcgctggacgacggctcggcccttggccgcttcgagcggatgctggcggcgcagggcgtggatcccggtctggccc

SEQ ID NO: 8013 - DNA, 201 bp, Homo sapiens
agcctgtcttcatcactgtggaccccgagcgggacgacgttgaagccatggcccgctacgtccaggacttccacccaagactgttgggtctgaccggctcyaccaaacaggttgcccaggctagtcacagttaccgcgtgtactacaatgcaggccccaaggatgaggaccaggactacatcgtggaccactccattgcca

SEQ ID NO: 8014 - DNA, 201 bp, Homo sapiens
gctggatcacagaggccgggctcgctgcaaggctgacttccggggccagtgggtgctgatgtactttggcttcactcactgccctgacatctgcccagacragctggagaagctggtgcaggtggtgcggcagctggaagcagagcctggtttgcctccagtgcagcctgtcttcatcactgtggaccccgagcgggacga

SEQ ID NO: 8015 - DNA, 201 bp, Homo sapiens
gccattcgccgccccctcgcccttcgcagagctcgttctgccgccgcagcaataaagctcctttgccgcgaaaccttgtcagtgcttgggcgggagcggarggatccagggctgcggaggcgggggccgtctcgatgaacacgtgacccccggcgggctccgccttccgcgcacgcgctgagagcctgtcagcagcgcagg

SEQ ID NO: 8016 - DNA, 201 bp, Homo sapiens
accggctccaccaaacaggttgcccaggctagtcacagttaccgcgtgtactacaatgcaggccccaaggatgaggaccaggactacatcgtggaccactycattgccatctacctgctcaaccctgacggcctcttcacggattactacggccggagcagatcggctgagcagatctcagacagtgtgcggcggcacatg

SEQ ID NO: 8017 - DNA, 201 bp, Homo sapiens; identical to SEQ ID NO: 7993

SEQ ID NO: 8018 - DNA, 201 bp, Homo sapiens; identical to SEQ ID NO: 7994

SEQ ID NO: 8019 - DNA, 201 bp, Homo sapiens; identical to SEQ ID NO: 7995

SEQ ID NO: 8020 - DNA, 201 bp, Homo sapiens; identical to SEQ ID NO: 7996

SEQ ID NO: 8021 - DNA, 201 bp, Homo sapiens; identical to SEQ ID NO: 7997

SEQ ID NO: 8022 - DNA, 201 bp, Homo sapiens; identical to SEQ ID NO: 7998

SEQ ID NO: 8023 - DNA, 201 bp, Homo sapiens; identical to SEQ ID NO: 7999

SEQ ID NO: 8024 - DNA, 201 bp, Homo sapiens; identical to SEQ ID NO: 8000

SEQ ID NO: 8025 - DNA, 201 bp, Homo sapiens
aacactcggaagccagggcccgcggcctacaacgtggatcaggtggcctggagcccagggtcaagggtcagagtcaggagagtggggagggcctgaggtcsgagtgatgggatcagagtccccgggggtccaggggtcccggcgcggagaggatgccggccccgcgaggtcagcggtgtctccgggcccgcagcaccggaa

SEQ ID NO: 8026 - DNA, 201 bp, Homo sapiens; identical to SEQ ID NO: 8001

SEQ ID NO: 8027 - DNA, 201 bp, Homo sapiens; identical to SEQ ID NO: 8002

SEQ ID NO: 8028 - DNA, 201 bp, Homo sapiens
aaccccgaaccccacggggctttgataaatcgtggctcagactccccactagtcccaggaccccatctcgggtacccaccaggctcccacgcagttctagscccccacacccttgatccgccccgcaggcaggtacttcccggagcgagcggggaacgcgacgtaccccagtgcgcctcggcacaccattgctccccgaaa

SEQ ID NO: 8029 - DNA, 201 bp, Homo sapiens; identical to SEQ ID NO: 8003

SEQ ID NO: 8030 - DNA, 201 bp, Homo sapiens; identical to SEQ ID NO: 8006

SEQ ID NO: 8031 - DNA, 201 bp, Homo sapiens; identical to SEQ ID NO: 8004

SEQ ID NO: 8032 - DNA, 201 bp, Homo sapiens; identical to SEQ ID NO: 8005

SEQ ID NO: 8033 - DNA, 201 bp, Homo sapiens; identical to SEQ ID NO: 8008

SEQ ID NO: 8034 - DNA, 201 bp, Homo sapiens; identical to SEQ ID NO: 8007

SEQ ID NO: 8035 - DNA, 201 bp, Homo sapiens
ccagggtcaagggtcagagtcaggagagtggggagggcctgaggtcggagtgatgggatcagagtccccgggggtccaggggtcccggcgcggagaggatsccggccccgcgaggtcagcggtgtctccgggcccgcagcaccggaagccccgcggctggagtttcgggatccggcactcggactacctggccccgctggt

SEQ ID NO: 8036 - DNA, 201 bp, Homo sapiens; identical to SEQ ID NO: 8009

SEQ ID NO: 8037 - DNA, 201 bp, Homo sapiens
gtgtcacatctttttttcaatttgtgtgattattttgtggcccaatacatgattttttttgcgaatatttcatggacttaaatagataagtcctctctctrcacataattaaatggagtgtgtgctttgcattattcagttcctttattcccatccttgcttttgtctgcagatttgtcctattccagaatgggtatactg

SEQ ID NO: 8038 - DNA, 201 bp, Homo sapiens
ggccagcgttctgggtggcccaggctactatcccacccgtgccacagaatccacacagaggcccagcggcggcactgggtggtggggaagggggaggcggrcccaggttgggggggcaggcagtcagtgcggttgccaggaagcgggaaagggccacaatggggtctgggaggtgggcggggcggagcggggatgtccagc

SEQ ID NO: 8039 - DNA, 201 bp, Homo sapiens; identical to SEQ ID NO: 8010

SEQ ID NO: 8040 - DNA, 201 bp, Homo sapiens; identical to SEQ ID NO: 8012

SEQ ID NO: 8041 - DNA, 201 bp, Homo sapiens; identical to SEQ ID NO: 8013

SEQ ID NO: 8042 - DNA, 201 bp, Homo sapiens; identical to SEQ ID NO: 8011

SEQ ID NO: 8043 - DNA, 201 bp, Homo sapiens; identical to SEQ ID NO: 8015

SEQ ID NO: 8044 - DNA, 201 bp, Homo sapiens; identical to SEQ ID NO: 8014

SEQ ID NO: 8045 - DNA, 201 bp, Homo sapiens; identical to SEQ ID NO: 8016

SEQ ID NO: 8046 - DNA, 201 bp, Homo sapiens
gaggagctgctgggaagcctggatgtgaggagggtggggttttgtggcgggtggaagtgtcgtgcgtctctgccaggagaggttaaacacagccggcgggsagagtctgagctccgggggttttctgctgggagtgtggaggaaggccgcggttggttgaagtggctggaggtaacaggaaagtgttggaggaatcggttg

SEQ ID NO: 8047 - DNA, 201 bp, Homo sapiens
gcggttggttgaagtggctggaggtaacaggaaagtgttggaggaatcggttgctctcggggattgcaagccagagagttacccacctccttttaagaaaygggtttattgcaaatagataacgtggttagttcaggcaaggcatgcacttggaatgctttccgtcagcaagaggttcaccttgctgaggtgcaggtgcag

SEQ ID NO: 8048 - DNA, 201 bp, Homo sapiens; identical to SEQ ID NO: 7993

SEQ ID NO: 8049 - DNA, 201 bp, Homo sapiens; identical to SEQ ID NO: 7994

SEQ ID NO: 8050 - DNA, 201 bp, Homo sapiens; identical to SEQ ID NO: 7995

SEQ ID NO: 8051 - DNA, 201 bp, Homo sapiens; identical to SEQ ID NO: 7996

SEQ ID NO: 8052 - DNA, 201 bp, Homo sapiens; identical to SEQ ID NO: 7997

SEQ ID NO: 8053 - DNA, 201 bp, Homo sapiens; identical to SEQ ID NO: 7998

SEQ ID NO: 8054 - DNA, 201 bp, Homo sapiens; identical to SEQ ID NO: 7999

SEQ ID NO: 8055 - DNA, 201 bp, Homo sapiens; identical to SEQ ID NO: 8000

SEQ ID NO: 8056 - DNA, 201 bp, Homo sapiens; identical to SEQ ID NO: 8025

SEQ ID NO: 8057 - DNA, 201 bp, Homo sapiens; identical to SEQ ID NO: 8001

SEQ ID NO: 8058 - DNA, 201 bp, Homo sapiens; identical to SEQ ID NO: 8002

SEQ ID NO: 8059 - DNA, 201 bp, Homo sapiens; identical to SEQ ID NO: 8028

SEQ ID NO: 8060 - DNA, 201 bp, Homo sapiens; identical to SEQ ID NO: 8003

SEQ ID NO: 8061 - DNA, 201 bp, Homo sapiens
tcagcggctgcgcccgtgtgcgcatgcgcagctccggggacgcctgcgccctgcctgtgagcgtgtggcgcccgctttccctgagccggcggggcagagcscagggagctggaggtcggcgcttcctctcgtgcttggtccactgacgcgcggccccgccgcgaggtgcggacgccggggctgggaggggaggaggtagcc

SEQ ID NO: 8062 - DNA, 201 bp, Homo sapiens; identical to SEQ ID NO: 8004

SEQ ID NO: 8063 - DNA, 201 bp, Homo sapiens; identical to SEQ ID NO: 8005

SEQ ID NO: 8064 - DNA, 201 bp, Homo sapiens
tggctcctgacgcctgtgcttgtttccaggagcatcagatccatgctgctgctgactcggagccccacagcttggcacaggctctctcagctcaagcctcsggtcctccctgggaccctgggaggccaggccctgcatctgaggtcctggcttttgtcaaggcagggccctgcagagacaggtgggcagggccagccccag

SEQ ID NO: 8065 - DNA, 201 bp, Homo sapiens; identical to SEQ ID NO: 8035

SEQ ID NO: 8066 - DNA, 201 bp, Homo sapiens; identical to SEQ ID NO: 8007

SEQ ID NO: 8067 - DNA, 201 bp, Homo sapiens; identical to SEQ ID NO: 8009

SEQ ID NO: 8068 - DNA, 201 bp, Homo sapiens; identical to SEQ ID NO: 8037

SEQ ID NO: 8069 - DNA, 201 bp, Homo sapiens; identical to SEQ ID NO: 8038

SEQ ID NO: 8070 - DNA, 201 bp, Homo sapiens; identical to SEQ ID NO: 8010

SEQ ID NO: 8071 - DNA, 201 bp, Homo sapiens; identical to SEQ ID NO: 8011

SEQ ID NO: 8072 - DNA, 201 bp, Homo sapiens; identical to SEQ ID NO: 8013

SEQ ID NO: 8073 - DNA, 201 bp, Homo sapiens; identical to SEQ ID NO: 8012

SEQ ID NO: 8074 - DNA, 201 bp, Homo sapiens; identical to SEQ ID NO: 8014

SEQ ID NO: 8075 - DNA, 201 bp, Homo sapiens
gccattcgccgccccctcgcccttcgcagagctcgttctgccgccgcagcaataaagctcctttgccgcgaaaccttgtcagtgcttgggcgggagcggarggatccagggctgcggaggcgggggccgtctcgatgaacacgtgacccccggcgggctccgccttccgcgcacgcgctgagagcctgtcagcggctgcgc

SEQ ID NO: 8076 - DNA, 201 bp, Homo sapiens; identical to SEQ ID NO: 8016

SEQ ID NO: 8077 - DNA, 201 bp, Homo sapiens
ggggagggcacaaacccagaaccgcccgggcgggggtgcagtgagtcctcgggagggtgccctcagcaggagggggcagtgaccgggagtcctgagacctscacctagcaaaccttctgcgggggcccgtgggaaaggctcaaaggtcaccaacgcaaaggcagggcgtcggctgtgagcccggaggagctgctgggaagc

SEQ ID NO: 8078 - DNA, 201 bp, Homo sapiens; identical to SEQ ID NO: 7993

SEQ ID NO: 8079 - DNA, 201 bp, Homo sapiens; identical to SEQ ID NO: 7994

SEQ ID NO: 8080 - DNA, 201 bp, Homo sapiens; identical to SEQ ID NO: 7995

SEQ ID NO: 8081 - DNA, 201 bp, Homo sapiens; identical to SEQ ID NO: 7996

SEQ ID NO: 8082 - DNA, 201 bp, Homo sapiens; identical to SEQ ID NO: 7997

SEQ ID NO: 8083 - DNA, 201 bp, Homo sapiens; identical to SEQ ID NO: 7998

SEQ ID NO: 8084 - DNA, 201 bp, Homo sapiens; identical to SEQ ID NO: 7999

SEQ ID NO: 8085 - DNA, 201 bp, Homo sapiens; identical to SEQ ID NO: 8000

SEQ ID NO: 8086 - DNA, 201 bp, Homo sapiens; identical to SEQ ID NO: 8001

SEQ ID NO: 8087 - DNA, 201 bp, Homo sapiens; identical to SEQ ID NO: 8002

SEQ ID NO: 8088 - DNA, 201 bp, Homo sapiens; identical to SEQ ID NO: 8003

SEQ ID NO: 8089 - DNA, 201 bp, Homo sapiens; identical to SEQ ID NO: 8004

SEQ ID NO: 8090 - DNA, 201 bp, Homo sapiens; identical to SEQ ID NO: 8005

SEQ ID NO: 8091 - DNA, 201 bp, Homo sapiens; identical to SEQ ID NO: 8006

SEQ ID NO: 8092 - DNA, 201 bp, Homo sapiens; identical to SEQ ID NO: 8007

SEQ ID NO: 8093 - DNA, 201 bp, Homo sapiens; identical to SEQ ID NO: 8008

SEQ ID NO: 8094 - DNA, 201 bp, Homo sapiens; identical to SEQ ID NO: 8037

SEQ ID NO: 8095 - DNA, 201 bp, Homo sapiens; identical to SEQ ID NO: 8009

SEQ ID NO: 8096 - DNA, 201 bp, Homo sapiens; identical to SEQ ID NO: 8038

SEQ ID NO: 8097 - DNA, 201 bp, Homo sapiens; identical to SEQ ID NO: 8010

SEQ ID NO: 8098 - DNA, 201 bp, Homo sapiens; identical to SEQ ID NO: 8013

SEQ ID NO: 8099 - DNA, 201 bp, Homo sapiens; identical to SEQ ID NO: 8012

SEQ ID NO: 8100 - DNA, 201 bp, Homo sapiens; identical to SEQ ID NO: 8011

SEQ ID NO: 8101 - DNA, 201 bp, Homo sapiens; identical to SEQ ID NO: 8015

SEQ ID NO: 8102 - DNA, 201 bp, Homo sapiens; identical to SEQ ID NO: 8014

SEQ ID NO: 8103 - DNA, 201 bp, Homo sapiens; identical to SEQ ID NO: 8016

SEQ ID NO: 8104 - DNA, 119 bp, Homo sapiens
gaggagctgctgggaagcctggatgtgaggagggtggggttttgtggcgggtggaagtgtcgtgcgtctctgccaggagaggttaaacacagccggcgggsagagtctgagctccgggg

SEQ ID NO: 8105 - DNA, 201 bp, Homo sapiens; identical to SEQ ID NO: 7993

SEQ ID NO: 8106 - DNA, 201 bp, Homo sapiens; identical to SEQ ID NO: 7997

SEQ ID NO: 8107 - DNA, 201 bp, Homo sapiens; identical to SEQ ID NO: 7998

SEQ ID NO: 8108 - DNA, 201 bp, Homo sapiens; identical to SEQ ID NO: 7999

SEQ ID NO: 8109 - DNA, 201 bp, Homo sapiens; identical to SEQ ID NO: 8000

SEQ ID NO: 8110 - DNA, 201 bp, Homo sapiens; identical to SEQ ID NO: 8001

SEQ ID NO: 8111 - DNA, 201 bp, Homo sapiens; identical to SEQ ID NO: 8002

SEQ ID NO: 8112 - DNA, 201 bp, Homo sapiens; identical to SEQ ID NO: 8003

SEQ ID NO: 8113 - DNA, 201 bp, Homo sapiens; identical to SEQ ID NO: 8004

SEQ ID NO: 8114 - DNA, 201 bp, Homo sapiens; identical to SEQ ID NO: 8005

SEQ ID NO: 8115 - DNA, 201 bp, Homo sapiens; identical to SEQ ID NO: 8061

SEQ ID NO: 8116 - DNA, 201 bp, Homo sapiens; identical to SEQ ID NO: 8007

SEQ ID NO: 8117 - DNA, 201 bp, Homo sapiens; identical to SEQ ID NO: 8010

SEQ ID NO: 8118 - DNA, 201 bp, Homo sapiens; identical to SEQ ID NO: 8012

SEQ ID NO: 8119 - DNA, 201 bp, Homo sapiens; identical to SEQ ID NO: 8075

SEQ ID NO: 8120 - DNA, 201 bp, Homo sapiens; identical to SEQ ID NO: 8077

SEQ ID NO: 8121 - DNA, 201 bp, Homo sapiens
acagaggacatcctggcaaaatccaaaaagggaattgaggaaagccttaggaaagtggcaaagaagaagtttgcagaaaaccctaaggccggcgatgaatktgtggagaagaccctgagcaccatagcgaccagcacggatgcagcctccgttgtccacagcacagacttggtggtggaagccatcgtggagaatctgaag

SEQ ID NO: 8122 - DNA, 201 bp, Homo sapiens
ttctccggctctgagaagaacacctgagagcgctttccagccagtgccccgagtgcctgtgggaatgctctttggtcagacattccctcacacagtacagwttaataaatgtgcattttgattgtaatctatcgaagtgattattacaccagttacagcagtaatagattctccattaagaaataattcccttttttagtc

SEQ ID NO: 8123 - DNA, 155 bp, Homo sapiens
cgtgtatacccgctcaacgctgggacgttacagccagggccaatgggcagagcgsgactcgaggccccgcccccgccttgtggcgtcacggggacgccgggggcgcgcgggctgcagggccgcgtaggtccccgcccccagagtctggctttccg

SEQ ID NO: 8124 - DNA, 127 bp, Homo sapiens
cgtgtatacccgctcaacgctgggacrttacagccagggccaatgggcagagcgggactcgaggccccgcccccgccttgtggcgtcacggggacgccgggggcgcgcgggctgcagggccgcgtag

SEQ ID NO: 8125 - DNA, 201 bp, Homo sapiens
agagcgggactcgaggccccgcccccgccttgtggcgtcacggggacgccgggggcgcgcgggctgcagggccgcgtaggtccccgcccccagagtctggytttccgcggctgcccgcctcgcgcgtcttccctgcccgggtctcctcgctgtcgccgccgctgccacaccatggccttcgtcaccaggcagttcatgcgt

SEQ ID NO: 8126 - DNA, 201 bp, Homo sapiens
gtagtgttggtagaccagacagaggacatcctggcaaaatccaaaaagggaattgaggaaagccttaggaaagtggcaaagaagaagtttgcagaaaaccytaaggccggcgatgaatttgtggagaagaccctgagcaccatagcgaccagcacggatgcagcctccgttgtccacagcacagacttggtggtggaagcc

SEQ ID NO: 8127 - DNA, 201 bp, Homo sapiens
cttctagattatgtcggactggatactacgaagttcatcgtggatgggtggcatgaaatggatgcagagaacccattacatcagcccagcccatccttaartaagctggtagcagagaacaagttcggcaagaagactggagaaggattttacaaatacaagtgatgtgcagcttctccggctctgagaagaacacctgag

SEQ ID NO: 8128 - DNA, 201 bp, Homo sapiens
ggcgtcacggggacgccgggggcgcgcgggctgcagggccgcgtaggtccccgcccccagagtctggctttccgcggctgcccgcctcgcgcgtcttcccygcccgggtctcctcgctgtcgccgccgctgccacaccatggccttcgtcaccaggcagttcatgcgttccgtgtcctcctcgtccaccgcctcggcctcg

SEQ ID NO: 8129 - DNA, 201 bp, Homo sapiens
ggtgattctaactcgggtttgggcttttctttaaaaggtgacgcatccaaagaagacattgacactgctatgaaattaggagccggttaccccatgggccyatttgagcttctagattatgtcggactggatactacgaagttcatcgtggatgggtggcatgaaatggatgcagagaacccattacatcagcccagccca

SEQ ID NO: 8130 - DNA, 201 bp, Homo sapiens
tagtctgttcatttctgtgtattttctaaacagctttacacccttggtgccttggagcaaacatgttttttgaaccttgtcatttttgtgaagaattgccwagattccttctctcatcaacgggaaagtacttcctctgagagtgcgagtgcaccatgctcactgttgctgcgtgggagagtcacaagccactggcaagca

SEQ ID NO: 8131 - DNA, 201 bp, Homo sapiens
ggactcgaggccccgcccccgccttgtggcgtcacggggacgccgggggcgcgcgggctgcagggccgcgtaggtccccgcccccagagtctggctttccrcggctgcccgcctcgcgcgtcttccctgcccgggtctcctcgctgtcgccgccgctgccacaccatggccttcgtcaccaggcagttcatgcgttccgtg

SEQ ID NO: 8132 - DNA, 201 bp, Homo sapiens
cggcaagaagactggagaaggattttacaaatacaagtgatgtgcagcttctccggctctgagaagaacacctgagagcgctttccagccagtgccccgartgcctgtgggaatgctctttggtcagacattccctcacacagtacagtttaataaatgtgcattttgattgtaatctatcgaagtgattattacaccagt

SEQ ID NO: 8133 - DNA, 201 bp, Homo sapiens
ccatcgtggagaatctgaaggtgaaaaacgagctcttcaaaaggctggacaagtttgctgctgaacatacaatctttgccagcaacacttcctccttgcakattacaagcatagctaatgccaccaccagacaagaccgattcgctggcctccatttcttcaacccagtgcctgtcatgaaacttgtggaggtcattaaaa

SEQ ID NO: 8134 - DNA, 201 bp, Homo sapiens; identical to SEQ ID NO: 8121

SEQ ID NO: 8135 - DNA, 201 bp, Homo sapiens; identical to SEQ ID NO: 8122

SEQ ID NO: 8136 - DNA, 155 bp, Homo sapiens; identical to SEQ ID NO: 8123

SEQ ID NO: 8137 - DNA, 127 bp, Homo sapiens; identical to SEQ ID NO: 8124

SEQ ID NO: 8138 - DNA, 201 bp, Homo sapiens; identical to SEQ ID NO: 8125

SEQ ID NO: 8139 - DNA, 201 bp, Homo sapiens; identical to SEQ ID NO: 8126

SEQ ID NO: 8140 - DNA, 201 bp, Homo sapiens; identical to SEQ ID NO: 8127

SEQ ID NO: 8141 - DNA, 201 bp, Homo sapiens; identical to SEQ ID NO: 8128

SEQ ID NO: 8142 - DNA, 201 bp, Homo sapiens
ccatacctcatggaagcaatcaggctgtatgaacgaggtgacgcatccaaagaagacattgacactgctatgaaattaggagccggttaccccatgggccyatttgagcttctagattatgtcggactggatactacgaagttcatcgtggatgggtggcatgaaatggatgcagagaacccattacatcagcccagccca

SEQ ID NO: 8143 - DNA, 201 bp, Homo sapiens; identical to SEQ ID NO: 8130

SEQ ID NO: 8144 - DNA, 201 bp, Homo sapiens; identical to SEQ ID NO: 8131

SEQ ID NO: 8145 - DNA, 201 bp, Homo sapiens; identical to SEQ ID NO: 8132

SEQ ID NO: 8146 - DNA, 201 bp, Homo sapiens; identical to SEQ ID NO: 8133

SEQ ID NO: 8147 - DNA, 201 bp, Homo sapiens; identical to SEQ ID NO: 8127

SEQ ID NO: 8148 - DNA, 201 bp, Homo sapiens; identical to SEQ ID NO: 8122

SEQ ID NO: 8149 - DNA, 201 bp, Homo sapiens
cagattgatatcctggatctctgcttttgattaaaaggtgacgcatccaaagaagacattgacactgctatgaaattaggagccggttaccccatgggccyatttgagcttctagattatgtcggactggatactacgaagttcatcgtggatgggtggcatgaaatggatgcagagaacccattacatcagcccagccca

SEQ ID NO: 8150 - DNA, 201 bp, Homo sapiens; identical to SEQ ID NO: 8130

SEQ ID NO: 8151 - DNA, 201 bp, Homo sapiens; identical to SEQ ID NO: 8132

SEQ ID NO: 8152 - DNA, 192 bp, Homo sapiens
atccacccacctcggtctcccaaagtgctgggattacaggcgtgagccaccacagacatacaatctttgccagcaacacttcctccttgcakattacaagcatagctaatgccaccaccagacaagaccgattcgctggcctccatttcttcaacccagtgcctgtcatgaaacttgtggaggtcattaaaa

SEQ ID NO: 8153 - DNA, 201 bp, Homo sapiens; identical to SEQ ID NO: 8130

SEQ ID NO: 8154 - DNA, 201 bp, Homo sapiens; identical to SEQ ID NO: 8126

SEQ ID NO: 8155 - DNA, 201 bp, Homo sapiens; identical to SEQ ID NO: 8142

SEQ ID NO: 8156 - DNA, 201 bp, Homo sapiens; identical to SEQ ID NO: 8133

SEQ ID NO: 8157 - DNA, 201 bp, Homo sapiens; identical to SEQ ID NO: 8122

SEQ ID NO: 8158 - DNA, 201 bp, Homo sapiens; identical to SEQ ID NO: 8132

SEQ ID NO: 8159 - DNA, 201 bp, Homo sapiens; identical to SEQ ID NO: 8127

SEQ ID NO: 8160 - DNA, 201 bp, Homo sapiens; identical to SEQ ID NO: 8121

SEQ ID NO: 8161 - DNA, 201 bp, Homo sapiens
gctcggtgacagatttctatccagcccagatcaaagtccggtggtttcggaatgaccaggaggagacagctggcgttgtgtccaccccccttattaggaayggtgactggaccttccagatcctggtgatgctggaaatgactccccagcgtggagacgtctacacctgccacgtggagcaccccagcctccagagcccca

SEQ ID NO: 8162 - DNA, 201 bp, Homo sapiens
aaaagacactgaaagaatttggggtgcaaagtcatggtgggcagaggaggtagaaaatcaactcagttgtcgcatcattcatggttctttcatattgatgytcagtgcagtggcctgagaatatcccagcctctcttctggtttggtgagtgctatataagtaaacatggtggaattgtttgggggcagatatagtgaccc

SEQ ID NO: 8163 - DNA, 201 bp, Homo sapiens
acctgtgcccagaaggagggttgtaccttgaaaagacactgaaagaatttggggtgcaaagtcatggtgggcagaggaggtagaaaatcaactcagttgtygcatcattcatggttctttcatattgatgttcagtgcagtggcctgagaatatcccagcctctcttctggtttggtgagtgctatataagtaaacatggt

SEQ ID NO: 8164 - DNA, 201 bp, Homo sapiens
ccctgagatcagagtcctacagtggctgtcacgcagccaccaggtcatctcctttcatccccaccttgaggcggatggctgtgaccctacttcctgcactkacccacagcctctgcctgtgcacggccagctgcatctactcaggccccaaggggtttctgtttctattctctcctcagactgctcaagagaagcacatga

SEQ ID NO: 8165 - DNA, 201 bp, Homo sapiens
gaggtgacccagccaacctgtgcccagaaggagggttgtaccttgaaaagacactgaaagaatttggggtgcaaagtcatggtgggcagaggaggtagaaratcaactcagttgtcgcatcattcatggttctttcatattgatgttcagtgcagtggcctgagaatatcccagcctctcttctggtttggtgagtgctat

SEQ ID NO: 8166 - DNA, 201 bp, Homo sapiens
acagcctctgcctgtgcacggccagctgcatctactcaggccccaaggggtttctgtttctattctctcctcagactgctcaagagaagcacatgaaaacyattacctgactttagagcttttttacataattaaacatgatcctgagttatctgtattctgaacttccttaattgagcagaggcaggaaatcactgcaga

SEQ ID NO: 8167 - DNA, 201 bp, Homo sapiens
cggatggctgtgaccctacttcctgcactgacccacagcctctgcctgtgcacggccagctgcatctactcaggccccaaggggtttctgtttctattctytcctcagactgctcaagagaagcacatgaaaaccattacctgactttagagcttttttacataattaaacatgatcctgagttatctgtattctgaactt

SEQ ID NO: 8168 - DNA, 201 bp, Homo sapiens
tgaggcggatggctgtgaccctacttcctgcactgacccacagcctctgcctgtgcacggccagctgcatctactcaggccccaaggggtttctgtttctrttctctcctcagactgctcaagagaagcacatgaaaaccattacctgactttagagcttttttacataattaaacatgatcctgagttatctgtattctg

SEQ ID NO: 8169 - DNA, 201 bp, Homo sapiens
gctgtcacgcagccaccaggtcatctcctttcatccccaccttgaggcggatggctgtgaccctacttcctgcactgacccacagcctctgcctgtgcacrgccagctgcatctactcaggccccaaggggtttctgtttctattctctcctcagactgctcaagagaagcacatgaaaaccattacctgactttagagct

SEQ ID NO: 8170 - DNA, 201 bp, Homo sapiens
gagtcctacagtggctgtcacgcagccaccaggtcatctcctttcatccccaccttgaggcggatggctgtgaccctacttcctgcactgacccacagccyctgcctgtgcacggccagctgcatctactcaggccccaaggggtttctgtttctattctctcctcagactgctcaagagaagcacatgaaaaccattacc

SEQ ID NO: 8171 - DNA, 201 bp, Homo sapiens
tcctgcactgactcctgagactattttaactgggattggttatcacttttctgtaacgcctgcttgtccctgcccagaattcccagctgtctgtgtcagcytgtccccctgagatcagagtcctacagtggctgtcacgcagccaccaggtcatctcctttcatccccaccttgaggcggatggctgtgaccctacttcct

SEQ ID NO: 8172 - DNA, 201 bp, Homo sapiens
gccttatcatccatcacaggagtcagaaagggctcctgcactgactcctgagactattttaactgggattggttatcacttttctgtaacgcctgcttgtscctgcccagaattcccagctgtctgtgtcagcctgtccccctgagatcagagtcctacagtggctgtcacgcagccaccaggtcatctcctttcatcccc

SEQ ID NO: 8173 - DNA, 169 bp, Homo sapiens
cagatccatcaggtccgagctgtgttgactaccactacttttcccttcgtctcaattatgtcttggaaraaggctttgcggatccctggaggccttcgggtagcaactgtgaccttgatgctggcgatgctgagcaccccggtggctgagggcagagactctcccgagg

SEQ ID NO: 8174 - DNA, 201 bp, Homo sapiens
attctctcctcagactgctcaagagaagcacatgaaaaccattacctgactttagagcttttttacataattaaacatgatcctgagttatctgtattctsaacttccttaattgagcagaggcaggaaatcactgcagaatgaaggaacataccttgaggtgacccagccaacctgtgcccagaaggagggttgtacctt

SEQ ID NO: 8175 - DNA, 201 bp, Homo sapiens
agccaccaggtcatctcctttcatccccaccttgaggcggatggctgtgaccctacttcctgcactgacccacagcctctgcctgtgcacggccagctgcrtctactcaggccccaaggggtttctgtttctattctctcctcagactgctcaagagaagcacatgaaaaccattacctgactttagagcttttttacata

SEQ ID NO: 8176 - DNA, 201 bp, Homo sapiens
aatatattttgttcatggtgcaaaggaagcctagagtcaagttgatttcagaagtgactagttccagatacacaatgagatcttcacctctctttctgttrtatctctatctgtgaatctgcctctctttctgtgtctctttgtccctgtatagttctttctgcgtgtctctctgcatctttgtctctgcccccttgttgt

SEQ ID NO: 8177 - DNA, 201 bp, Homo sapiens
aggaatggtgactggaccttccagatcctggtgatgctggaaatgactccccagcgtggagacgtctacacctgccacgtggagcaccccagcctccagarccccatcaccgtggagtggcgggctcaatctgaatctgcccagagcaagatgctgagtggcattggaggcttcgtgctggggctgatcttcctcgggctg

SEQ ID NO: 8178 - DNA, 201 bp, Homo sapiens
gactggaccttccagatcctggtgatgctggaaatgactccccagcgtggagacgtctacacctgccacgtggagcaccccagcctccagagccccatcaycgtggagtggcgggctcaatctgaatctgcccagagcaagatgctgagtggcattggaggcttcgtgctggggctgatcttcctcgggctgggccttatc

SEQ ID NO: 8179 - DNA, 201 bp, Homo sapiens
gatacatctataaccgagaggagtacgcgcgcttcgacagcgacgtgggggtgtatcgggcggtgacgccgctggggccgcctgccgccgagtactggaayagccagaaggaagtcctggagaggacccgggcgtcggtggacacggtgtgcagacacaactaccagttggagctccgcacgaccttgcagcggcgagtgg

SEQ ID NO: 8180 - DNA, 201 bp, Homo sapiens
tgcggggtgtgaccagatacatctataaccgagaggagtacgcgcgcttcgacagcgacgtgggggtgtatcgggcggtgacgccgctggggccgcctgcygccgagtactggaatagccagaaggaagtcctggagaggacccgggcgtcggtggacacggtgtgcagacacaactaccagttggagctccgcacgacct

SEQ ID NO: 8181 - DNA, 201 bp, Homo sapiens
gggaccgagcgcgtgcggggtgtgaccagatacatctataaccgagaggagtacgcgcgcttcgacagcgacgtgggggtgtatcgggcggtgacgccgcwggggccgcctgccgccgagtactggaatagccagaaggaagtcctggagaggacccgggcgtcggtggacacggtgtgcagacacaactaccagttggag

SEQ ID NO: 8182 - DNA, 201 bp, Homo sapiens
cagatccatcaggtccgagctgtgttgactaccactacttttcccttcgtctcaattatgtcttggaaaaaggctttgcggatccctggaggccttcgggyagcaactgtgaccttgatgctggcgatgctgagcaccccggtggctgagggcagagactctcccgaggatttcgtgttccagtttaagggcatgtgctac

SEQ ID NO: 8183 - DNA, 201 bp, Homo sapiens
aagggcatgtgctacttcaccaacgggaccgagcgcgtgcggggtgtgaccagatacatctataaccgagaggagtacgcgcgcttcgacagcgacgtggrggtgtatcgggcggtgacgccgctggggccgcctgccgccgagtactggaatagccagaaggaagtcctggagaggacccgggcgtcggtggacacggtg

SEQ ID NO: 8184 - DNA, 201 bp, Homo sapiens
tgtgctacttcaccaacgggaccgagcgcgtgcggggtgtgaccagatacatctataaccgagaggagtacgcgcgcttcgacagcgacgtgggggtgtaycgggcggtgacgccgctggggccgcctgccgccgagtactggaatagccagaaggaagtcctggagaggacccgggcgtcggtggacacggtgtgcagac

SEQ ID NO: 8185 - DNA, 201 bp, Homo sapiens
acttcaccaacgggaccgagcgcgtgcggggtgtgaccagatacatctataaccgagaggagtacgcgcgcttcgacagcgacgtgggggtgtatcgggcrgtgacgccgctggggccgcctgccgccgagtactggaatagccagaaggaagtcctggagaggacccgggcgtcggtggacacggtgtgcagacacaact

SEQ ID NO: 8186 - DNA, 201 bp, Homo sapiens
aggatttcgtgttccagtttaagggcatgtgctacttcaccaacgggaccgagcgcgtgcggggtgtgaccagatacatctataaccgagaggagtacgcrcgcttcgacagcgacgtgggggtgtatcgggcggtgacgccgctggggccgcctgccgccgagtactggaatagccagaaggaagtcctggagaggaccc

SEQ ID NO: 8187 - DNA, 201 bp, Homo sapiens
gtgcggggtgtgaccagatacatctataaccgagaggagtacgcgcgcttcgacagcgacgtgggggtgtatcgggcggtgacgccgctggggccgcctghcgccgagtactggaatagccagaaggaagtcctggagaggacccgggcgtcggtggacacggtgtgcagacacaactaccagttggagctccgcacgacc

SEQ ID NO: 8188 - DNA, 201 bp, Homo sapiens
gaggatttcgtgttccagtttaagggcatgtgctacttcaccaacgggaccgagcgcgtgcggggtgtgaccagatacatctataaccgagaggagtacgygcgcttcgacagcgacgtgggggtgtatcgggcggtgacgccgctggggccgcctgccgccgagtactggaatagccagaaggaagtcctggagaggacc

SEQ ID NO: 8189 - DNA, 201 bp, Homo sapiens
gacagcgacgtgggggtgtatcgggcggtgacgccgctggggccgcctgccgccgagtactggaatagccagaaggaagtcctggagaggacccgggcgtmggtggacacggtgtgcagacacaactaccagttggagctccgcacgaccttgcagcggcgagtggagcccacagtgaccatctccccatccaggacagag

SEQ ID NO: 8190 - DNA, 201 bp, Homo sapiens
tgctgagcaccccggtggctgagggcagagactctcccgaggatttcgtgttccagtttaagggcatgtgctacttcaccaacgggaccgagcgcgtgcgkggtgtgaccagatacatctataaccgagaggagtacgcgcgcttcgacagcgacgtgggggtgtatcgggcggtgacgccgctggggccgcctgccgccg

SEQ ID NO: 8191 - DNA, 201 bp, Homo sapiens
aggccctcaaccaccacaacctgctggtctgctcggtgacagatttctatccagcccagatcaaagtccggtggtttcggaatgaccaggaggagacagcyggcgttgtgtccaccccccttattaggaatggtgactggaccttccagatcctggtgatgctggaaatgactccccagcgtggagacgtctacacctgcc

SEQ ID NO: 8192 - DNA, 201 bp, Homo sapiens
agaggccctcaaccaccacaacctgctggtctgctcggtgacagatttctatccagcccagatcaaagtccggtggtttcggaatgaccaggaggagacarctggcgttgtgtccaccccccttattaggaatggtgactggaccttccagatcctggtgatgctggaaatgactccccagcgtggagacgtctacacctg

SEQ ID NO: 8193 - DNA, 201 bp, Homo sapiens
ccccatccaggacagaggccctcaaccaccacaacctgctggtctgctcggtgacagatttctatccagcccagatcaaagtccggtggtttcggaatgaycaggaggagacagctggcgttgtgtccaccccccttattaggaatggtgactggaccttccagatcctggtgatgctggaaatgactccccagcgtggag

SEQ ID NO: 8194 - DNA, 201 bp, Homo sapiens
cagaatgaaggaacataccttgaggtgacccagccaacctgtgcccagaaggagggttgtaccttgaaaagacactgaaagaatttggggtgcaaagtcakggtgggcagaggaggtagaaaatcaactcagttgtcgcatcattcatggttctttcatattgatgttcagtgcagtggcctgagaatatcccagcctctc

SEQ ID NO: 8195 - DNA, 201 bp, Homo sapiens
gggccttatcatccatcacaggagtcagaaagggctcctgcactgactcctgagactattttaactgggattggttatcacttttctgtaacgcctgcttrtccctgcccagaattcccagctgtctgtgtcagcctgtccccctgagatcagagtcctacagtggctgtcacgcagccaccaggtcatctcctttcatcc

SEQ ID NO: 8196 - DNA, 201 bp, Homo sapiens
cctcgggctgggccttatcatccatcacaggagtcagaaagggctcctgcactgactcctgagactattttaactgggattggttatcacttttctgtaaygcctgcttgtccctgcccagaattcccagctgtctgtgtcagcctgtccccctgagatcagagtcctacagtggctgtcacgcagccaccaggtcatctc

SEQ ID NO: 8197 - DNA, 201 bp, Homo sapiens
ttcccttcgtctcaattatgtcttggaaaaaggctttgcggatccctggaggccttcgggtagcaactgtgaccttgatgctggcgatgctgagcaccccrgtggctgagggcagagactctcccgaggatttcgtgttccagtttaagggcatgtgctacttcaccaacgggaccgagcgcgtgcggggtgtgaccagat

SEQ ID NO: 8198 - DNA, 201 bp, Homo sapiens
gctgatcttcctcgggctgggccttatcatccatcacaggagtcagaaagggctcctgcactgactcctgagactattttaactgggattggttatcactyttctgtaacgcctgcttgtccctgcccagaattcccagctgtctgtgtcagcctgtccccctgagatcagagtcctacagtggctgtcacgcagccacca

SEQ ID NO: 8199 - DNA, 201 bp, Homo sapiens
aggtcatctcctttcatccccaccttgaggcggatggctgtgaccctacttcctgcactgacccacagcctctgcctgtgcacggccagctgcatctactsaggccccaaggggtttctgtttctattctctcctcagactgctcaagagaagcacatgaaaaccattacctgactttagagcttttttacataattaaac

SEQ ID NO: 8200 - DNA, 201 bp, Homo sapiens
agttgtcgcatcattcatggttctttcatattgatgttcagtgcagtggcctgagaatatcccagcctctcttctggtttggtgagtgctatataagtaarcatggtggaattgtttgggggcagatatagtgacccttggtcactggtgtttcaaacattctggcaagtcacatcaatcaagaataatttttacttttaa

SEQ ID NO: 8201 - DNA, 201 bp, Homo sapiens
atttctatccagcccagatcaaagtccggtggtttcggaatgaccaggaggagacagctggcgttgtgtccaccccccttattaggaatggtgactggacyttccagatcctggtgatgctggaaatgactccccagcgtggagacgtctacacctgccacgtggagcaccccagcctccagagccccatcaccgtggagt

SEQ ID NO: 8202 - DNA, 201 bp, Homo sapiens
gctacttcaccaacgggaccgagcgcgtgcggggtgtgaccagatacatctataaccgagaggagtacgcgcgcttcgacagcgacgtgggggtgtatcgsgcggtgacgccgctggggccgcctgccgccgagtactggaatagccagaaggaagtcctggagaggacccgggcgtcggtggacacggtgtgcagacaca

SEQ ID NO: 8203 - DNA, 123 bp, Homo sapiens
cagatccatcaggtccgagctgwgttgactaccactacttttcccttcgtctcaattatgtcttggaaaaaggctttgcggatccctggaggccttcgggtagcaactgtgaccttgatgctg

SEQ ID NO: 8204 - DNA, 201 bp, Homo sapiens
ttcctcgggctgggccttatcatccatcacaggagtcagaaagggctcctgcactgactcctgagactattttaactgggattggttatcacttttctgtracgcctgcttgtccctgcccagaattcccagctgtctgtgtcagcctgtccccctgagatcagagtcctacagtggctgtcacgcagccaccaggtcatc

SEQ ID NO: 8205 - DNA, 201 bp, Homo sapiens
gcaggaaatcactgcagaatgaaggaacataccttgaggtgacccagccaacctgtgcccagaaggagggttgtaccttgaaaagacactgaaagaatttkgggtgcaaagtcatggtgggcagaggaggtagaaaatcaactcagttgtcgcatcattcatggttctttcatattgatgttcagtgcagtggcctgagaa

SEQ ID NO: 8206 - DNA, 201 bp, Homo sapiens
aggtccgagctgtgttgactaccactacttttcccttcgtctcaattatgtcttggaaaaaggctttgcggatccctggaggccttcgggtagcaactgtsaccttgatgctggcgatgctgagcaccccggtggctgagggcagagactctcccgaggatttcgtgttccagtttaagggcatgtgctacttcaccaacg

SEQ ID NO: 8207 - DNA, 201 bp, Homo sapiens
ctgagcaccccggtggctgagggcagagactctcccgaggatttcgtgttccagtttaagggcatgtgctacttcaccaacgggaccgagcgcgtgcgggktgtgaccagatacatctataaccgagaggagtacgcgcgcttcgacagcgacgtgggggtgtatcgggcggtgacgccgctggggccgcctgccgccgag

SEQ ID NO: 8208 - DNA, 192 bp, Homo sapiens
cagatccatcaggtccgagctgtgttgactaccactacttttcccttcgtctcaattatgtcttggaaaaaggctttgcggatccctggagrccttcgggtagcaactgtgaccttgatgctggcgatgctgagcaccccggtggctgagggcagagactctcccgaggatttcgtgttccagtttaagggc

SEQ ID NO: 8209 - DNA, 201 bp, Homo sapiens
tccccatccaggacagaggccctcaaccaccacaacctgctggtctgctcggtgacagatttctatccagcccagatcaaagtccggtggtttcggaatgrccaggaggagacagctggcgttgtgtccaccccccttattaggaatggtgactggaccttccagatcctggtgatgctggaaatgactccccagcgtgga

SEQ ID NO: 8210 - DNA, 201 bp, Homo sapiens
gagcgcgtgcggggtgtgaccagatacatctataaccgagaggagtacgcgcgcttcgacagcgacgtgggggtgtatcgggcggtgacgccgctggggcsgcctgccgccgagtactggaatagccagaaggaagtcctggagaggacccgggcgtcggtggacacggtgtgcagacacaactaccagttggagctccgc

SEQ ID NO: 8211 - DNA, 173 bp, Homo sapiens
cagatccatcaggtccgagctgtgttgactaccactacttttcccttcgtctcaattatgtcttggaaaaagkctttgcggatccctggaggccttcgggtagcaactgtgaccttgatgctggcgatgctgagcaccccggtggctgagggcagagactctcccgaggattt

SEQ ID NO: 8212 - DNA, 201 bp, Homo sapiens
cagcggcgagtggagcccacagtgaccatctccccatccaggacagaggccctcaaccaccacaacctgctggtctgctcggtgacagatttctatccagsccagatcaaagtccggtggtttcggaatgaccaggaggagacagctggcgttgtgtccaccccccttattaggaatggtgactggaccttccagatcctg

SEQ ID NO: 8213 - DNA, 155 bp, Homo sapiens
cagatccatcaggtccgagctgtgttgactaccactacttttcccttcgtctcarttatgtcttggaaaaaggctttgcggatccctggaggccttcgggtagcaactgtgaccttgatgctggcgatgctgagcaccccggtggctgagggcag

SEQ ID NO: 8214 - DNA, 201 bp, Homo sapiens
tggagctccgcacgaccttgcagcggcgagtggagcccacagtgaccatctccccatccaggacagaggccctcaaccaccacaacctgctggtctgctcrgtgacagatttctatccagcccagatcaaagtccggtggtttcggaatgaccaggaggagacagctggcgttgtgtccaccccccttattaggaatggtg

SEQ ID NO: 8215 - DNA, 187 bp, Homo sapiens
cagatccatcaggtccgagctgtgttgactaccactacttttcccttcgtctcaattatgtcttggaaaaaggctttgcggatcccyggaggccttcgggtagcaactgtgaccttgatgctggcgatgctgagcaccccggtggctgagggcagagactctcccgaggatttcgtgttccagttta

SEQ ID NO: 8216 - DNA, 117 bp, Homo sapiens
cagatccatcaggtccragctgtgttgactaccactacttttcccttcgtctcaattatgtcttggaaaaaggctttgcggatccctggaggccttcgggtagcaactgtgaccttg

SEQ ID NO: 8217 - DNA, 201 bp, Homo sapiens
ctaccagttggagctccgcacgaccttgcagcggcgagtggagcccacagtgaccatctccccatccaggacagaggccctcaaccaccacaacctgctgrtctgctcggtgacagatttctatccagcccagatcaaagtccggtggtttcggaatgaccaggaggagacagctggcgttgtgtccaccccccttattag

SEQ ID NO: 8218 - DNA, 201 bp, Homo sapiens; identical to SEQ ID NO: 8161

SEQ ID NO: 8219 - DNA, 201 bp, Homo sapiens; identical to SEQ ID NO: 8162

SEQ ID NO: 8220 - DNA, 201 bp, Homo sapiens; identical to SEQ ID NO: 8163

SEQ ID NO: 8221 - DNA, 201 bp, Homo sapiens; identical to SEQ ID NO: 8164

SEQ ID NO: 8222 - DNA, 201 bp, Homo sapiens; identical to SEQ ID NO: 8165

SEQ ID NO: 8223 - DNA, 201 bp, Homo sapiens; identical to SEQ ID NO: 8166

SEQ ID NO: 8224 - DNA, 201 bp, Homo sapiens; identical to SEQ ID NO: 8167

SEQ ID NO: 8225 - DNA, 201 bp, Homo sapiens; identical to SEQ ID NO: 8168

SEQ ID NO: 8226 - DNA, 201 bp, Homo sapiens; identical to SEQ ID NO: 8169

SEQ ID NO: 8227 - DNA, 201 bp, Homo sapiens; identical to SEQ ID NO: 8170

SEQ ID NO: 8228 - DNA, 201 bp, Homo sapiens; identical to SEQ ID NO: 8171

SEQ ID NO: 8229 - DNA, 201 bp, Homo sapiens
gcctccagagccccatcaccgtggagtggcggctcctgcactgactcctgagactattttaactgggattggttatcacttttctgtaacgcctgcttgtscctgcccagaattcccagctgtctgtgtcagcctgtccccctgagatcagagtcctacagtggctgtcacgcagccaccaggtcatctcctttcatcccc

SEQ ID NO: 8230 - DNA, 169 bp, Homo sapiens; identical to SEQ ID NO: 8173

SEQ ID NO: 8231 - DNA, 201 bp, Homo sapiens; identical to SEQ ID NO: 8174

SEQ ID NO: 8232 - DNA, 201 bp, Homo sapiens; identical to SEQ ID NO: 8175

SEQ ID NO: 8233 - DNA, 201 bp, Homo sapiens; identical to SEQ ID NO: 8176

SEQ ID NO: 8234 - DNA, 201 bp, Homo sapiens
aggaatggtgactggaccttccagatcctggtgatgctggaaatgactccccagcgtggagacgtctacacctgccacgtggagcaccccagcctccagarccccatcaccgtggagtggcggctcctgcactgactcctgagactattttaactgggattggttatcacttttctgtaacgcctgcttgtccctgcccag

SEQ ID NO: 8235 - DNA, 201 bp, Homo sapiens
gactggaccttccagatcctggtgatgctggaaatgactccccagcgtggagacgtctacacctgccacgtggagcaccccagcctccagagccccatcaycgtggagtggcggctcctgcactgactcctgagactattttaactgggattggttatcacttttctgtaacgcctgcttgtccctgcccagaattcccag

SEQ ID NO: 8236 - DNA, 201 bp, Homo sapiens
cagatccatcaggtccgagctgtgttgactaccactacttttcccttcgtctcaattatgtcttggaaaaaggctttgcggatccctggaggccttcgggyagcaactgtgaccttgatgctggcgatgctgagcaccccggtggctgagggcagagactctcccgaggatttcgtgtaccagtttaagggcatgtgctac

SEQ ID NO: 8237 - DNA, 201 bp, Homo sapiens
gatcgtgcgcttcgacagcgacgtgggggagttccgggcggtgacgctgctggggctgcctgccgccgagtactggaacagccagaaggacatcctggagrggaaacgggcggcggtggacagggtgtgcagacacaactaccagttggagctccgcacgaccttgcagcggcgagtggagcccacagtgaccatctcccc

SEQ ID NO: 8238 - DNA, 201 bp, Homo sapiens
gtgcgtcttgtgagcagaagcatctataaccgagaagagatcgtgcgcttcgacagcgacgtgggggagttccgggcggtgacgctgctggggctgcctghcgccgagtactggaacagccagaaggacatcctggagaggaaacgggcggcggtggacagggtgtgcagacacaactaccagttggagctccgcacgacc

SEQ ID NO: 8239 - DNA, 201 bp, Homo sapiens; identical to SEQ ID NO: 8191

SEQ ID NO: 8240 - DNA, 201 bp, Homo sapiens
tgtgctacttcaccaacgggacagagcgcgtgcgtcttgtgagcagaagcatctataaccgagaagagatcgtgcgcttcgacagcgacgtgggggagttycgggcggtgacgctgctggggctgcctgccgccgagtactggaacagccagaaggacatcctggagaggaaacgggcggcggtggacagggtgtgcagac

SEQ ID NO: 8241 - DNA, 201 bp, Homo sapiens; identical to SEQ ID NO: 8192

SEQ ID NO: 8242 - DNA, 201 bp, Homo sapiens
ggtggctgagggcagagactctcccgaggatttcgtgtaccagtttaagggcatgtgctacttcaccaacgggacagagcgcgtgcgtcttgtgagcagaygcatctataaccgagaagagatcgtgcgcttcgacagcgacgtgggggagttccgggcggtgacgctgctggggctgcctgccgccgagtactggaacag

SEQ ID NO: 8243 - DNA, 201 bp, Homo sapiens; identical to SEQ ID NO: 8193

SEQ ID NO: 8244 - DNA, 201 bp, Homo sapiens
gcaccccggtggctgagggcagagactctcccgaggatttcgtgtaccagtttaagggcatgtgctacttcaccaacgggacagagcgcgtgcgtcttgtragcagaagcatctataaccgagaagagatcgtgcgcttcgacagcgacgtgggggagttccgggcggtgacgctgctggggctgcctgccgccgagtact

SEQ ID NO: 8245 - DNA, 201 bp, Homo sapiens
ctgagcaccccggtggctgagggcagagactctcccgaggatttcgtgtaccagtttaagggcatgtgctacttcaccaacgggacagagcgcgtgcgtcktgtgagcagaagcatctataaccgagaagagatcgtgcgcttcgacagcgacgtgggggagttccgggcggtgacgctgctggggctgcctgccgccgag

SEQ ID NO: 8246 - DNA, 201 bp, Homo sapiens; identical to SEQ ID NO: 8194

SEQ ID NO: 8247 - DNA, 201 bp, Homo sapiens
cagcctccagagccccatcaccgtggagtggcggctcctgcactgactcctgagactattttaactgggattggttatcacttttctgtaacgcctgcttrtccctgcccagaattcccagctgtctgtgtcagcctgtccccctgagatcagagtcctacagtggctgtcacgcagccaccaggtcatctcctttcatcc

SEQ ID NO: 8248 - DNA, 201 bp, Homo sapiens
ggagcaccccagcctccagagccccatcaccgtggagtggcggctcctgcactgactcctgagactattttaactgggattggttatcacttttctgtaaygcctgcttgtccctgcccagaattcccagctgtctgtgtcagcctgtccccctgagatcagagtcctacagtggctgtcacgcagccaccaggtcatctc

SEQ ID NO: 8249 - DNA, 201 bp, Homo sapiens
ctgccacgtggagcaccccagcctccagagccccatcaccgtggagtggcggctcctgcactgactcctgagactattttaactgggattggttatcactyttctgtaacgcctgcttgtccctgcccagaattcccagctgtctgtgtcagcctgtccccctgagatcagagtcctacagtggctgtcacgcagccacca

SEQ ID NO: 8250 - DNA, 201 bp, Homo sapiens
ttcccttcgtctcaattatgtcttggaaaaaggctttgcggatccctggaggccttcgggtagcaactgtgaccttgatgctggcgatgctgagcaccccrgtggctgagggcagagactctcccgaggatttcgtgtaccagtttaagggcatgtgctacttcaccaacgggacagagcgcgtgcgtcttgtgagcagaa

SEQ ID NO: 8251 - DNA, 201 bp, Homo sapiens; identical to SEQ ID NO: 8199

SEQ ID NO: 8252 - DNA, 201 bp, Homo sapiens; identical to SEQ ID NO: 8200

SEQ ID NO: 8253 - DNA, 201 bp, Homo sapiens; identical to SEQ ID NO: 8201

SEQ ID NO: 8254 - DNA, 123 bp, Homo sapiens; identical to SEQ ID NO: 8203

SEQ ID NO: 8255 - DNA, 201 bp, Homo sapiens
gtggagcaccccagcctccagagccccatcaccgtggagtggcggctcctgcactgactcctgagactattttaactgggattggttatcacttttctgtracgcctgcttgtccctgcccagaattcccagctgtctgtgtcagcctgtccccctgagatcagagtcctacagtggctgtcacgcagccaccaggtcatc

SEQ ID NO: 8256 - DNA, 201 bp, Homo sapiens; identical to SEQ ID NO: 8205

SEQ ID NO: 8257 - DNA, 201 bp, Homo sapiens
aggtccgagctgtgttgactaccactacttttcccttcgtctcaattatgtcttggaaaaaggctttgcggatccctggaggccttcgggtagcaactgtsaccttgatgctggcgatgctgagcaccccggtggctgagggcagagactctcccgaggatttcgtgtaccagtttaagggcatgtgctacttcaccaacg

SEQ ID NO: 8258 - DNA, 192 bp, Homo sapiens
cagatccatcaggtccgagctgtgttgactaccactacttttcccttcgtctcaattatgtcttggaaaaaggctttgcggatccctggagrccttcgggtagcaactgtgaccttgatgctggcgatgctgagcaccccggtggctgagggcagagactctcccgaggatttcgtgtaccagtttaagggc

SEQ ID NO: 8259 - DNA, 201 bp, Homo sapiens; identical to SEQ ID NO: 8209

SEQ ID NO: 8260 - DNA, 173 bp, Homo sapiens; identical to SEQ ID NO: 8211

SEQ ID NO: 8261 - DNA, 201 bp, Homo sapiens; identical to SEQ ID NO: 8212

SEQ ID NO: 8262 - DNA, 155 bp, Homo sapiens; identical to SEQ ID NO: 8213

SEQ ID NO: 8263 - DNA, 201 bp, Homo sapiens; identical to SEQ ID NO: 8214

SEQ ID NO: 8264 - DNA, 187 bp, Homo sapiens
cagatccatcaggtccgagctgtgttgactaccactacttttcccttcgtctcaattatgtcttggaaaaaggctttgcggatcccyggaggccttcgggtagcaactgtgaccttgatgctggcgatgctgagcaccccggtggctgagggcagagactctcccgaggatttcgtgtaccagttta

SEQ ID NO: 8265 - DNA, 117 bp, Homo sapiens; identical to SEQ ID NO: 8216

SEQ ID NO: 8266 - DNA, 201 bp, Homo sapiens; identical to SEQ ID NO: 8217

SEQ ID NO: 8267 - DNA, 201 bp, Homo sapiens; identical to SEQ ID NO: 8161

SEQ ID NO: 8268 - DNA, 201 bp, Homo sapiens; identical to SEQ ID NO: 8162

SEQ ID NO: 8269 - DNA, 201 bp, Homo sapiens; identical to SEQ ID NO: 8163

SEQ ID NO: 8270 - DNA, 201 bp, Homo sapiens; identical to SEQ ID NO: 8164

SEQ ID NO: 8271 - DNA, 201 bp, Homo sapiens; identical to SEQ ID NO: 8165

SEQ ID NO: 8272 - DNA, 201 bp, Homo sapiens; identical to SEQ ID NO: 8166

SEQ ID NO: 8273 - DNA, 201 bp, Homo sapiens; identical to SEQ ID NO: 8167

SEQ ID NO: 8274 - DNA, 201 bp, Homo sapiens; identical to SEQ ID NO: 8168

SEQ ID NO: 8275 - DNA, 201 bp, Homo sapiens; identical to SEQ ID NO: 8169

SEQ ID NO: 8276 - DNA, 201 bp, Homo sapiens; identical to SEQ ID NO: 8170

SEQ ID NO: 8277 - DNA, 201 bp, Homo sapiens; identical to SEQ ID NO: 8171

SEQ ID NO: 8278 - DNA, 201 bp, Homo sapiens; identical to SEQ ID NO: 8172

SEQ ID NO: 8279 - DNA, 169 bp, Homo sapiens; identical to SEQ ID NO: 8173

SEQ ID NO: 8280 - DNA, 201 bp, Homo sapiens; identical to SEQ ID NO: 8174

SEQ ID NO: 8281 - DNA, 201 bp, Homo sapiens; identical to SEQ ID NO: 8175

SEQ ID NO: 8282 - DNA, 201 bp, Homo sapiens; identical to SEQ ID NO: 8176

SEQ ID NO: 8283 - DNA, 201 bp, Homo sapiens; identical to SEQ ID NO: 8177

SEQ ID NO: 8284 - DNA, 201 bp, Homo sapiens; identical to SEQ ID NO: 8178

SEQ ID NO: 8285 - DNA, 201 bp, Homo sapiens; identical to SEQ ID NO: 8236

SEQ ID NO: 8286 - DNA, 201 bp, Homo sapiens; identical to SEQ ID NO: 8237

SEQ ID NO: 8287 - DNA, 201 bp, Homo sapiens; identical to SEQ ID NO: 8238

SEQ ID NO: 8288 - DNA, 201 bp, Homo sapiens; identical to SEQ ID NO: 8191

SEQ ID NO: 8289 - DNA, 201 bp, Homo sapiens; identical to SEQ ID NO: 8240

SEQ ID NO: 8290 - DNA, 201 bp, Homo sapiens; identical to SEQ ID NO: 8192

SEQ ID NO: 8291 - DNA, 201 bp, Homo sapiens; identical to SEQ ID NO: 8242

SEQ ID NO: 8292 - DNA, 201 bp, Homo sapiens; identical to SEQ ID NO: 8193

SEQ ID NO: 8293 - DNA, 201 bp, Homo sapiens; identical to SEQ ID NO: 8244

SEQ ID NO: 8294 - DNA, 201 bp, Homo sapiens; identical to SEQ ID NO: 8245

SEQ ID NO: 8295 - DNA, 201 bp, Homo sapiens; identical to SEQ ID NO: 8194

SEQ ID NO: 8296 - DNA, 201 bp, Homo sapiens; identical to SEQ ID NO: 8195

SEQ ID NO: 8297 - DNA, 201 bp, Homo sapiens; identical to SEQ ID NO: 8196

SEQ ID NO: 8298 - DNA, 201 bp, Homo sapiens; identical to SEQ ID NO: 8198

SEQ ID NO: 8299 - DNA, 201 bp, Homo sapiens; identical to SEQ ID NO: 8250

SEQ ID NO: 8300 - DNA, 201 bp, Homo sapiens; identical to SEQ ID NO: 8199

SEQ ID NO: 8301 - DNA, 201 bp, Homo sapiens; identical to SEQ ID NO: 8200

SEQ ID NO: 8302 - DNA, 201 bp, Homo sapiens; identical to SEQ ID NO: 8201

SEQ ID NO: 8303 - DNA, 123 bp, Homo sapiens; identical to SEQ ID NO: 8203

SEQ ID NO: 8304 - DNA, 201 bp, Homo sapiens; identical to SEQ ID NO: 8204

SEQ ID NO: 8305 - DNA, 201 bp, Homo sapiens; identical to SEQ ID NO: 8205

SEQ ID NO: 8306 - DNA, 201 bp, Homo sapiens; identical to SEQ ID NO: 8257

SEQ ID NO: 8307 - DNA, 192 bp, Homo sapiens; identical to SEQ ID NO: 8258

SEQ ID NO: 8308 - DNA, 201 bp, Homo sapiens; identical to SEQ ID NO: 8209

SEQ ID NO: 8309 - DNA, 173 bp, Homo sapiens; identical to SEQ ID NO: 8211

SEQ ID NO: 8310 - DNA, 201 bp, Homo sapiens; identical to SEQ ID NO: 8212

SEQ ID NO: 8311 - DNA, 155 bp, Homo sapiens; identical to SEQ ID NO: 8213

SEQ ID NO: 8312 - DNA, 201 bp, Homo sapiens; identical to SEQ ID NO: 8214

SEQ ID NO: 8313 - DNA, 187 bp, Homo sapiens; identical to SEQ ID NO: 8264

SEQ ID NO: 8314 - DNA, 117 bp, Homo sapiens; identical to SEQ ID NO: 8216

SEQ ID NO: 8315 - DNA, 201 bp, Homo sapiens; identical to SEQ ID NO: 8217

SEQ ID NO: 8316 - DNA, 201 bp, Homo sapiens; identical to SEQ ID NO: 8161

SEQ ID NO: 8317 - DNA, 201 bp, Homo sapiens; identical to SEQ ID NO: 8162

SEQ ID NO: 8318 - DNA, 201 bp, Homo sapiens; identical to SEQ ID NO: 8163

SEQ ID NO: 8319 - DNA, 201 bp, Homo sapiens; identical to SEQ ID NO: 8164

SEQ ID NO: 8320 - DNA, 201 bp, Homo sapiens; identical to SEQ ID NO: 8165

SEQ ID NO: 8321 - DNA, 201 bp, Homo sapiens; identical to SEQ ID NO: 8166

SEQ ID NO: 8322 - DNA, 201 bp, Homo sapiens; identical to SEQ ID NO: 8167

SEQ ID NO: 8323 - DNA, 201 bp, Homo sapiens; identical to SEQ ID NO: 8168

SEQ ID NO: 8324 - DNA, 201 bp, Homo sapiens; identical to SEQ ID NO: 8169

SEQ ID NO: 8325 - DNA, 201 bp, Homo sapiens; identical to SEQ ID NO: 8170

SEQ ID NO: 8326 - DNA, 201 bp, Homo sapiens; identical to SEQ ID NO: 8171

SEQ ID NO: 8327 - DNA, 201 bp, Homo sapiens
cagaaagacctcaagggcctccaccagcagggctcctgcactgactcctgagactattttaactgggattggttatcacttttctgtaacgcctgcttgtscctgcccagaattcccagctgtctgtgtcagcctgtccccctgagatcagagtcctacagtggctgtcacgcagccaccaggtcatctcctttcatcccc

SEQ ID NO: 8328 - DNA, 169 bp, Homo sapiens; identical to SEQ ID NO: 8173

SEQ ID NO: 8329 - DNA, 201 bp, Homo sapiens; identical to SEQ ID NO: 8174

SEQ ID NO: 8330 - DNA, 201 bp, Homo sapiens; identical to SEQ ID NO: 8175

SEQ ID NO: 8331 - DNA, 201 bp, Homo sapiens; identical to SEQ ID NO: 8176

SEQ ID NO: 8332 - DNA, 201 bp, Homo sapiens; identical to SEQ ID NO: 8177

SEQ ID NO: 8333 - DNA, 201 bp, Homo sapiens; identical to SEQ ID NO: 8178

SEQ ID NO: 8334 - DNA, 201 bp, Homo sapiens; identical to SEQ ID NO: 8179

SEQ ID NO: 8335 - DNA, 201 bp, Homo sapiens; identical to SEQ ID NO: 8180

SEQ ID NO: 8336 - DNA, 201 bp, Homo sapiens; identical to SEQ ID NO: 8181

SEQ ID NO: 8337 - DNA, 201 bp, Homo sapiens; identical to SEQ ID NO: 8182

SEQ ID NO: 8338 - DNA, 201 bp, Homo sapiens; identical to SEQ ID NO: 8183

SEQ ID NO: 8339 - DNA, 201 bp, Homo sapiens; identical to SEQ ID NO: 8184

SEQ ID NO: 8340 - DNA, 201 bp, Homo sapiens; identical to SEQ ID NO: 8185

SEQ ID NO: 8341 - DNA, 201 bp, Homo sapiens; identical to SEQ ID NO: 8186

SEQ ID NO: 8342 - DNA, 201 bp, Homo sapiens; identical to SEQ ID NO: 8187

SEQ ID NO: 8343 - DNA, 201 bp, Homo sapiens; identical to SEQ ID NO: 8188

SEQ ID NO: 8344 - DNA, 201 bp, Homo sapiens; identical to SEQ ID NO: 8189

SEQ ID NO: 8345 - DNA, 201 bp, Homo sapiens; identical to SEQ ID NO: 8190

SEQ ID NO: 8346 - DNA, 201 bp, Homo sapiens; identical to SEQ ID NO: 8191

SEQ ID NO: 8347 - DNA, 201 bp, Homo sapiens; identical to SEQ ID NO: 8192

SEQ ID NO: 8348 - DNA, 201 bp, Homo sapiens; identical to SEQ ID NO: 8193

SEQ ID NO: 8349 - DNA, 201 bp, Homo sapiens; identical to SEQ ID NO: 8194

SEQ ID NO: 8350 - DNA, 201 bp, Homo sapiens
gtcagaaagacctcaagggcctccaccagcagggctcctgcactgactcctgagactattttaactgggattggttatcacttttctgtaacgcctgcttrtccctgcccagaattcccagctgtctgtgtcagcctgtccccctgagatcagagtcctacagtggctgtcacgcagccaccaggtcatctcctttcatcc

SEQ ID NO: 8351 - DNA, 201 bp, Homo sapiens
atcacaggagtcagaaagacctcaagggcctccaccagcagggctcctgcactgactcctgagactattttaactgggattggttatcacttttctgtaaygcctgcttgtccctgcccagaattcccagctgtctgtgtcagcctgtccccctgagatcagagtcctacagtggctgtcacgcagccaccaggtcatctc

SEQ ID NO: 8352 - DNA, 201 bp, Homo sapiens; identical to SEQ ID NO: 8197

SEQ ID NO: 8353 - DNA, 201 bp, Homo sapiens
ttatcatccatcacaggagtcagaaagacctcaagggcctccaccagcagggctcctgcactgactcctgagactattttaactgggattggttatcactyttctgtaacgcctgcttgtccctgcccagaattcccagctgtctgtgtcagcctgtccccctgagatcagagtcctacagtggctgtcacgcagccacca

SEQ ID NO: 8354 - DNA, 201 bp, Homo sapiens; identical to SEQ ID NO: 8199

SEQ ID NO: 8355 - DNA, 201 bp, Homo sapiens; identical to SEQ ID NO: 8200

SEQ ID NO: 8356 - DNA, 201 bp, Homo sapiens; identical to SEQ ID NO: 8201

SEQ ID NO: 8357 - DNA, 201 bp, Homo sapiens; identical to SEQ ID NO: 8202

SEQ ID NO: 8358 - DNA, 123 bp, Homo sapiens; identical to SEQ ID NO: 8203

SEQ ID NO: 8359 - DNA, 201 bp, Homo sapiens
ccatcacaggagtcagaaagacctcaagggcctccaccagcagggctcctgcactgactcctgagactattttaactgggattggttatcacttttctgtracgcctgcttgtccctgcccagaattcccagctgtctgtgtcagcctgtccccctgagatcagagtcctacagtggctgtcacgcagccaccaggtcatc

SEQ ID NO: 8360 - DNA, 201 bp, Homo sapiens; identical to SEQ ID NO: 8205

SEQ ID NO: 8361 - DNA, 201 bp, Homo sapiens; identical to SEQ ID NO: 8206

SEQ ID NO: 8362 - DNA, 201 bp, Homo sapiens; identical to SEQ ID NO: 8207

SEQ ID NO: 8363 - DNA, 192 bp, Homo sapiens; identical to SEQ ID NO: 8208

SEQ ID NO: 8364 - DNA, 201 bp, Homo sapiens; identical to SEQ ID NO: 8209

SEQ ID NO: 8365 - DNA, 201 bp, Homo sapiens; identical to SEQ ID NO: 8210

SEQ ID NO: 8366 - DNA, 173 bp, Homo sapiens; identical to SEQ ID NO: 8211

SEQ ID NO: 8367 - DNA, 201 bp, Homo sapiens; identical to SEQ ID NO: 8212

SEQ ID NO: 8368 - DNA, 155 bp, Homo sapiens; identical to SEQ ID NO: 8213

SEQ ID NO: 8369 - DNA, 201 bp, Homo sapiens; identical to SEQ ID NO: 8214

SEQ ID NO: 8370 - DNA, 187 bp, Homo sapiens; identical to SEQ ID NO: 8215

SEQ ID NO: 8371 - DNA, 117 bp, Homo sapiens; identical to SEQ ID NO: 8216

SEQ ID NO: 8372 - DNA, 201 bp, Homo sapiens; identical to SEQ ID NO: 8217

SEQ ID NO: 8373 - DNA, 201 bp, Homo sapiens; identical to SEQ ID NO: 8161

SEQ ID NO: 8374 - DNA, 201 bp, Homo sapiens; identical to SEQ ID NO: 8162

SEQ ID NO: 8375 - DNA, 201 bp, Homo sapiens; identical to SEQ ID NO: 8163

SEQ ID NO: 8376 - DNA, 201 bp, Homo sapiens; identical to SEQ ID NO: 8164

SEQ ID NO: 8377 - DNA, 201 bp, Homo sapiens; identical to SEQ ID NO: 8165

SEQ ID NO: 8378 - DNA, 201 bp, Homo sapiens; identical to SEQ ID NO: 8166

SEQ ID NO: 8379 - DNA, 201 bp, Homo sapiens; identical to SEQ ID NO: 8167

SEQ ID NO: 8380 - DNA, 201 bp, Homo sapiens; identical to SEQ ID NO: 8168

SEQ ID NO: 8381 - DNA, 201 bp, Homo sapiens; identical to SEQ ID NO: 8169

SEQ ID NO: 8382 - DNA, 201 bp, Homo sapiens; identical to SEQ ID NO: 8170

SEQ ID NO: 8383 - DNA, 201 bp, Homo sapiens; identical to SEQ ID NO: 8171

SEQ ID NO: 8384 - DNA, 201 bp, Homo sapiens; identical to SEQ ID NO: 8327

SEQ ID NO: 8385 - DNA, 169 bp, Homo sapiens; identical to SEQ ID NO: 8173

SEQ ID NO: 8386 - DNA, 201 bp, Homo sapiens; identical to SEQ ID NO: 8174

SEQ ID NO: 8387 - DNA, 201 bp, Homo sapiens; identical to SEQ ID NO: 8175

SEQ ID NO: 8388 - DNA, 201 bp, Homo sapiens; identical to SEQ ID NO: 8176

SEQ ID NO: 8389 - DNA, 201 bp, Homo sapiens; identical to SEQ ID NO: 8177

SEQ ID NO: 8390 - DNA, 201 bp, Homo sapiens; identical to SEQ ID NO: 8178

SEQ ID NO: 8391 - DNA, 201 bp, Homo sapiens; identical to SEQ ID NO: 8236

SEQ ID NO: 8392 - DNA, 201 bp, Homo sapiens; identical to SEQ ID NO: 8237

SEQ ID NO: 8393 - DNA, 201 bp, Homo sapiens; identical to SEQ ID NO: 8238

SEQ ID NO: 8394 - DNA, 201 bp, Homo sapiens; identical to SEQ ID NO: 8191

SEQ ID NO: 8395 - DNA, 201 bp, Homo sapiens; identical to SEQ ID NO: 8240

SEQ ID NO: 8396 - DNA, 201 bp, Homo sapiens; identical to SEQ ID NO: 8192

SEQ ID NO: 8397 - DNA, 201 bp, Homo sapiens; identical to SEQ ID NO: 8242

SEQ ID NO: 8398 - DNA, 201 bp, Homo sapiens; identical to SEQ ID NO: 8193

SEQ ID NO: 8399 - DNA, 201 bp, Homo sapiens; identical to SEQ ID NO: 8244

SEQ ID NO: 8400 - DNA, 201 bp, Homo sapiens; identical to SEQ ID NO: 8245

SEQ ID NO: 8401 - DNA, 201 bp, Homo sapiens; identical to SEQ ID NO: 8194

SEQ ID NO: 8402 - DNA, 201 bp, Homo sapiens; identical to SEQ ID NO: 8350

SEQ ID NO: 8403 - DNA, 201 bp, Homo sapiens; identical to SEQ ID NO: 8351

SEQ ID NO: 8404 - DNA, 201 bp, Homo sapiens; identical to SEQ ID NO: 8353

SEQ ID NO: 8405 - DNA, 201 bp, Homo sapiens; identical to SEQ ID NO: 8250

SEQ ID NO: 8406 - DNA, 201 bp, Homo sapiens; identical to SEQ ID NO: 8199

SEQ ID NO: 8407 - DNA, 201 bp, Homo sapiens; identical to SEQ ID NO: 8200

SEQ ID NO: 8408 - DNA, 201 bp, Homo sapiens; identical to SEQ ID NO: 8201

SEQ ID NO: 8409 - DNA, 123 bp, Homo sapiens; identical to SEQ ID NO: 8203

SEQ ID NO: 8410 - DNA, 201 bp, Homo sapiens; identical to SEQ ID NO: 8359

SEQ ID NO: 8411 - DNA, 201 bp, Homo sapiens; identical to SEQ ID NO: 8205

SEQ ID NO: 8412 - DNA, 201 bp, Homo sapiens; identical to SEQ ID NO: 8257

SEQ ID NO: 8413 - DNA, 192 bp, Homo sapiens; identical to SEQ ID NO: 8258

SEQ ID NO: 8414 - DNA, 201 bp, Homo sapiens; identical to SEQ ID NO: 8209

SEQ ID NO: 8415 - DNA, 173 bp, Homo sapiens; identical to SEQ ID NO: 8211

SEQ ID NO: 8416 - DNA, 201 bp, Homo sapiens; identical to SEQ ID NO: 8212

SEQ ID NO: 8417 - DNA, 155 bp, Homo sapiens; identical to SEQ ID NO: 8213

SEQ ID NO: 8418 - DNA, 201 bp, Homo sapiens; identical to SEQ ID NO: 8214

SEQ ID NO: 8419 - DNA, 187 bp, Homo sapiens; identical to SEQ ID NO: 8264

SEQ ID NO: 8420 - DNA, 117 bp, Homo sapiens; identical to SEQ ID NO: 8216

SEQ ID NO: 8421 - DNA, 201 bp, Homo sapiens; identical to SEQ ID NO: 8217

SEQ ID NO: 8422 - DNA, 201 bp, Homo sapiens; identical to SEQ ID NO: 8164

SEQ ID NO: 8423 - DNA, 201 bp, Homo sapiens; identical to SEQ ID NO: 8191

SEQ ID NO: 8424 - DNA, 201 bp, Homo sapiens; identical to SEQ ID NO: 8192

SEQ ID NO: 8425 - DNA, 201 bp, Homo sapiens; identical to SEQ ID NO: 8193

SEQ ID NO: 8426 - DNA, 201 bp, Homo sapiens; identical to SEQ ID NO: 8209

SEQ ID NO: 8427 - DNA, 201 bp, Homo sapiens; identical to SEQ ID NO: 8212

SEQ ID NO: 8428 - DNA, 201 bp, Homo sapiens; identical to SEQ ID NO: 8214

SEQ ID NO: 8429 - DNA, 201 bp, Homo sapiens; identical to SEQ ID NO: 8217

SEQ ID NO: 8430 - DNA, 201 bp, Homo sapiens; identical to SEQ ID NO: 8237

SEQ ID NO: 8431 - DNA, 201 bp, Homo sapiens; identical to SEQ ID NO: 8238

SEQ ID NO: 8432 - DNA, 201 bp, Homo sapiens; identical to SEQ ID NO: 8240

SEQ ID NO: 8433 - DNA, 201 bp, Homo sapiens
agtggctgagggcagagactctcccgaggatttcgtgtaccagtttaagggcatgtgctacttcaccaacgggacagagcgcgtgcgtcttgtgagcagaygcatctataaccgagaagagatcgtgcgcttcgacagcgacgtgggggagttccgggcggtgacgctgctggggctgcctgccgccgagtactggaacag

SEQ ID NO: 8434 - DNA, 201 bp, Homo sapiens
gcaccccagtggctgagggcagagactctcccgaggatttcgtgtaccagtttaagggcatgtgctacttcaccaacgggacagagcgcgtgcgtcttgtragcagaagcatctataaccgagaagagatcgtgcgcttcgacagcgacgtgggggagttccgggcggtgacgctgctggggctgcctgccgccgagtact

SEQ ID NO: 8435 - DNA, 201 bp, Homo sapiens
ctgagcaccccagtggctgagggcagagactctcccgaggatttcgtgtaccagtttaagggcatgtgctacttcaccaacgggacagagcgcgtgcgtcktgtgagcagaagcatctataaccgagaagagatcgtgcgcttcgacagcgacgtgggggagttccgggcggtgacgctgctggggctgcctgccgccgag

SEQ ID NO: 8436 - DNA, 184 bp, Homo sapiens
cggatggctgtgaccctacttcctgcactgacccacagcctctgcctgtgcacggccagctgcatctactcaggccccaaggggtttctgtttctattctytcctcagactgctcaagagaagcacatgaaaaccattacctgactttagagcttttttacataattaaacatgatcctgagtt

SEQ ID NO: 8437 - DNA, 189 bp, Homo sapiens
tgaggcggatggctgtgaccctacttcctgcactgacccacagcctctgcctgtgcacggccagctgcatctactcaggccccaaggggtttctgtttctrttctctcctcagactgctcaagagaagcacatgaaaaccattacctgactttagagcttttttacataattaaacatgatcctgagtt

SEQ ID NO: 8438 - DNA, 201 bp, Homo sapiens; identical to SEQ ID NO: 8169

SEQ ID NO: 8439 - DNA, 201 bp, Homo sapiens; identical to SEQ ID NO: 8170

SEQ ID NO: 8440 - DNA, 201 bp, Homo sapiens; identical to SEQ ID NO: 8171

SEQ ID NO: 8441 - DNA, 201 bp, Homo sapiens; identical to SEQ ID NO: 8172

SEQ ID NO: 8442 - DNA, 201 bp, Homo sapiens; identical to SEQ ID NO: 8195

SEQ ID NO: 8443 - DNA, 201 bp, Homo sapiens; identical to SEQ ID NO: 8196

SEQ ID NO: 8444 - DNA, 201 bp, Homo sapiens; identical to SEQ ID NO: 8198

SEQ ID NO: 8445 - DNA, 201 bp, Homo sapiens; identical to SEQ ID NO: 8161

SEQ ID NO: 8446 - DNA, 201 bp, Homo sapiens; identical to SEQ ID NO: 8201

SEQ ID NO: 8447 - DNA, 201 bp, Homo sapiens; identical to SEQ ID NO: 8177

SEQ ID NO: 8448 - DNA, 201 bp, Homo sapiens; identical to SEQ ID NO: 8178

SEQ ID NO: 8449 - DNA, 201 bp, Homo sapiens; identical to SEQ ID NO: 8204

SEQ ID NO: 8450 - DNA, 201 bp, Homo sapiens; identical to SEQ ID NO: 8175

SEQ ID NO: 8451 - DNA, 201 bp, Homo sapiens; identical to SEQ ID NO: 8199

SEQ ID NO: 8452 - DNA, 201 bp, Homo sapiens
gaggcaccccaaattacctgcccattcgtcaggacacccacccacccagtgttatattctgcctcgccggagtgggtgttcccgggggcacttgccgaccrgccccttgcgtccccaggtttgcagctctcccctgggccactaaccatcctggcccgggctgcctgtctgacctccgtgcctagtcgtggctctccatct

SEQ ID NO: 8453 - DNA, 201 bp, Homo sapiens
ccccgcctccccgaaacaggctactctcctcggccccctccatcgggctgaggaagcacagcagcatcttcaaacatgtacaaaatcgattggctttaaamacccttcacataccctccccccaaattatccccaattatccccacacataaaaaatcaaaacattaaactaacccccttcccccccccccacaacaaccc

SEQ ID NO: 8454 - DNA, 201 bp, Homo sapiens
aggcttggggtgtatggggaggggggctttgcttttaaaagaggtcatctcagcaatatctttttgtttttccccaggggccgaagagtcaccaccgagcytgtgtgggaggaggtggattccagcccccagccccagggctctgaatcgctgccagctcagccccctgcccagcctgccccacagcctgagccccagcag

SEQ ID NO: 8455 - DNA, 193 bp, Homo sapiens
atacaccattttacaggtaaagcttccttccctcctgcctccctatgcctgctgaccaccagcaagaaattggacaggagactgaggagaaaygccgggagaggcaacaaccgccctccatgtcccccctaggtttagcttctctcctcctgatggcgcacctggtcccccttgctgctctcccagcctccct

SEQ ID NO: 8456 - DNA, 201 bp, Homo sapiens
cacagcacatgcacacacagcacacacatgaacacagcacacagcacacacatgcacacagcacacacgcatgcacagcacacatgaacacagcacacacmaacacacagcacacacatgcacacacagcacacacactcatgcgcagcacatacatgaacacagctcacagcacacaaacacgcagcacacacgttgcac

SEQ ID NO: 8457 - DNA, 201 bp, Homo sapiens
cagcacacacagcacacacacaaacacagcacacacatgcacacagcacatgcacacacagcacacacatgaacacagcacacagcacacacatgcacacmgcacacacgcatgcacagcacacatgaacacagcacacacaaacacacagcacacacatgcacacacagcacacacactcatgcgcagcacatacatgaa

SEQ ID NO: 8458 - DNA, 201 bp, Homo sapiens
cacacacatgcacacacagcacacacacgcgaacacagcacacacgaacacagcacacacagcacacacacaaacacagcacacacatgcacacagcacaygcacacacagcacacacatgaacacagcacacagcacacacatgcacacagcacacacgcatgcacagcacacatgaacacagcacacacaaacacacag

SEQ ID NO: 8459 - DNA, 201 bp, Homo sapiens
ttggatgaaaacaataagcatatctaagcaactacgatatctgtatggatcaggccaaagtcccgctaagattctccaatgttttcatggtctgagccccsctcctgttcccatctccactgcccctcggccctgtctgtgccctgcctctcagaggagggggctcagatggtgcggcctgagtgtgcggccggcggcatt

SEQ ID NO: 8460 - DNA, 197 bp, Homo sapiens
ccctcctctgccatcacctgaagacccccacgccaaacactgaatgtcacctgtgcctgccgcctcggtccaccttgcggcccgtgtttgactcaactcarctcctttaacgctaatatttccggcaaaatcccatgcttgggttttgtctttaaccttgtaacgcttgcaatcccaataaagcattaaaagtcatg

SEQ ID NO: 8461 - DNA, 201 bp, Homo sapiens
aaattacctgcccattcgtcaggacacccacccacccagtgttatattctgcctcgccggagtgggtgttcccgggggcacttgccgaccagccccttgcrtccccaggtttgcagctctcccctgggccactaaccatcctggcccgggctgcctgtctgacctccgtgcctagtcgtggctctccatcttgtctcctcc

SEQ ID NO: 8462 - DNA, 201 bp, Homo sapiens
ggaatttggcactccccacccccctctttctcttctcccttggactttgagtcaaattggcctggacttgagtccctgaaccagcaaagagaaaagaaggrccccagaaatcacaggtgggcacgtcgctgctaccgccatctcccttctcacgggaattttcagggtaaactggccatccgaaaatagcaacaacccaga

SEQ ID NO: 8463 - DNA, 201 bp, Homo sapiens
tctagaggcctgaggcttctgggtcctggtgacggggctggcatgaccccgggggtcgtccatgccagtccgcctcagtcgcagagggtccctcggcaagygccctgtgagtgggccattcggaacattggacagaagcccaaagagccaaattgtcacaattgtggaacccacattggcctgagatccaaaacgcttcga

SEQ ID NO: 8464 - DNA, 201 bp, Homo sapiens
aggcgggtctgagcccacagagcaggagagctgccaggtctgcccatcgaccaggttgcttgggccccggagcccacgggtctggttgggaggtttacctygcccccacttgtgcccccagctcagcccccctgcacgcagcccgactagcagtctagaggcctgaggcttctgggtcctggtgacggggctggcatgacc

SEQ ID NO: 8465 - DNA, 201 bp, Homo sapiens
acccagcgcctgcgcaggggcctgcctgccctcctgcgtgcccgccggggtcacgtgctcgccaaggagctcgaggcgttcagggaggccaaacgtcaccrtcccctgattgctctacccacccaagaccccgcccacgggggcgcccccccagagatggccagcaatcggaagtgagcaaaactgccgcaagtctgcagc

SEQ ID NO: 8466 - DNA, 201 bp, Homo sapiens
aaacgtcaccgtcccctgattgctctacccacccaagaccccgcccacgggggcgcccccccagagatggccagcaatcggaagtgagcaaaactgccgcragtctgcagcccggcgccaccatcctgcagcctcctcctgaccacggacgtttccatcaggttccatcccgaaaatctctcggttccacgtccccctggg

SEQ ID NO: 8467 - DNA, 201 bp, Homo sapiens
cctggcttctggggacagtggctggtccccagaagtcctgagggcggaggggggggttgggcagggtctcctcaggtgtcaggagggtgctcggaggccayaggagggggctcctggctggcctgaggctggccggaggggaaggggctagcaggtgtgtaaacagagggttccatcaggctggggcagggtggccgcctt

SEQ ID NO: 8468 - DNA, 201 bp, Homo sapiens
accaccaaaaaaaatcaattggctaaaaaaaaaaagtattaaaaacgaattggctgagaaacaattggcaaaataaaggaatttggcactccccacccccstctttctcttctcccttggactttgagtcaaattggcctggacttgagtccctgaaccagcaaagagaaaagaagggccccagaaatcacaggtgggcac

SEQ ID NO: 8469 - DNA, 201 bp, Homo sapiens
cccctggggcttctcctgacccagtccccgtgccccgcctccccgaaacaggctactctcctcggccccctccatcgggctgaggaagcacagcagcatcwtcaaacatgtacaaaatcgattggctttaaacacccttcacataccctccccccaaattatccccaattatccccacacataaaaaatcaaaacattaaa

SEQ ID NO: 8470 - DNA, 201 bp, Homo sapiens
ctgattgctctacccacccaagaccccgcccacgggggcgcccccccagagatggccagcaatcggaagtgagcaaaactgccgcaagtctgcagcccggygccaccatcctgcagcctcctcctgaccacggacgtttccatcaggttccatcccgaaaatctctcggttccacgtccccctggggcttctcctgaccca

SEQ ID NO: 8471 - DNA, 201 bp, Homo sapiens
atcccgaaaatctctcggttccacgtccccctggggcttctcctgacccagtccccgtgccccgcctccccgaaacaggctactctcctcggccccctccrtcgggctgaggaagcacagcagcatcttcaaacatgtacaaaatcgattggctttaaacacccttcacataccctccccccaaattatccccaattatcc

SEQ ID NO: 8472 - DNA, 201 bp, Homo sapiens
ggggggttgggcagggtctcctcaggtgtcaggagggtgctcggaggccacaggagggggctcctggctggcctgaggctggccggaggggaaggggctarcaggtgtgtaaacagagggttccatcaggctggggcagggtggccgccttccgcacacttgaggaaccctcccctctccctcggtgacatcttgcccgcc

SEQ ID NO: 8473 - DNA, 201 bp, Homo sapiens
gtggggaccgcggcttctacttcagcaggcccgcaagccgtgtgagccgtcgcagccgtggcatcgttgaggagtgctgtttccgcagctgtgacctggcsctcctggagacgtactgtgctacccccgccaagtccgagagggacgtgtcgacccctccgaccgtgcttccggacaacttccccagataccccgtgggca

SEQ ID NO: 8474 - DNA, 201 bp, Homo sapiens
tgtcgacccctccgaccgtgcttccggacaacttccccagataccccgtgggcaagttcttccaatatgacacctggaagcagtccacccagcgcctgcgmaggggcctgcctgccctcctgcgtgcccgccggggtcacgtgctcgccaaggagctcgaggcgttcagggaggccaaacgtcaccgtcccctgattgctc

SEQ ID NO: 8475 - DNA, 201 bp, Homo sapiens
gagggggctcctggctggcctgaggctggccggaggggaaggggctagcaggtgtgtaaacagagggttccatcaggctggggcagggtggccgccttccrcacacttgaggaaccctcccctctccctcggtgacatcttgcccgcccctcagcaccctgccttgtctccaggaggtccgaagctctgtgggacctcttg

SEQ ID NO: 8476 - DNA, 201 bp, Homo sapiens
ccgccaagtccgagagggacgtgtcgacccctccgaccgtgcttccggacaacttccccagataccccgtgggcaagttcttccaatatgacacctggaakcagtccacccagcgcctgcgcaggggcctgcctgccctcctgcgtgcccgccggggtcacgtgctcgccaaggagctcgaggcgttcagggaggccaaac

SEQ ID NO: 8477 - DNA, 201 bp, Homo sapiens
aaaggaatttggcactccccacccccctctttctcttctcccttggactttgagtcaaattggcctggacttgagtccctgaaccagcaaagagaaaagamgggccccagaaatcacaggtgggcacgtcgctgctaccgccatctcccttctcacgggaattttcagggtaaactggccatccgaaaatagcaacaaccc

SEQ ID NO: 8478 - DNA, 201 bp, Homo sapiens; identical to SEQ ID NO: 8452

SEQ ID NO: 8479 - DNA, 201 bp, Homo sapiens
ccccgcctccccgaaacaggctactctcctcggccccctccatcgggctgaggaagcacagcagcatcttcaaacatgtacaaaatcgattggctttaaamacccttcacataccctccccccaaattatccccaattatccccacacatattagaaacaccccacaaaagctcagaaattggctttaaaaaaaacaacca

SEQ ID NO: 8480 - DNA, 201 bp, Homo sapiens; identical to SEQ ID NO: 8454

SEQ ID NO: 8481 - DNA, 193 bp, Homo sapiens; identical to SEQ ID NO: 8455

SEQ ID NO: 8482 - DNA, 201 bp, Homo sapiens; identical to SEQ ID NO: 8456

SEQ ID NO: 8483 - DNA, 201 bp, Homo sapiens; identical to SEQ ID NO: 8457

SEQ ID NO: 8484 - DNA, 201 bp, Homo sapiens; identical to SEQ ID NO: 8458

SEQ ID NO: 8485 - DNA, 201 bp, Homo sapiens; identical to SEQ ID NO: 8459

SEQ ID NO: 8486 - DNA, 195 bp, Homo sapiens
ccctcctctgccatcacctgaagacccccacgccaaacactgaatgtcacctgtgcctgccgcctcggtccaccttgcggcccgtgtttgactcaactcarctcctttaacgctaatatttccggcaaaatcccatgcttgggttttgtctttaaccttgtaacgcttgcaatcccaataaagcattaaaagtca

SEQ ID NO: 8487 - DNA, 201 bp, Homo sapiens; identical to SEQ ID NO: 8461

SEQ ID NO: 8488 - DNA, 201 bp, Homo sapiens; identical to SEQ ID NO: 8462

SEQ ID NO: 8489 - DNA, 201 bp, Homo sapiens; identical to SEQ ID NO: 8463

SEQ ID NO: 8490 - DNA, 201 bp, Homo sapiens
ttgcttgggccccggagcccacgggtctggtgatgccatagcagccaccaccgcggcgcctagggctgcggcagggactcggcctctgggaggtttacctygcccccacttgtgcccccagctcagcccccctgcacgcagcccgactagcagtctagaggcctgaggcttctgggtcctggtgacggggctggcatgacc

SEQ ID NO: 8491 - DNA, 201 bp, Homo sapiens; identical to SEQ ID NO: 8465

SEQ ID NO: 8492 - DNA, 201 bp, Homo sapiens; identical to SEQ ID NO: 8466

SEQ ID NO: 8493 - DNA, 201 bp, Homo sapiens; identical to SEQ ID NO: 8467

SEQ ID NO: 8494 - DNA, 201 bp, Homo sapiens; identical to SEQ ID NO: 8468

SEQ ID NO: 8495 - DNA, 201 bp, Homo sapiens
cccctggggcttctcctgacccagtccccgtgccccgcctccccgaaacaggctactctcctcggccccctccatcgggctgaggaagcacagcagcatcwtcaaacatgtacaaaatcgattggctttaaacacccttcacataccctccccccaaattatccccaattatccccacacatattagaaacaccccacaaa

SEQ ID NO: 8496 - DNA, 201 bp, Homo sapiens; identical to SEQ ID NO: 8470

SEQ ID NO: 8497 - DNA, 201 bp, Homo sapiens; identical to SEQ ID NO: 8471

SEQ ID NO: 8498 - DNA, 201 bp, Homo sapiens; identical to SEQ ID NO: 8472

SEQ ID NO: 8499 - DNA, 201 bp, Homo sapiens
gcggcttctacttcagacttccaggcaggcccgcaagccgtgtgagccgtcgcagccgtggcatcgttgaggagtgctgtttccgcagctgtgacctggcsctcctggagacgtactgtgctacccccgccaagtccgagagggacgtgtcgacccctccgaccgtgcttccggacaacttccccagataccccgtgggca

SEQ ID NO: 8500 - DNA, 201 bp, Homo sapiens; identical to SEQ ID NO: 8474

SEQ ID NO: 8501 - DNA, 201 bp, Homo sapiens; identical to SEQ ID NO: 8475

SEQ ID NO: 8502 - DNA, 201 bp, Homo sapiens; identical to SEQ ID NO: 8476

SEQ ID NO: 8503 - DNA, 201 bp, Homo sapiens; identical to SEQ ID NO: 8477

SEQ ID NO: 8504 - DNA, 201 bp, Homo sapiens; identical to SEQ ID NO: 8465

SEQ ID NO: 8505 - DNA, 201 bp, Homo sapiens; identical to SEQ ID NO: 8453

SEQ ID NO: 8506 - DNA, 201 bp, Homo sapiens; identical to SEQ ID NO: 8466

SEQ ID NO: 8507 - DNA, 201 bp, Homo sapiens; identical to SEQ ID NO: 8456

SEQ ID NO: 8508 - DNA, 201 bp, Homo sapiens; identical to SEQ ID NO: 8468

SEQ ID NO: 8509 - DNA, 201 bp, Homo sapiens; identical to SEQ ID NO: 8457

SEQ ID NO: 8510 - DNA, 201 bp, Homo sapiens; identical to SEQ ID NO: 8458

SEQ ID NO: 8511 - DNA, 201 bp, Homo sapiens; identical to SEQ ID NO: 8462

SEQ ID NO: 8512 - DNA, 201 bp, Homo sapiens; identical to SEQ ID NO: 8470

SEQ ID NO: 8513 - DNA, 201 bp, Homo sapiens; identical to SEQ ID NO: 8469

SEQ ID NO: 8514 - DNA, 201 bp, Homo sapiens; identical to SEQ ID NO: 8471

SEQ ID NO: 8515 - DNA, 201 bp, Homo sapiens; identical to SEQ ID NO: 8473

SEQ ID NO: 8516 - DNA, 201 bp, Homo sapiens; identical to SEQ ID NO: 8474

SEQ ID NO: 8517 - DNA, 201 bp, Homo sapiens; identical to SEQ ID NO: 8476

SEQ ID NO: 8518 - DNA, 201 bp, Homo sapiens; identical to SEQ ID NO: 8477

SEQ ID NO: 8519 - DNA, 201 bp, Homo sapiens
agtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaagtaagtatgaaggaggctgatccctgagatccttgggatcttgtgtttgggagc

SEQ ID NO: 8520 - DNA, 201 bp, Homo sapiens
gcacagactgacagaatgaacctgcagaccctgcgcggctactacaaccagagcgaggccagttctcacaccctccagtggatgattggctgcgacctggkgtccgacggacgcctcctccgcgggtatgaacagtatgcctacgatggcaaggattacctcgccctgaacgaggacctgcgctcctggaccgcagcggac

SEQ ID NO: 8521 - DNA, 201 bp, Homo sapiens
ccaaggcccacgcacagactgacagaatgaacctgcagaccctgcgcggctactacaaccagagcgaggccagttctcacaccctccagtggatgattggytgcgacctggggtccgacggacgcctcctccgcgggtatgaacagtatgcctacgatggcaaggattacctcgccctgaacgaggacctgcgctcctgga

SEQ ID NO: 8522 - DNA, 201 bp, Homo sapiens
gggcgggctcccactccatgaggtatttcagcgccgccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 8523 - DNA, 201 bp, Homo sapiens
gacctgggcgggctcccactccatgaggtatttcagcgccgccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 8524 - DNA, 201 bp, Homo sapiens
acccaggacgtggagctcgtggagaccaggcctgcaggggatggaaccttccagaagtgggcagctgtggtggtgccttctggagaggagcagagatacaygtgccatgtgcagcatgaggggctgccggagcccctcatgctgagatggaagcagtcttccctgcccaccatccccatcatgggtatcgttgctggcctg

SEQ ID NO: 8525 - DNA, 201 bp, Homo sapiens
aaaggagagcctacctggagggcacgtgcgtggagtggctccacagatacctggagaacgggaaggagatgctgcagcgcgcggacccccccaagacacaygtgacccaccaccctgtctttgactatgaggccaccctgaggtgctgggccctgggcttctaccctgcggagatcatactgacctggcagcgggatgggg

SEQ ID NO: 8526 - DNA, 201 bp, Homo sapiens
acacgtgccatgtgcagcatgaggggctgccggagcccctcatgctgagatggaagcagtcttccctgcccaccatccccatcatgggtatcgttgctggyctggttgtccttgcagctgtagtcactggagctgcggtcgctgctgtgctgtggagaaagaagagctcagattgaaaaggagggagctactctcaggctg

SEQ ID NO: 8527 - DNA, 178 bp, Homo sapiens
cagaaaaggggctgggatgtctccgtctctgtctcaaatttgtggtgcactgagctataacttacttctgtattaaaattagaatctgagtataaatttastttttcaaattatttccaagagagattgatgggttaattaaaggagaagattcctgaaatttgagagacaaaataaa

SEQ ID NO: 8528 - DNA, 201 bp, Homo sapiens
tctctcacggcttgtaaatgtgacaccccggggggcctgatgtgtgtgggttgttgaggggaacagtggacatagctgtgctatgaggtttctttgacttsaatgtattgagcatgtgatgggctgtttaaagtgtcacccctcactgtgactgatatgaatttgttcatgaatatttttctgtagtgtgaaacagctgcc

SEQ ID NO: 8529 - DNA, 201 bp, Homo sapiens
cccaggacgtggagctcgtggagaccaggcctgcaggggatggaaccttccagaagtgggcagctgtggtggtgccttctggagaggagcagagatacacrtgccatgtgcagcatgaggggctgccggagcccctcatgctgagatggaagcagtcttccctgcccaccatccccatcatgggtatcgttgctggcctgg

SEQ ID NO: 8530 - DNA, 201 bp, Homo sapiens
tctaggcagtgacagtgcccagggctctaatgtgtctctcacggcttgtaaatgtgacaccccggggggcctgatgtgtgtgggttgttgaggggaacagbggacatagctgtgctatgaggtttctttgacttgaatgtattgagcatgtgatgggctgtttaaagtgtcacccctcactgtgactgatatgaatttgtt

SEQ ID NO: 8531 - DNA, 187 bp, Homo sapiens
ttcctgttccagaaaaggggctgggatgtctccgtctctgtctcaaatttgtggtgcactgagctataacttacttctgtattaaaattagaatctgagtrtaaatttactttttcaaattatttccaagagagattgatgggttaattaaaggagaagattcctgaaatttgagagacaaaataaa

SEQ ID NO: 8532 - DNA, 201 bp, Homo sapiens
gaacctgcagaccctgcgcggctactacaaccagagcgaggccagttctcacaccctccagtggatgattggctgcgacctggggtccgacggacgcctcmtccgcgggtatgaacagtatgcctacgatggcaaggattacctcgccctgaacgaggacctgcgctcctggaccgcagcggacactgcggctcagatctc

SEQ ID NO: 8533 - DNA, 201 bp, Homo sapiens
ttctactctaggcagtgacagtgcccagggctctaatgtgtctctcacggcttgtaaatgtgacaccccggggggcctgatgtgtgtgggttgttgagggvaacagtggacatagctgtgctatgaggtttctttgacttgaatgtattgagcatgtgatgggctgtttaaagtgtcacccctcactgtgactgatatgaa

SEQ ID NO: 8534 - DNA, 201 bp, Homo sapiens
tgaccctcttcctcatgctgaactgcattccttccccaatcacctttcctgttccagaaaaggggctgggatgtctccgtctctgtctcaaatttgtggtscactgagctataacttacttctgtattaaaattagaatctgagtataaatttactttttcaaattatttccaagagagattgatgggttaattaaaggag

SEQ ID NO: 8535 - DNA, 201 bp, Homo sapiens
ccatgggctacgtggacgacacgcagttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggcca

SEQ ID NO: 8536 - DNA, 201 bp, Homo sapiens
ctgatatgaatttgttcatgaatatttttctgtagtgtgaaacagctgccctgtgtgggactgagtggcaagtccctttgtgacttcaagaaccctgactyctctttctgcagagaccagcccacccctgtgcccaccatgaccctcttcctcatgctgaactgcattccttccccaatcacctttcctgttccagaaaag

SEQ ID NO: 8537 - DNA, 201 bp, Homo sapiens
gaatttgttcatgaatatttttctgtagtgtgaaacagctgccctgtgtgggactgagtggcaagtccctttgtgacttcaagaaccctgacttctctttstgcagagaccagcccacccctgtgcccaccatgaccctcttcctcatgctgaactgcattccttccccaatcacctttcctgttccagaaaaggggctgg

SEQ ID NO: 8538 - DNA, 147 bp, Homo sapiens
tctcaaatttgtggtgcactgagctataacttacttctgtattaaaattagaatctgagtataaatttactttttcaaattatttccaagagagattgatdggttaattaaaggagaagattcctgaaatttgagagacaaaataaa

SEQ ID NO: 8539 - DNA, 201 bp, Homo sapiens
agtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcg

SEQ ID NO: 8540 - DNA, 149 bp, Homo sapiens
cccattaggtgacaggtttttagagaagccaatcagcgtcgccgcggtyctggttctaaagtcctcgctcacccacccggactcattctccccagacgccaaggatggtggtcatggcgccccgaaccctcttcctgctgctctcgggg

SEQ ID NO: 8541 - DNA, 201 bp, Homo sapiens
cgccgcggtcctggttctaaagtcctcgctcacccacccggactcattctccccagacgccaaggatggtggtcatggcgccccgaaccctcttcctgctrctctcgggggccctgaccctgaccgagacctgggcgggctcccactccatgaggtatttcagcgccgccgtgtcccggcccggccgcggggagccccgct

SEQ ID NO: 8542 - DNA, 201 bp, Homo sapiens
ggcctgcaggggatggaaccttccagaagtgggcagctgtggtggtgccttctggagaggagcagagatacacgtgccatgtgcagcatgaggggctgccrgagcccctcatgctgagatggaagcagtcttccctgcccaccatccccatcatgggtatcgttgctggcctggttgtccttgcagctgtagtcactggag

SEQ ID NO: 8543 - DNA, 201 bp, Homo sapiens
tttagagaagccaatcagcgtcgccgcggtcctggttctaaagtcctcgctcacccacccggactcattctccccagacgccaaggatggtggtcatggcrccccgaaccctcttcctgctgctctcgggggccctgaccctgaccgagacctgggcgggctcccactccatgaggtatttcagcgccgccgtgtcccggc

SEQ ID NO: 8544 - DNA, 201 bp, Homo sapiens
acagaatgaacctgcagaccctgcgcggctactacaaccagagcgaggccagttctcacaccctccagtggatgattggctgcgacctggggtccgacggwcgcctcctccgcgggtatgaacagtatgcctacgatggcaaggattacctcgccctgaacgaggacctgcgctcctggaccgcagcggacactgcggctc

SEQ ID NO: 8545 - DNA, 201 bp, Homo sapiens
gggaagaggagacacggaacaccaaggcccacgcacagactgacagaatgaacctgcagaccctgcgcggctactacaaccagagcgaggccagttctcayaccctccagtggatgattggctgcgacctggggtccgacggacgcctcctccgcgggtatgaacagtatgcctacgatggcaaggattacctcgccctga

SEQ ID NO: 8546 - DNA, 201 bp, Homo sapiens
aaaggagggagctactctcaggctgcaatgtgaaacagctgccctgtgtgggactgagtggcaagtccctttgtgacttcaagaaccctgacttctctttstgcagagaccagcccacccctgtgcccaccatgaccctcttcctcatgctgaactgcattccttccccaatcacctttcctgttccagaaaaggggctgg

SEQ ID NO: 8547 - DNA, 168 bp, Homo sapiens
tctcaaatttgtggtgcactgagctataacttacttctgtattaaaattagaatctgagtataaatttactttttcaaattatttccaagagagattgatdggttaattaaaggagaagattcctgaaatttgagagacaaaataaatggaagacatgagaactttcc

SEQ ID NO: 8548 - DNA, 201 bp, Homo sapiens
agtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaa

SEQ ID NO: 8549 - DNA, 166 bp, Homo sapiens
gccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 8550 - DNA, 161 bp, Homo sapiens
gccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 8551 - DNA, 201 bp, Homo sapiens; identical to SEQ ID NO: 8542

SEQ ID NO: 8552 - DNA, 201 bp, Homo sapiens; identical to SEQ ID NO: 8526

SEQ ID NO: 8553 - DNA, 201 bp, Homo sapiens; identical to SEQ ID NO: 8524

SEQ ID NO: 8554 - DNA, 201 bp, Homo sapiens; identical to SEQ ID NO: 8529

SEQ ID NO: 8555 - DNA, 199 bp, Homo sapiens
cagaaaaggggctgggatgtctccgtctctgtctcaaatttgtggtgcactgagctataacttacttctgtattaaaattagaatctgagtataaatttastttttcaaattatttccaagagagattgatgggttaattaaaggagaagattcctgaaatttgagagacaaaataaatggaagacatgagaactttcc

SEQ ID NO: 8556 - DNA, 201 bp, Homo sapiens
ttcctgttccagaaaaggggctgggatgtctccgtctctgtctcaaatttgtggtgcactgagctataacttacttctgtattaaaattagaatctgagtrtaaatttactttttcaaattatttccaagagagattgatgggttaattaaaggagaagattcctgaaatttgagagacaaaataaatggaagacatgaga

SEQ ID NO: 8557 - DNA, 201 bp, Homo sapiens; identical to SEQ ID NO: 8534

SEQ ID NO: 8558 - DNA, 201 bp, Homo sapiens
agattgaaaaggagggagctactctcaggctgcaatgtgaaacagctgccctgtgtgggactgagtggcaagtccctttgtgacttcaagaaccctgactyctctttctgcagagaccagcccacccctgtgcccaccatgaccctcttcctcatgctgaactgcattccttccccaatcacctttcctgttccagaaaag

SEQ ID NO: 8559 - DNA, 201 bp, Homo sapiens; identical to SEQ ID NO: 8535

SEQ ID NO: 8560 - DNA, 201 bp, Homo sapiens
caggatggagccggaggggccggaatattgggaagaggagacagggaccgccaaggccaaagcacagttttaccgagtgaacctgcggaccctgagcggcyactacaaccagagtgaggcctgtgagtgacaccggccgggggcgcagatcactacccctctacatcccccacggaccgcccgggtctccccgagtctctg

SEQ ID NO: 8561 - DNA, 201 bp, Homo sapiens
gacaccggccgggggcgcagatcactacccctctacatcccccacggaccgcccgggtctccccgagtctctgggtccgagatccacgccgaggcagcggvacctggagaccctttacccgggagaggcccaggagccgttacccggtttcattttcagccaaaatccccgcaggggctgccagccacacagagtcatgga

SEQ ID NO: 8562 - DNA, 201 bp, Homo sapiens
cgcagatcactacccctctacatcccccacggaccgcccgggtctccccgagtctctgggtccgagatccacgccgaggcagcggaacctggagacccttbacccgggagaggcccaggagccgttacccggtttcattttcagccaaaatccccgcaggggctgccagccacacagagtcatggacaggtctctacagac

SEQ ID NO: 8563 - DNA, 201 bp, Homo sapiens
aaagcacagttttaccgagtgaacctgcggaccctgagcggctactacaaccagagtgaggcctgtgagtgacaccggccgggggcgcagatcactacccstctacatcccccacggaccgcccgggtctccccgagtctctgggtccgagatccacgccgaggcagcggaacctggagaccctttacccgggagaggccc

SEQ ID NO: 8564 - DNA, 201 bp, Homo sapiens
tccactccttgaggtatttccacaccaccatgtcccggcccggccgcgcggatccccgcttcctctccgtgggcgacgtggacgacacgcagtgcgtgcgsctcgacagcgacgccacgagtcccaggatggagccggaggggccggaatattgggaagaggagacagggaccgccaaggccaaagcacagttttaccgag

SEQ ID NO: 8565 - DNA, 184 bp, Homo sapiens
attaggagatgtcctggactcacacagaaactcagggctatggaatgaagggcaagctcactctctggcaacaagctccctggvgtgatttttcttctagaagagtccacggggacagggtttctcttctccctctcccaacctgtgtcgggtccttcttcctggatactcaccaggctgcccc

SEQ ID NO: 8566 - DNA, 201 bp, Homo sapiens
tggcaacaagctccctggagtgatttttcttctagaagagtccacggggacagggtttctcttctccctctcccaacctgtgtcgggtccttcttcctggmtactcaccaggctgccccagttctcactcccattgagtgtcgggttcctagagaagccaatcaatgtagccgcggtcccggttctaaagttcccacgcac

SEQ ID NO: 8567 - DNA, 201 bp, Homo sapiens
gctccctggagtgatttttcttctagaagagtccacggggacagggtttctcttctccctctcccaacctgtgtcgggtccttcttcctggatactcaccmggctgccccagttctcactcccattgagtgtcgggttcctagagaagccaatcaatgtagccgcggtcccggttctaaagttcccacgcacccaccggga

SEQ ID NO: 8568 - DNA, 201 bp, Homo sapiens
ggacagggtttctcttctccctctcccaacctgtgtcgggtccttcttcctggatactcaccaggctgccccagttctcactcccattgagtgtcgggttyctagagaagccaatcaatgtagccgcggtcccggttctaaagttcccacgcacccaccgggactccgattctccccagtcgccgaggatggtgtcatggc

SEQ ID NO: 8569 - DNA, 201 bp, Homo sapiens
gttctcactcccattgagtgtcgggttcctagagaagccaatcaatgtagccgcggtcccggttctaaagttcccacgcacccaccgggactccgattctycccagtcgccgaggatggtgtcatggcgccccgaaccctgcttctgctgctctcgggggccctggtcctgacccagacctgggcaggcttccactccttg

SEQ ID NO: 8570 - DNA, 201 bp, Homo sapiens
cggcccggccgcgcggatccccgcttcctctccgtgggcgacgtggacgacacgcagtgcgtgcggctcgacagcgacgccacgagtcccaggatggagcmggaggggccggaatattgggaagaggagacagggaccgccaaggccaaagcacagttttaccgagtgaacctgcggaccctgagcggctactacaaccag

SEQ ID NO: 8571 - DNA, 201 bp, Homo sapiens
gagtgaacctgcggaccctgagcggctactacaaccagagtgaggcctgtgagtgacaccggccgggggcgcagatcactacccctctacatcccccacgraccgcccgggtctccccgagtctctgggtccgagatccacgccgaggcagcggaacctggagaccctttacccgggagaggcccaggagccgttacccgg

SEQ ID NO: 8572 - DNA, 201 bp, Homo sapiens
cgccaaggccaaagcacagttttaccgagtgaacctgcggaccctgagcggctactacaaccagagtgaggcctgtgagtgacaccggccgggggcgcagvtcactacccctctacatcccccacggaccgcccgggtctccccgagtctctgggtccgagatccacgccgaggcagcggaacctggagaccctttacccg

SEQ ID NO: 8573 - DNA, 201 bp, Homo sapiens
gcacagttttaccgagtgaacctgcggaccctgagcggctactacaaccagagtgaggcctgtgagtgacaccggccgggggcgcagatcactacccctcyacatcccccacggaccgcccgggtctccccgagtctctgggtccgagatccacgccgaggcagcggaacctggagaccctttacccgggagaggcccagg

SEQ ID NO: 8574 - DNA, 201 bp, Homo sapiens; identical to SEQ ID NO: 8539

SEQ ID NO: 8575 - DNA, 201 bp, Homo sapiens; identical to SEQ ID NO: 8520

SEQ ID NO: 8576 - DNA, 201 bp, Homo sapiens; identical to SEQ ID NO: 8521

SEQ ID NO: 8577 - DNA, 201 bp, Homo sapiens
gggcaggctcccactccatgaggtatttcagcgccgccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 8578 - DNA, 201 bp, Homo sapiens
gacctgggcaggctcccactccatgaggtatttcagcgccgccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 8579 - DNA, 176 bp, Homo sapiens
gcgtggagtggctccacagatacctggagaacgggaaggagatgctgcagcgcgcggggccatcttcccagcccacattcctcatcatgggcatcgttacygtcctggttgttctaggtgctgtggtcactgctgtgatgtggaagaataagaccccaggtaggaaaggggtgagt

SEQ ID NO: 8580 - DNA, 201 bp, Homo sapiens; identical to SEQ ID NO: 8544

SEQ ID NO: 8581 - DNA, 182 bp, Homo sapiens
gcacgtgcgtggagtggctccacagatacctggagaacgggaaggagatgctgcagcgcgcggggccatcttcccagcccacattcctcatcatgggcatygttaccgtcctggttgttctaggtgctgtggtcactgctgtgatgtggaagaataagaccccaggtaggaaaggggtgagt

SEQ ID NO: 8582 - DNA, 190 bp, Homo sapiens
cctggagggcacgtgcgtggagtggctccacagatacctggagaacgggaaggagatgctgcagcgcgcggggccatcttcccagcccacattcctcatcrtgggcatcgttaccgtcctggttgttctaggtgctgtggtcactgctgtgatgtggaagaataagaccccaggtaggaaaggggtgagt

SEQ ID NO: 8583 - DNA, 195 bp, Homo sapiens
gcctacctggagggcacgtgcgtggagtggctccacagatacctggagaacgggaaggagatgctgcagcgcgcggggccatcttcccagcccacattccycatcatgggcatcgttaccgtcctggttgttctaggtgctgtggtcactgctgtgatgtggaagaataagaccccaggtaggaaaggggtgagt

SEQ ID NO: 8584 - DNA, 201 bp, Homo sapiens; identical to SEQ ID NO: 8532

SEQ ID NO: 8585 - DNA, 201 bp, Homo sapiens; identical to SEQ ID NO: 8545

SEQ ID NO: 8586 - DNA, 201 bp, Homo sapiens; identical to SEQ ID NO: 8535

SEQ ID NO: 8587 - DNA, 201 bp, Homo sapiens; identical to SEQ ID NO: 8548

SEQ ID NO: 8588 - DNA, 201 bp, Homo sapiens; identical to SEQ ID NO: 8520

SEQ ID NO: 8589 - DNA, 201 bp, Homo sapiens; identical to SEQ ID NO: 8521

SEQ ID NO: 8590 - DNA, 201 bp, Homo sapiens; identical to SEQ ID NO: 8522

SEQ ID NO: 8591 - DNA, 201 bp, Homo sapiens; identical to SEQ ID NO: 8523

SEQ ID NO: 8592 - DNA, 201 bp, Homo sapiens; identical to SEQ ID NO: 8524

SEQ ID NO: 8593 - DNA, 201 bp, Homo sapiens; identical to SEQ ID NO: 8525

SEQ ID NO: 8594 - DNA, 201 bp, Homo sapiens; identical to SEQ ID NO: 8526

SEQ ID NO: 8595 - DNA, 199 bp, Homo sapiens; identical to SEQ ID NO: 8555

SEQ ID NO: 8596 - DNA, 201 bp, Homo sapiens; identical to SEQ ID NO: 8529

SEQ ID NO: 8597 - DNA, 201 bp, Homo sapiens; identical to SEQ ID NO: 8556

SEQ ID NO: 8598 - DNA, 201 bp, Homo sapiens; identical to SEQ ID NO: 8532

SEQ ID NO: 8599 - DNA, 201 bp, Homo sapiens; identical to SEQ ID NO: 8534

SEQ ID NO: 8600 - DNA, 201 bp, Homo sapiens; identical to SEQ ID NO: 8535

SEQ ID NO: 8601 - DNA, 201 bp, Homo sapiens; identical to SEQ ID NO: 8558

SEQ ID NO: 8602 - DNA, 201 bp, Homo sapiens; identical to SEQ ID NO: 8546

SEQ ID NO: 8603 - DNA, 168 bp, Homo sapiens; identical to SEQ ID NO: 8547

SEQ ID NO: 8604 - DNA, 201 bp, Homo sapiens; identical to SEQ ID NO: 8539

SEQ ID NO: 8605 - DNA, 149 bp, Homo sapiens; identical to SEQ ID NO: 8540

SEQ ID NO: 8606 - DNA, 201 bp, Homo sapiens; identical to SEQ ID NO: 8541

SEQ ID NO: 8607 - DNA, 201 bp, Homo sapiens; identical to SEQ ID NO: 8542

SEQ ID NO: 8608 - DNA, 201 bp, Homo sapiens; identical to SEQ ID NO: 8543

SEQ ID NO: 8609 - DNA, 201 bp, Homo sapiens; identical to SEQ ID NO: 8544

SEQ ID NO: 8610 - DNA, 201 bp, Homo sapiens; identical to SEQ ID NO: 8545

SEQ ID NO: 8611 - DNA, 201 bp, Homo sapiens; identical to SEQ ID NO: 8548

SEQ ID NO: 8612 - DNA, 201 bp, Homo sapiens; identical to SEQ ID NO: 8520

SEQ ID NO: 8613 - DNA, 201 bp, Homo sapiens; identical to SEQ ID NO: 8521

SEQ ID NO: 8614 - DNA, 201 bp, Homo sapiens; identical to SEQ ID NO: 8522

SEQ ID NO: 8615 - DNA, 201 bp, Homo sapiens; identical to SEQ ID NO: 8523

SEQ ID NO: 8616 - DNA, 201 bp, Homo sapiens; identical to SEQ ID NO: 8524

SEQ ID NO: 8617 - DNA, 201 bp, Homo sapiens; identical to SEQ ID NO: 8525

SEQ ID NO: 8618 - DNA, 201 bp, Homo sapiens; identical to SEQ ID NO: 8526

SEQ ID NO: 8619 - DNA, 199 bp, Homo sapiens; identical to SEQ ID NO: 8555

SEQ ID NO: 8620 - DNA, 201 bp, Homo sapiens; identical to SEQ ID NO: 8529

SEQ ID NO: 8621 - DNA, 201 bp, Homo sapiens; identical to SEQ ID NO: 8556

SEQ ID NO: 8622 - DNA, 201 bp, Homo sapiens; identical to SEQ ID NO: 8532

SEQ ID NO: 8623 - DNA, 201 bp, Homo sapiens; identical to SEQ ID NO: 8534

SEQ ID NO: 8624 - DNA, 201 bp, Homo sapiens; identical to SEQ ID NO: 8535

SEQ ID NO: 8625 - DNA, 201 bp, Homo sapiens; identical to SEQ ID NO: 8558

SEQ ID NO: 8626 - DNA, 201 bp, Homo sapiens; identical to SEQ ID NO: 8546

SEQ ID NO: 8627 - DNA, 168 bp, Homo sapiens; identical to SEQ ID NO: 8547

SEQ ID NO: 8628 - DNA, 201 bp, Homo sapiens; identical to SEQ ID NO: 8539

SEQ ID NO: 8629 - DNA, 201 bp, Homo sapiens
tttgtcttgaggagatgtcctggactcacacggaaacttagggctacggaatgaagacgccaaggatggtggtcatggcgccccgaaccctcttcctgctrctctcgggggccctgaccctgaccgagacctgggcgggctcccactccatgaggtatttcagcgccgccgtgtcccggcccggccgcggggagccccgct

SEQ ID NO: 8630 - DNA, 201 bp, Homo sapiens; identical to SEQ ID NO: 8542

SEQ ID NO: 8631 - DNA, 201 bp, Homo sapiens
tatagtaacatagtgtggtactttgtcttgaggagatgtcctggactcacacggaaacttagggctacggaatgaagacgccaaggatggtggtcatggcrccccgaaccctcttcctgctgctctcgggggccctgaccctgaccgagacctgggcgggctcccactccatgaggtatttcagcgccgccgtgtcccggc

SEQ ID NO: 8632 - DNA, 201 bp, Homo sapiens; identical to SEQ ID NO: 8544

SEQ ID NO: 8633 - DNA, 201 bp, Homo sapiens; identical to SEQ ID NO: 8545

SEQ ID NO: 8634 - DNA, 201 bp, Homo sapiens; identical to SEQ ID NO: 8629

SEQ ID NO: 8635 - DNA, 201 bp, Homo sapiens; identical to SEQ ID NO: 8523

SEQ ID NO: 8636 - DNA, 201 bp, Homo sapiens; identical to SEQ ID NO: 8631

SEQ ID NO: 8637 - DNA, 170 bp, Homo sapiens
ctgacagaatgaacctgcagaccctgcgcggctactacaaccagagcgaggccaagcagtcttccctgcccaccatccccatcatgggtatcgttgctggyctggttgtccttgcagctgtagtcactggagctgcggtcgctgctgtgctgtggagaaagaagagctca

SEQ ID NO: 8638 - DNA, 113 bp, Homo sapiens
agtcttccctgcccaccatccccatcatgggtatcgttgctggcctggttgtccttgcagctgtagtcactggagctgcggtcgctgctgtgctgtggagraagaagagctca

SEQ ID NO: 8639 - DNA, 201 bp, Homo sapiens; identical to SEQ ID NO: 8535

SEQ ID NO: 8640 - DNA, 201 bp, Homo sapiens; identical to SEQ ID NO: 8522

SEQ ID NO: 8641 - DNA, 161 bp, Homo sapiens; identical to SEQ ID NO: 8550

SEQ ID NO: 8642 - DNA, 170 bp, Homo sapiens; identical to SEQ ID NO: 8637

SEQ ID NO: 8643 - DNA, 113 bp, Homo sapiens; identical to SEQ ID NO: 8638

SEQ ID NO: 8644 - DNA, 201 bp, Homo sapiens; identical to SEQ ID NO: 8535

SEQ ID NO: 8645 - DNA, 166 bp, Homo sapiens; identical to SEQ ID NO: 8549

SEQ ID NO: 8646 - DNA, 201 bp, Homo sapiens; identical to SEQ ID NO: 8548

SEQ ID NO: 8647 - DNA, 201 bp, Homo sapiens; identical to SEQ ID NO: 8522

SEQ ID NO: 8648 - DNA, 201 bp, Homo sapiens; identical to SEQ ID NO: 8523

SEQ ID NO: 8649 - DNA, 201 bp, Homo sapiens; identical to SEQ ID NO: 8524

SEQ ID NO: 8650 - DNA, 201 bp, Homo sapiens; identical to SEQ ID NO: 8526

SEQ ID NO: 8651 - DNA, 201 bp, Homo sapiens
agacacggaacaccaaggcccacgcacagactgacagaatgaacctgcagaccctgcgcggctactacaaccagagcgaggccaacccccccaagacacaygtgacccaccaccctgtctttgactatgaggccaccctgaggtgctgggccctgggcttctaccctgcggagatcatactgacctggcagcgggatgggg

SEQ ID NO: 8652 - DNA, 199 bp, Homo sapiens; identical to SEQ ID NO: 8555

SEQ ID NO: 8653 - DNA, 201 bp, Homo sapiens; identical to SEQ ID NO: 8529

SEQ ID NO: 8654 - DNA, 201 bp, Homo sapiens; identical to SEQ ID NO: 8556

SEQ ID NO: 8655 - DNA, 201 bp, Homo sapiens; identical to SEQ ID NO: 8534

SEQ ID NO: 8656 - DNA, 201 bp, Homo sapiens; identical to SEQ ID NO: 8535

SEQ ID NO: 8657 - DNA, 201 bp, Homo sapiens; identical to SEQ ID NO: 8558

SEQ ID NO: 8658 - DNA, 201 bp, Homo sapiens; identical to SEQ ID NO: 8546

SEQ ID NO: 8659 - DNA, 168 bp, Homo sapiens; identical to SEQ ID NO: 8547

SEQ ID NO: 8660 - DNA, 201 bp, Homo sapiens; identical to SEQ ID NO: 8629

SEQ ID NO: 8661 - DNA, 201 bp, Homo sapiens; identical to SEQ ID NO: 8542

SEQ ID NO: 8662 - DNA, 201 bp, Homo sapiens; identical to SEQ ID NO: 8631

SEQ ID NO: 8663 - DNA, 201 bp, Homo sapiens; identical to SEQ ID NO: 8546

SEQ ID NO: 8664 - DNA, 168 bp, Homo sapiens; identical to SEQ ID NO: 8547

SEQ ID NO: 8665 - DNA, 201 bp, Homo sapiens; identical to SEQ ID NO: 8548

SEQ ID NO: 8666 - DNA, 166 bp, Homo sapiens; identical to SEQ ID NO: 8549

SEQ ID NO: 8667 - DNA, 161 bp, Homo sapiens; identical to SEQ ID NO: 8550

SEQ ID NO: 8668 - DNA, 201 bp, Homo sapiens; identical to SEQ ID NO: 8542

SEQ ID NO: 8669 - DNA, 201 bp, Homo sapiens; identical to SEQ ID NO: 8524

SEQ ID NO: 8670 - DNA, 201 bp, Homo sapiens; identical to SEQ ID NO: 8526

SEQ ID NO: 8671 - DNA, 201 bp, Homo sapiens; identical to SEQ ID NO: 8651

SEQ ID NO: 8672 - DNA, 201 bp, Homo sapiens; identical to SEQ ID NO: 8529

SEQ ID NO: 8673 - DNA, 199 bp, Homo sapiens; identical to SEQ ID NO: 8555

SEQ ID NO: 8674 - DNA, 201 bp, Homo sapiens; identical to SEQ ID NO: 8556

SEQ ID NO: 8675 - DNA, 201 bp, Homo sapiens; identical to SEQ ID NO: 8534

SEQ ID NO: 8676 - DNA, 201 bp, Homo sapiens; identical to SEQ ID NO: 8535

SEQ ID NO: 8677 - DNA, 201 bp, Homo sapiens; identical to SEQ ID NO: 8558

SEQ ID NO: 8678 - DNA, 201 bp, Homo sapiens
cgctgagggacatctggatggtcagcccttcctgcgctatgacaggcagaaacgcagggcaaagccccagggacagtgggcagaagatgtcctgggagctragacctgggacacagagaccgaggacttgacagagaatgggcaagacctcaggaggaccctgactcatatcaaggaccagaaaggaggcttgcattccct

SEQ ID NO: 8679 - DNA, 201 bp, Homo sapiens
gcagtcagggtttctcgctgagggacatctggatggtcagcccttcctgcgctatgacaggcagaaacgcagggcaaagccccagggacagtgggcagaaratgtcctgggagctgagacctgggacacagagaccgaggacttgacagagaatgggcaagacctcaggaggaccctgactcatatcaaggaccagaaagg

SEQ ID NO: 8680 - DNA, 130 bp, Homo sapiens
gtcggggccatggggctgggcccggtcttyctgcttctggctggcatcttcccttttgcacctccgggagctgctgctgagccccacagtcttcgttacaacctcatggtgctgtcccaggatggatctg

SEQ ID NO: 8681 - DNA, 201 bp, Homo sapiens
tgcctgatgggaatggaacctaccagacctgggtggccaccaggattcgccaaggagaggagcagaggttcacctgctacatggaacacagcgggaatcayggcactcaccctgtgccctctgggaaggcgctggtgcttcagagtcaacggacagactttccatatgtttctgctgctatgccatgttttgttattatta

SEQ ID NO: 8682 - DNA, 201 bp, Homo sapiens
ggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatca

SEQ ID NO: 8683 - DNA, 201 bp, Homo sapiens
gcctgatgggaatggaacctaccagacctgggtggccaccaggattcgccaaggagaggagcagaggttcacctgctacatggaacacagcgggaatcacrgcactcaccctgtgccctctgggaaggcgctggtgcttcagagtcaacggacagactttccatatgtttctgctgctatgccatgttttgttattattat

SEQ ID NO: 8684 - DNA, 201 bp, Homo sapiens
acttgacagagaatgggcaagacctcaggaggaccctgactcatatcaaggaccagaaaggaggcttgcattccctccaggagattagggtctgtgagatscatgaagacagcagcaccaggggctcccggcatttctactacaatggggagctcttcctctcccaaaacctggagactcaagaatcgacagtgccccagt

SEQ ID NO: 8685 - DNA, 201 bp, Homo sapiens
tatcaaggaccagaaaggaggcttgcattccctccaggagattagggtctgtgagatccatgaagacagcagcaccaggggctcccggcatttctactacratggggagctcttcctctcccaaaacctggagactcaagaatcgacagtgccccagtcctccagagctcagaccttggctatgaacgtcacaaatttctg

SEQ ID NO: 8686 - DNA, 201 bp, Homo sapiens
tgacctggcgtcaggatggggtatctttgagccacgacacccagcagtggggggatgtcctgcctgatgggaatggaacctaccagacctgggtggccacyaggatttgccgaggagaggagcagaggttcacctgctacatggaacacagcgggaatcacagcactcaccctgtgccctctgggaaagtgctggtgcttc

SEQ ID NO: 8687 - DNA, 201 bp, Homo sapiens
gaatggaacctaccagacctgggtggccaccaggatttgccgaggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattt

SEQ ID NO: 8688 - DNA, 201 bp, Homo sapiens
acgctatgcatgcagactgcctgcaggaactacggcgatatctagaatccggcgtagtcctgaggagaacagtgccccccatggtgaatgtcacccgcagygaggcctcagagggcaacatcaccgtgacatgcagggcttccagcttctatccccggaatatcatactgacctggcgtcaggatggggtatctttgagcc

SEQ ID NO: 8689 - DNA, 201 bp, Homo sapiens
gctgctgctgagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 8690 - DNA, 201 bp, Homo sapiens
agaacagtgccccccatggtgaatgtcacccgcagcgaggcctcagagggcaacatcaccgtgacatgcagggcttccagcttctatccccggaatatcayactgacctggcgtcaggatggggtatctttgagccacgacacccagcagtggggggatgtcctgcctgatgggaatggaacctaccagacctgggtggcc

SEQ ID NO: 8691 - DNA, 201 bp, Homo sapiens
gggcccggtcttcctgcttctggctggcatcttcccttttgcacctccgggagctgctgctgagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 8692 - DNA, 201 bp, Homo sapiens
gtgctgtcctgggatggatctgtgcagtcagggtttcttgctgaggtacatctggatggtcagcccttcctgcgctatgacaggcagaaatgcagggcaargccccagggacagtgggcagaagatgtcctgggaaataagacatgggacagagagaccagggacttgacagggaacggaaaggacctcaggatgaccctg

SEQ ID NO: 8693 - DNA, 201 bp, Homo sapiens
catgaacgtcaggaatttcttgaaggaagatgccatgaagaccaagacacactatcacgctatgcatgcagactgcctgcaggaactacggcgatatctaraatccggcgtagtcctgaggagaacagtgccccccatggtgaatgtcacccgcagcgaggcctcagagggcaacatcaccgtgacatgcagggcttccag

SEQ ID NO: 8694 - DNA, 201 bp, Homo sapiens
gccctctgggaaagtgctggtgcttcagagtcattggcagacattccatgtttctgctgttgctgctggctgctgctatttttgttattattattttctaygtccgttgttgtaagaagaaaacatcagctgcagagggtccagagctcgtgagcctgcaggtcctggatcaacacccagttgggacgagtgaccacaggg

SEQ ID NO: 8695 - DNA, 201 bp, Homo sapiens
gagactgaggaatggacagtgccccagtcctccagagctcagaccttggccatgaacgtcaggaatttcttgaaggaagatgccatgaagaccaagacacwctatcacgctatgcatgcagactgcctgcaggaactacggcgatatctagaatccggcgtagtcctgaggagaacagtgccccccatggtgaatgtcacc

SEQ ID NO: 8696 - DNA, 201 bp, Homo sapiens
gtgccccccatggtgaatgtcacccgcagcgaggcctcagagggcaacatcaccgtgacatgcagggcttccagcttctatccccggaatatcatactgasctggcgtcaggatggggtatctttgagccacgacacccagcagtggggggatgtcctgcctgatgggaatggaacctaccagacctgggtggccaccagg

SEQ ID NO: 8697 - DNA, 201 bp, Homo sapiens
ggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcctgacctatgaaacagag

SEQ ID NO: 8698 - DNA, 201 bp, Homo sapiens
agcccttcctgcgctatgacaggcagaaatgcagggcaaagccccagggacagtgggcagaagatgtcctgggaaataagacatgggacagagagaccagrgacttgacagggaacggaaaggacctcaggatgaccctggctcatatcaaggaccagaaagaaggcttgcattccctccaggagattagggtctgtgaga

SEQ ID NO: 8699 - DNA, 201 bp, Homo sapiens
tatcaaggaccagaaagaaggcttgcattccctccaggagattagggtctgtgagatccatgaagacaacagcaccaggagctcccagcatttctactacratggggagctcttcctctcccaaaacctggagactgaggaatggacagtgccccagtcctccagagctcagaccttggccatgaacgtcaggaatttctt

SEQ ID NO: 8700 - DNA, 201 bp, Homo sapiens
ttccctccaggagattagggtctgtgagatccatgaagacaacagcaccaggagctcccagcatttctactacgatggggagctcttcctctcccaaaacstggagactgaggaatggacagtgccccagtcctccagagctcagaccttggccatgaacgtcaggaatttcttgaaggaagatgccatgaagaccaagac

SEQ ID NO: 8701 - DNA, 201 bp, Homo sapiens
ggagattagggtctgtgagatccatgaagacaacagcaccaggagctcccagcatttctactacgatggggagctcttcctctcccaaaacctggagactraggaatggacagtgccccagtcctccagagctcagaccttggccatgaacgtcaggaatttcttgaaggaagatgccatgaagaccaagacacactatca

SEQ ID NO: 8702 - DNA, 201 bp, Homo sapiens
tgcaggaactacggcgatatctagaatccggcgtagtcctgaggagaacagtgccccccatggtgaatgtcacccgcagcgaggcctcagagggcaacatyaccgtgacatgcagggcttccagcttctatccccggaatatcatactgacctggcgtcaggatggggtatctttgagccacgacacccagcagtgggggg

SEQ ID NO: 8703 - DNA, 201 bp, Homo sapiens
caaggaccagaaagaaggcttgcattccctccaggagattagggtctgtgagatccatgaagacaacagcaccaggagctcccagcatttctactacgatrgggagctcttcctctcccaaaacctggagactgaggaatggacagtgccccagtcctccagagctcagaccttggccatgaacgtcaggaatttcttgaa

SEQ ID NO: 8704 - DNA, 201 bp, Homo sapiens
agtcctgaggagaacagtgccccccatggtgaatgtcacccgcagcgaggcctcagagggcaacatcaccgtgacatgcagggcttccagcttctatcccyggaatatcatactgacctggcgtcaggatggggtatctttgagccacgacacccagcagtggggggatgtcctgcctgatgggaatggaacctaccagac

SEQ ID NO: 8705 - DNA, 201 bp, Homo sapiens
ttctcttccaagcgtggccccgccctctccgctcgtgattggccctaagttccgggccccagtttcattggatgagcggtcgggggaccgggccaggtgastaagtttccgcggcgccttctccccggccactgcttgagccgctgagagggtggcgacgtcggggccatggggctgggcccggtcttcctgcttctggct

SEQ ID NO: 8706 - DNA, 201 bp, Homo sapiens
ctggatggtcagcccttcctgcgctatgacaggcagaaatgcagggcaaagccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagg

SEQ ID NO: 8707 - DNA, 201 bp, Homo sapiens
tgtcacccgcagcgaggcctcagagggcaacatcaccgtgacatgcagggcttccagcttctatccccggaatatcatactgacctggcgtcaggatgggstatctttgagccacgacacccagcagtggggggatgtcctgcctgatgggaatggaacctaccagacctgggtggccaccaggatttgccgaggagagga

SEQ ID NO: 8708 - DNA, 201 bp, Homo sapiens
gccccagtttcattggatgagcggtcgggggaccgggccaggtgactaagtttccgcggcgccttctccccggccactgcttgagccgctgagagggtggygacgtcggggccatggggctgggcccggtcttcctgcttctggctggcatcttcccttttgcacctccgggagctgctgctgagccccacagtcttcgtt

SEQ ID NO: 8709 - DNA, 201 bp, Homo sapiens
cctctcccaaaacctggagactgaggaatggacagtgccccagtcctccagagctcagaccttggccatgaacgtcaggaatttcttgaaggaagatgccrtgaagaccaagacacactatcacgctatgcatgcagactgcctgcaggaactacggcgatatctagaatccggcgtagtcctgaggagaacagtgccccc

SEQ ID NO: 8710 - DNA, 201 bp, Homo sapiens
tagaatccggcgtagtcctgaggagaacagtgccccccatggtgaatgtcacccgcagcgaggcctcagagggcaacatcaccgtgacatgcagggcttcyagcttctatccccggaatatcatactgacctggcgtcaggatggggtatctttgagccacgacacccagcagtggggggatgtcctgcctgatgggaatg

SEQ ID NO: 8711 - DNA, 201 bp, Homo sapiens
atatcaaggaccagaaagaaggcttgcattccctccaggagattagggtctgtgagatccatgaagacaacagcaccaggagctcccagcatttctactaygatggggagctcttcctctcccaaaacctggagactgaggaatggacagtgccccagtcctccagagctcagaccttggccatgaacgtcaggaatttct

SEQ ID NO: 8712 - DNA, 201 bp, Homo sapiens
caggatggggtatctttgagccacgacacccagcagtggggggatgtcctgcctgatgggaatggaacctaccagacctgggtggccaccaggatttgccraggagaggagcagaggttcacctgctacatggaacacagcgggaatcacagcactcaccctgtgccctctgggaaagtgctggtgcttcagagtcattgg

SEQ ID NO: 8713 - DNA, 201 bp, Homo sapiens
agaatccggcgtagtcctgaggagaacagtgccccccatggtgaatgtcacccgcagcgaggcctcagagggcaacatcaccgtgacatgcagggcttccrgcttctatccccggaatatcatactgacctggcgtcaggatggggtatctttgagccacgacacccagcagtggggggatgtcctgcctgatgggaatgg

SEQ ID NO: 8714 - DNA, 201 bp, Homo sapiens
ctggctccactgagggcacctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaatt

SEQ ID NO: 8715 - DNA, 201 bp, Homo sapiens
tctgggaaagtgctggtgcttcagagtcattggcagacattccatgtttctgctgttgctgctggctgctgctatttttgttattattattttctatgtcygttgttgtaagaagaaaacatcagctgcagagggtccagagctcgtgagcctgcaggtcctggatcaacacccagttgggacgagtgaccacagggatgc

SEQ ID NO: 8716 - DNA, 201 bp, Homo sapiens
cgggccaggtgactaagtttccgcggcgccttctccccggccactgcttgagccgctgagagggtggcgacgtcggggccatggggctgggcccggtcttyctgcttctggctggcatcttcccttttgcacctccgggagctgctgctgagccccacagtcttcgttataacctcacggtgctgtcctgggatggatctg

SEQ ID NO: 8717 - DNA, 201 bp, Homo sapiens
gtggccccgccctctccgctcgtgattggccctaagttccgggccccagtttcattggatgagcggtcgggggaccgggccaggtgactaagtttccgcgrcgccttctccccggccactgcttgagccgctgagagggtggcgacgtcggggccatggggctgggcccggtcttcctgcttctggctggcatcttccctt

SEQ ID NO: 8718 - DNA, 201 bp, Homo sapiens
gcatttctactacgatggggagctcttcctctcccaaaacctggagactgaggaatggacagtgccccagtcctccagagctcagaccttggccatgaacrtcaggaatttcttgaaggaagatgccatgaagaccaagacacactatcacgctatgcatgcagactgcctgcaggaactacggcgatatctagaatccgg

SEQ ID NO: 8719 - DNA, 201 bp, Homo sapiens
tcttcccttttgcacctccgggagctgctgctgagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 8720 - DNA, 201 bp, Homo sapiens
gaccttggccatgaacgtcaggaatttcttgaaggaagatgccatgaagaccaagacacactatcacgctatgcatgcagactgcctgcaggaactacggygatatctagaatccggcgtagtcctgaggagaacagtgccccccatggtgaatgtcacccgcagcgaggcctcagagggcaacatcaccgtgacatgcag

SEQ ID NO: 8721 - DNA, 201 bp, Homo sapiens
ctgtgagatccatgaagacaacagcaccaggagctcccagcatttctactacgatggggagctcttcctctcccaaaacctggagactgaggaatggacartgccccagtcctccagagctcagaccttggccatgaacgtcaggaatttcttgaaggaagatgccatgaagaccaagacacactatcacgctatgcatgc

SEQ ID NO: 8722 - DNA, 201 bp, Homo sapiens
cttcccttttgcacctccgggagctgctgctgagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 8723 - DNA, 201 bp, Homo sapiens
cgtcaggaatttcttgaaggaagatgccatgaagaccaagacacactatcacgctatgcatgcagactgcctgcaggaactacggcgatatctagaatccrgcgtagtcctgaggagaacagtgccccccatggtgaatgtcacccgcagcgaggcctcagagggcaacatcaccgtgacatgcagggcttccagcttcta

SEQ ID NO: 8724 - DNA, 201 bp, Homo sapiens
cacagtcttcgttataacctcacggtgctgtcctgggatggatctgtgcagtcagggtttcttgctgaggtacatctggatggtcagcccttcctgcgctrtgacaggcagaaatgcagggcaaagccccagggacagtgggcagaagatgtcctgggaaataagacatgggacagagagaccagggacttgacagggaac

SEQ ID NO: 8725 - DNA, 201 bp, Homo sapiens
gaagatgccatgaagaccaagacacactatcacgctatgcatgcagactgcctgcaggaactacggcgatatctagaatccggcgtagtcctgaggagaasagtgccccccatggtgaatgtcacccgcagcgaggcctcagagggcaacatcaccgtgacatgcagggcttccagcttctatccccggaatatcatactg

SEQ ID NO: 8726 - DNA, 201 bp, Homo sapiens
ggcgacgtcggggccatggggctgggcccggtcttcctgcttctggctggcatcttcccttttgcacctccgggagctgctgctgagccccacagtcttcsttataacctcacggtgctgtcctgggatggatctgtgcagtcagggtttcttgctgaggtacatctggatggtcagcccttcctgcgctatgacaggcag

SEQ ID NO: 8727 - DNA, 201 bp, Homo sapiens; identical to SEQ ID NO: 8678

SEQ ID NO: 8728 - DNA, 201 bp, Homo sapiens; identical to SEQ ID NO: 8679

SEQ ID NO: 8729 - DNA, 201 bp, Homo sapiens; identical to SEQ ID NO: 8681

SEQ ID NO: 8730 - DNA, 201 bp, Homo sapiens; identical to SEQ ID NO: 8682

SEQ ID NO: 8731 - DNA, 201 bp, Homo sapiens; identical to SEQ ID NO: 8683

SEQ ID NO: 8732 - DNA, 201 bp, Homo sapiens; identical to SEQ ID NO: 8685

SEQ ID NO: 8733 - DNA, 201 bp, Homo sapiens; identical to SEQ ID NO: 8684

SEQ ID NO: 8734 - DNA, 201 bp, Homo sapiens; identical to SEQ ID NO: 8686

SEQ ID NO: 8735 - DNA, 201 bp, Homo sapiens; identical to SEQ ID NO: 8687

SEQ ID NO: 8736 - DNA, 201 bp, Homo sapiens; identical to SEQ ID NO: 8688

SEQ ID NO: 8737 - DNA, 201 bp, Homo sapiens; identical to SEQ ID NO: 8689

SEQ ID NO: 8738 - DNA, 201 bp, Homo sapiens; identical to SEQ ID NO: 8690

SEQ ID NO: 8739 - DNA, 201 bp, Homo sapiens; identical to SEQ ID NO: 8691

SEQ ID NO: 8740 - DNA, 201 bp, Homo sapiens; identical to SEQ ID NO: 8692

SEQ ID NO: 8741 - DNA, 201 bp, Homo sapiens; identical to SEQ ID NO: 8693

SEQ ID NO: 8742 - DNA, 201 bp, Homo sapiens; identical to SEQ ID NO: 8694

SEQ ID NO: 8743 - DNA, 201 bp, Homo sapiens; identical to SEQ ID NO: 8695

SEQ ID NO: 8744 - DNA, 201 bp, Homo sapiens; identical to SEQ ID NO: 8696

SEQ ID NO: 8745 - DNA, 201 bp, Homo sapiens; identical to SEQ ID NO: 8697

SEQ ID NO: 8746 - DNA, 201 bp, Homo sapiens; identical to SEQ ID NO: 8698

SEQ ID NO: 8747 - DNA, 201 bp, Homo sapiens; identical to SEQ ID NO: 8699

SEQ ID NO: 8748 - DNA, 201 bp, Homo sapiens; identical to SEQ ID NO: 8700

SEQ ID NO: 8749 - DNA, 201 bp, Homo sapiens; identical to SEQ ID NO: 8701

SEQ ID NO: 8750 - DNA, 201 bp, Homo sapiens; identical to SEQ ID NO: 8702

SEQ ID NO: 8751 - DNA, 201 bp, Homo sapiens; identical to SEQ ID NO: 8703

SEQ ID NO: 8752 - DNA, 201 bp, Homo sapiens; identical to SEQ ID NO: 8704

SEQ ID NO: 8753 - DNA, 201 bp, Homo sapiens; identical to SEQ ID NO: 8705

SEQ ID NO: 8754 - DNA, 201 bp, Homo sapiens; identical to SEQ ID NO: 8706

SEQ ID NO: 8755 - DNA, 201 bp, Homo sapiens; identical to SEQ ID NO: 8707

SEQ ID NO: 8756 - DNA, 201 bp, Homo sapiens; identical to SEQ ID NO: 8708

SEQ ID NO: 8757 - DNA, 201 bp, Homo sapiens; identical to SEQ ID NO: 8709

SEQ ID NO: 8758 - DNA, 201 bp, Homo sapiens; identical to SEQ ID NO: 8710

SEQ ID NO: 8759 - DNA, 201 bp, Homo sapiens; identical to SEQ ID NO: 8711

SEQ ID NO: 8760 - DNA, 201 bp, Homo sapiens; identical to SEQ ID NO: 8712

SEQ ID NO: 8761 - DNA, 201 bp, Homo sapiens; identical to SEQ ID NO: 8713

SEQ ID NO: 8762 - DNA, 201 bp, Homo sapiens; identical to SEQ ID NO: 8714

SEQ ID NO: 8763 - DNA, 201 bp, Homo sapiens; identical to SEQ ID NO: 8715

SEQ ID NO: 8764 - DNA, 201 bp, Homo sapiens; identical to SEQ ID NO: 8716

SEQ ID NO: 8765 - DNA, 201 bp, Homo sapiens; identical to SEQ ID NO: 8717

SEQ ID NO: 8766 - DNA, 201 bp, Homo sapiens; identical to SEQ ID NO: 8718

SEQ ID NO: 8767 - DNA, 201 bp, Homo sapiens; identical to SEQ ID NO: 8719

SEQ ID NO: 8768 - DNA, 201 bp, Homo sapiens; identical to SEQ ID NO: 8720

SEQ ID NO: 8769 - DNA, 201 bp, Homo sapiens; identical to SEQ ID NO: 8721

SEQ ID NO: 8770 - DNA, 201 bp, Homo sapiens; identical to SEQ ID NO: 8722

SEQ ID NO: 8771 - DNA, 201 bp, Homo sapiens; identical to SEQ ID NO: 8723

SEQ ID NO: 8772 - DNA, 201 bp, Homo sapiens; identical to SEQ ID NO: 8724

SEQ ID NO: 8773 - DNA, 201 bp, Homo sapiens; identical to SEQ ID NO: 8725

SEQ ID NO: 8774 - DNA, 175 bp, Homo sapiens
ggctagtcaagtgaaacagtgggagtgaagaagaaacaaagacatctataactggttgtgatcaattagttgtamacactgcactcagaccagcctgggaagattttaaggatatggtgtggtctgatgggttccaaggcagaggttacaatagcctggaagagggagactgctt

SEQ ID NO: 8775 - DNA, 201 bp, Homo sapiens; identical to SEQ ID NO: 8726

SEQ ID NO: 8776 - DNA, 201 bp, Homo sapiens; identical to SEQ ID NO: 8686

SEQ ID NO: 8777 - DNA, 201 bp, Homo sapiens; identical to SEQ ID NO: 8687

SEQ ID NO: 8778 - DNA, 201 bp, Homo sapiens; identical to SEQ ID NO: 8688

SEQ ID NO: 8779 - DNA, 201 bp, Homo sapiens
tataaggcaaagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 8780 - DNA, 185 bp, Homo sapiens
ggcggagcggagccccgccctgggttatgtaagcgaccgcgctgggccgtttctctttcttttccggaccctgcagtggcgcctraagtctgagagagggaagtcgcctctgtgctcgtgagtgcatggggtataaggcaaagccccacagtcttcgttataacctcacggtgctgtcctgggat

SEQ ID NO: 8781 - DNA, 201 bp, Homo sapiens; identical to SEQ ID NO: 8690

SEQ ID NO: 8782 - DNA, 201 bp, Homo sapiens
cgcctaaagtctgagagagggaagtcgcctctgtgctcgtgagtgcatggggtataaggcaaagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 8783 - DNA, 201 bp, Homo sapiens; identical to SEQ ID NO: 8692

SEQ ID NO: 8784 - DNA, 201 bp, Homo sapiens; identical to SEQ ID NO: 8693

SEQ ID NO: 8785 - DNA, 201 bp, Homo sapiens
gccctctgggaaagtgctggtgcttcagagtcattggcagacattccatgtttctgctgttgctgctggctgctgctatttttgttattattattttctaygtccgttgttgtaagaagaaaacatcagctgcagagggtccaggtgagaaaactcgtgagcctgcaggtcctggatcaacacccagttgggacgagtgac

SEQ ID NO: 8786 - DNA, 201 bp, Homo sapiens; identical to SEQ ID NO: 8695

SEQ ID NO: 8787 - DNA, 201 bp, Homo sapiens; identical to SEQ ID NO: 8696

SEQ ID NO: 8788 - DNA, 201 bp, Homo sapiens; identical to SEQ ID NO: 8697

SEQ ID NO: 8789 - DNA, 201 bp, Homo sapiens; identical to SEQ ID NO: 8698

SEQ ID NO: 8790 - DNA, 201 bp, Homo sapiens; identical to SEQ ID NO: 8699

SEQ ID NO: 8791 - DNA, 201 bp, Homo sapiens; identical to SEQ ID NO: 8700

SEQ ID NO: 8792 - DNA, 201 bp, Homo sapiens; identical to SEQ ID NO: 8701

SEQ ID NO: 8793 - DNA, 201 bp, Homo sapiens; identical to SEQ ID NO: 8702

SEQ ID NO: 8794 - DNA, 201 bp, Homo sapiens
gccctgggttatgtaagcgaccgcgctgggccgtttctctttcttttccggaccctgcagtggcgcctaaagtctgagagagggaagtcgcctctgtgctsgtgagtgcatggggtataaggcaaagccccacagtcttcgttataacctcacggtgctgtcctgggatggatctgtgcagtcagggtttcttgctgaggt

SEQ ID NO: 8795 - DNA, 201 bp, Homo sapiens; identical to SEQ ID NO: 8703

SEQ ID NO: 8796 - DNA, 201 bp, Homo sapiens; identical to SEQ ID NO: 8704

SEQ ID NO: 8797 - DNA, 201 bp, Homo sapiens; identical to SEQ ID NO: 8706

SEQ ID NO: 8798 - DNA, 201 bp, Homo sapiens; identical to SEQ ID NO: 8707

SEQ ID NO: 8799 - DNA, 201 bp, Homo sapiens; identical to SEQ ID NO: 8709

SEQ ID NO: 8800 - DNA, 201 bp, Homo sapiens; identical to SEQ ID NO: 8710

SEQ ID NO: 8801 - DNA, 201 bp, Homo sapiens; identical to SEQ ID NO: 8711

SEQ ID NO: 8802 - DNA, 201 bp, Homo sapiens; identical to SEQ ID NO: 8712

SEQ ID NO: 8803 - DNA, 201 bp, Homo sapiens; identical to SEQ ID NO: 8713

SEQ ID NO: 8804 - DNA, 115 bp, Homo sapiens
ggcggagcggagccmcgccctgggttatgtaagcgaccgcgctgggccgtttctctttcttttccggaccctgcagtggcgcctaaagtctgagagagggaagtcgcctctgtgc

SEQ ID NO: 8805 - DNA, 201 bp, Homo sapiens; identical to SEQ ID NO: 8714

SEQ ID NO: 8806 - DNA, 201 bp, Homo sapiens
tctgggaaagtgctggtgcttcagagtcattggcagacattccatgtttctgctgttgctgctggctgctgctatttttgttattattattttctatgtcygttgttgtaagaagaaaacatcagctgcagagggtccaggtgagaaaactcgtgagcctgcaggtcctggatcaacacccagttgggacgagtgaccaca

SEQ ID NO: 8807 - DNA, 201 bp, Homo sapiens; identical to SEQ ID NO: 8718

SEQ ID NO: 8808 - DNA, 201 bp, Homo sapiens
tctgtgctcgtgagtgcatggggtataaggcaaagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 8809 - DNA, 201 bp, Homo sapiens; identical to SEQ ID NO: 8720

SEQ ID NO: 8810 - DNA, 201 bp, Homo sapiens; identical to SEQ ID NO: 8721

SEQ ID NO: 8811 - DNA, 201 bp, Homo sapiens
ctgtgctcgtgagtgcatggggtataaggcaaagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 8812 - DNA, 201 bp, Homo sapiens; identical to SEQ ID NO: 8723

SEQ ID NO: 8813 - DNA, 201 bp, Homo sapiens; identical to SEQ ID NO: 8724

SEQ ID NO: 8814 - DNA, 201 bp, Homo sapiens; identical to SEQ ID NO: 8725

SEQ ID NO: 8815 - DNA, 201 bp, Homo sapiens
ttcttttccggaccctgcagtggcgcctaaagtctgagagagggaagtcgcctctgtgctcgtgagtgcatggggtataaggcaaagccccacagtcttcsttataacctcacggtgctgtcctgggatggatctgtgcagtcagggtttcttgctgaggtacatctggatggtcagcccttcctgcgctatgacaggcag

SEQ ID NO: 8816 - DNA, 201 bp, Homo sapiens; identical to SEQ ID NO: 8686

SEQ ID NO: 8817 - DNA, 201 bp, Homo sapiens; identical to SEQ ID NO: 8687

SEQ ID NO: 8818 - DNA, 201 bp, Homo sapiens; identical to SEQ ID NO: 8688

SEQ ID NO: 8819 - DNA, 201 bp, Homo sapiens; identical to SEQ ID NO: 8689

SEQ ID NO: 8820 - DNA, 201 bp, Homo sapiens; identical to SEQ ID NO: 8690

SEQ ID NO: 8821 - DNA, 201 bp, Homo sapiens; identical to SEQ ID NO: 8691

SEQ ID NO: 8822 - DNA, 201 bp, Homo sapiens; identical to SEQ ID NO: 8692

SEQ ID NO: 8823 - DNA, 201 bp, Homo sapiens; identical to SEQ ID NO: 8693

SEQ ID NO: 8824 - DNA, 201 bp, Homo sapiens; identical to SEQ ID NO: 8785

SEQ ID NO: 8825 - DNA, 201 bp, Homo sapiens; identical to SEQ ID NO: 8695

SEQ ID NO: 8826 - DNA, 201 bp, Homo sapiens; identical to SEQ ID NO: 8696

SEQ ID NO: 8827 - DNA, 201 bp, Homo sapiens; identical to SEQ ID NO: 8697

SEQ ID NO: 8828 - DNA, 201 bp, Homo sapiens; identical to SEQ ID NO: 8698

SEQ ID NO: 8829 - DNA, 201 bp, Homo sapiens; identical to SEQ ID NO: 8699

SEQ ID NO: 8830 - DNA, 201 bp, Homo sapiens; identical to SEQ ID NO: 8700

SEQ ID NO: 8831 - DNA, 201 bp, Homo sapiens; identical to SEQ ID NO: 8701

SEQ ID NO: 8832 - DNA, 201 bp, Homo sapiens; identical to SEQ ID NO: 8702

SEQ ID NO: 8833 - DNA, 201 bp, Homo sapiens; identical to SEQ ID NO: 8703

SEQ ID NO: 8834 - DNA, 201 bp, Homo sapiens; identical to SEQ ID NO: 8704

SEQ ID NO: 8835 - DNA, 201 bp, Homo sapiens; identical to SEQ ID NO: 8705

SEQ ID NO: 8836 - DNA, 201 bp, Homo sapiens; identical to SEQ ID NO: 8706

SEQ ID NO: 8837 - DNA, 201 bp, Homo sapiens; identical to SEQ ID NO: 8707

SEQ ID NO: 8838 - DNA, 201 bp, Homo sapiens; identical to SEQ ID NO: 8708

SEQ ID NO: 8839 - DNA, 201 bp, Homo sapiens; identical to SEQ ID NO: 8709

SEQ ID NO: 8840 - DNA, 201 bp, Homo sapiens; identical to SEQ ID NO: 8710

SEQ ID NO: 8841 - DNA, 201 bp, Homo sapiens; identical to SEQ ID NO: 8711

SEQ ID NO: 8842 - DNA, 201 bp, Homo sapiens; identical to SEQ ID NO: 8712

SEQ ID NO: 8843 - DNA, 201 bp, Homo sapiens; identical to SEQ ID NO: 8713

SEQ ID NO: 8844 - DNA, 201 bp, Homo sapiens; identical to SEQ ID NO: 8714

SEQ ID NO: 8845 - DNA, 201 bp, Homo sapiens; identical to SEQ ID NO: 8806

SEQ ID NO: 8846 - DNA, 201 bp, Homo sapiens; identical to SEQ ID NO: 8716

SEQ ID NO: 8847 - DNA, 201 bp, Homo sapiens; identical to SEQ ID NO: 8717

SEQ ID NO: 8848 - DNA, 201 bp, Homo sapiens; identical to SEQ ID NO: 8718

SEQ ID NO: 8849 - DNA, 201 bp, Homo sapiens; identical to SEQ ID NO: 8719

SEQ ID NO: 8850 - DNA, 201 bp, Homo sapiens; identical to SEQ ID NO: 8720

SEQ ID NO: 8851 - DNA, 201 bp, Homo sapiens; identical to SEQ ID NO: 8721

SEQ ID NO: 8852 - DNA, 201 bp, Homo sapiens; identical to SEQ ID NO: 8722

SEQ ID NO: 8853 - DNA, 201 bp, Homo sapiens; identical to SEQ ID NO: 8723

SEQ ID NO: 8854 - DNA, 201 bp, Homo sapiens; identical to SEQ ID NO: 8724

SEQ ID NO: 8855 - DNA, 201 bp, Homo sapiens; identical to SEQ ID NO: 8725

SEQ ID NO: 8856 - DNA, 175 bp, Homo sapiens; identical to SEQ ID NO: 8774

SEQ ID NO: 8857 - DNA, 201 bp, Homo sapiens; identical to SEQ ID NO: 8726

SEQ ID NO: 8858 - DNA, 201 bp, Homo sapiens; identical to SEQ ID NO: 8686

SEQ ID NO: 8859 - DNA, 201 bp, Homo sapiens; identical to SEQ ID NO: 8687

SEQ ID NO: 8860 - DNA, 201 bp, Homo sapiens
gtatatgaaatcctcgttcttgtccctttgcccgtgtgcatttcctgccccaggaaggttgggacagcagacctgtgtgttaaacatcaatgtgaagttayttccaggaagaagtttcacctgtgatttcctcttccccagagccccacagtcttcgttataacctcacggtgctgtcctgggatggatctgtgcagtcag

SEQ ID NO: 8861 - DNA, 201 bp, Homo sapiens; identical to SEQ ID NO: 8688

SEQ ID NO: 8862 - DNA, 201 bp, Homo sapiens
tcttccccagagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 8863 - DNA, 201 bp, Homo sapiens; identical to SEQ ID NO: 8690

SEQ ID NO: 8864 - DNA, 201 bp, Homo sapiens
ttaaacatcaatgtgaagttacttccaggaagaagtttcacctgtgatttcctcttccccagagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 8865 - DNA, 201 bp, Homo sapiens; identical to SEQ ID NO: 8692

SEQ ID NO: 8866 - DNA, 201 bp, Homo sapiens; identical to SEQ ID NO: 8693

SEQ ID NO: 8867 - DNA, 201 bp, Homo sapiens
aacttctctggggctacaaccttcctaccctttgtgcctcatgaccaccccctcccttgtccccgccatgcccatgatgagtctcttctcgaggcagctcsccttgcctccatctcaccctcagcctatgcaccacagccacactggacatgggtccctctgagcctgagtcccttcccattcccaccatcccctctggca

SEQ ID NO: 8868 - DNA, 201 bp, Homo sapiens
ctcgaggcagctccccttgcctccatctcaccctcagcctatgcaccacagccacactggacatgggtccctctgagcctgagtcccttcccattcccacyatcccctctggcaagaccttccttccaccaccttcatgctcctcccttgcccctgcagggcagcctctccccttggcccctattcccttagggggcttgt

SEQ ID NO: 8869 - DNA, 201 bp, Homo sapiens
aggcagctccccttgcctccatctcaccctcagcctatgcaccacagccacactggacatgggtccctctgagcctgagtcccttcccattcccaccatcycctctggcaagaccttccttccaccaccttcatgctcctcccttgcccctgcagggcagcctctccccttggcccctattcccttagggggcttgtggcc

SEQ ID NO: 8870 - DNA, 201 bp, Homo sapiens
cagccacactggacatgggtccctctgagcctgagtcccttcccattcccaccatcccctctggcaagaccttccttccaccaccttcatgctcctccctygcccctgcagggcagcctctccccttggcccctattcccttagggggcttgtggccacccagtccttgcacctggcctacaagtttgccatcttcattcc

SEQ ID NO: 8871 - DNA, 201 bp, Homo sapiens; identical to SEQ ID NO: 8694

SEQ ID NO: 8872 - DNA, 201 bp, Homo sapiens
cttctgttcatcagccccctcctctatcctcccaccctcacagttttctttgtatatgaaatcctcgttcttgtccctttgcccgtgtgcatttcctgccycaggaaggttgggacagcagacctgtgtgttaaacatcaatgtgaagttacttccaggaagaagtttcacctgtgatttcctcttccccagagccccaca

SEQ ID NO: 8873 - DNA, 201 bp, Homo sapiens; identical to SEQ ID NO: 8695

SEQ ID NO: 8874 - DNA, 201 bp, Homo sapiens; identical to SEQ ID NO: 8696

SEQ ID NO: 8875 - DNA, 201 bp, Homo sapiens
tcttcccactggatctggctcaggctgggggtgaggaatgggggtcagtggaactcagcagggaggtgagccggcactcagcccacacagggaggcatggrggagggccagggaggcataccccctgggctgagttcctcacttgggtggaaaggtgatgggttcgggaatggagaagtcactgctgggtgggggcaggct

SEQ ID NO: 8876 - DNA, 201 bp, Homo sapiens
gctcaggctgggggtgaggaatgggggtcagtggaactcagcagggaggtgagccggcactcagcccacacagggaggcatggaggagggccagggaggcrtaccccctgggctgagttcctcacttgggtggaaaggtgatgggttcgggaatggagaagtcactgctgggtgggggcaggcttgcattccctccaggag

SEQ ID NO: 8877 - DNA, 201 bp, Homo sapiens
agcccttcctgcgctatgacaggcagaaatgcagggcaaagccccagggacagtgggcagaagatgtcctgggaaataagacatgggacagagagaccagrgacttgacagggaacggaaaggacctcaggatgaccctggctcatatcaaggaccagaaagaaggtgagagtcggcaggggcaagagtgactggagaggc

SEQ ID NO: 8878 - DNA, 201 bp, Homo sapiens
tcactgctgggtgggggcaggcttgcattccctccaggagattagggtctgtgagatccatgaagacaacagcaccaggagctcccagcatttctactacratggggagctcttcctctcccaaaacctggagactgaggaatggacagtgccccagtcctccagagctcagaccttggccatgaacgtcaggaatttctt

SEQ ID NO: 8879 - DNA, 201 bp, Homo sapiens; identical to SEQ ID NO: 8697

SEQ ID NO: 8880 - DNA, 201 bp, Homo sapiens; identical to SEQ ID NO: 8700

SEQ ID NO: 8881 - DNA, 201 bp, Homo sapiens; identical to SEQ ID NO: 8702

SEQ ID NO: 8882 - DNA, 201 bp, Homo sapiens; identical to SEQ ID NO: 8701

SEQ ID NO: 8883 - DNA, 201 bp, Homo sapiens
tccctttgcccgtgtgcatttcctgccccaggaaggttgggacagcagacctgtgtgttaaacatcaatgtgaagttacttccaggaagaagtttcacctrtgatttcctcttccccagagccccacagtcttcgttataacctcacggtgctgtcctgggatggatctgtgcagtcagggtttcttgctgaggtacatct

SEQ ID NO: 8884 - DNA, 201 bp, Homo sapiens
ctgctgggtgggggcaggcttgcattccctccaggagattagggtctgtgagatccatgaagacaacagcaccaggagctcccagcatttctactacgatrgggagctcttcctctcccaaaacctggagactgaggaatggacagtgccccagtcctccagagctcagaccttggccatgaacgtcaggaatttcttgaa

SEQ ID NO: 8885 - DNA, 201 bp, Homo sapiens; identical to SEQ ID NO: 8704

SEQ ID NO: 8886 - DNA, 201 bp, Homo sapiens
ctggatggtcagcccttcctgcgctatgacaggcagaaatgcagggcaaagccccagggacagtgggcagaagatgtcctgggaaataagacatgggacasagagaccagggacttgacagggaacggaaaggacctcaggatgaccctggctcatatcaaggaccagaaagaaggtgagagtcggcaggggcaagagtga

SEQ ID NO: 8887 - DNA, 201 bp, Homo sapiens; identical to SEQ ID NO: 8707

SEQ ID NO: 8888 - DNA, 201 bp, Homo sapiens; identical to SEQ ID NO: 8709

SEQ ID NO: 8889 - DNA, 201 bp, Homo sapiens; identical to SEQ ID NO: 8712

SEQ ID NO: 8890 - DNA, 201 bp, Homo sapiens; identical to SEQ ID NO: 8710

SEQ ID NO: 8891 - DNA, 201 bp, Homo sapiens
gtcactgctgggtgggggcaggcttgcattccctccaggagattagggtctgtgagatccatgaagacaacagcaccaggagctcccagcatttctactaygatggggagctcttcctctcccaaaacctggagactgaggaatggacagtgccccagtcctccagagctcagaccttggccatgaacgtcaggaatttct

SEQ ID NO: 8892 - DNA, 201 bp, Homo sapiens; identical to SEQ ID NO: 8713

SEQ ID NO: 8893 - DNA, 201 bp, Homo sapiens; identical to SEQ ID NO: 8714

SEQ ID NO: 8894 - DNA, 201 bp, Homo sapiens; identical to SEQ ID NO: 8715

SEQ ID NO: 8895 - DNA, 201 bp, Homo sapiens
ttgtccctttgcccgtgtgcatttcctgccccaggaaggttgggacagcagacctgtgtgttaaacatcaatgtgaagttacttccaggaagaagtttcayctgtgatttcctcttccccagagccccacagtcttcgttataacctcacggtgctgtcctgggatggatctgtgcagtcagggtttcttgctgaggtaca

SEQ ID NO: 8896 - DNA, 201 bp, Homo sapiens; identical to SEQ ID NO: 8718

SEQ ID NO: 8897 - DNA, 201 bp, Homo sapiens
ttccagaaaagttaggggcagagagcagggacctgtctcttcccactggatctggctcaggctgggggtgaggaatgggggtcagtggaactcagcagggwggtgagccggcactcagcccacacagggaggcatggaggagggccagggaggcataccccctgggctgagttcctcacttgggtggaaaggtgatgggtt

SEQ ID NO: 8898 - DNA, 153 bp, Homo sapiens
ccagtggacactagctgttccatccaattgctgtcctggggccttgtcatgcyactcttccactttgaacccaagcccacaccgttcgttgctcccctctgggatactgaccccactataaacttctctggggctacaaccttcctacccttt

SEQ ID NO: 8899 - DNA, 168 bp, Homo sapiens
ccagtggacactagctgttccatccaattgctgtcctggggccttgtcatgctactcttccactttgracccaagcccacaccgttcgttgctcccctctgggatactgaccccactataaacttctctggggctacaaccttcctaccctttgtgcctcatgaccac

SEQ ID NO: 8900 - DNA, 201 bp, Homo sapiens; identical to SEQ ID NO: 8720

SEQ ID NO: 8901 - DNA, 201 bp, Homo sapiens
aagaagtttcacctgtgatttcctcttccccagagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 8902 - DNA, 201 bp, Homo sapiens
gctgtcctggggccttgtcatgctactcttccactttgaacccaagcccacaccgttcgttgctcccctctgggatactgaccccactataaacttctctrgggctacaaccttcctaccctttgtgcctcatgaccaccccctcccttgtccccgccatgcccatgatgagtctcttctcgaggcagctccccttgcctc

SEQ ID NO: 8903 - DNA, 201 bp, Homo sapiens
gctactcttccactttgaacccaagcccacaccgttcgttgctcccctctgggatactgaccccactataaacttctctggggctacaaccttcctacccyttgtgcctcatgaccaccccctcccttgtccccgccatgcccatgatgagtctcttctcgaggcagctccccttgcctccatctcaccctcagcctatgc

SEQ ID NO: 8904 - DNA, 201 bp, Homo sapiens
ccccactataaacttctctggggctacaaccttcctaccctttgtgcctcatgaccaccccctcccttgtccccgccatgcccatgatgagtctcttctcraggcagctccccttgcctccatctcaccctcagcctatgcaccacagccacactggacatgggtccctctgagcctgagtcccttcccattcccaccatc

SEQ ID NO: 8905 - DNA, 201 bp, Homo sapiens; identical to SEQ ID NO: 8721

SEQ ID NO: 8906 - DNA, 201 bp, Homo sapiens; identical to SEQ ID NO: 8723

SEQ ID NO: 8907 - DNA, 201 bp, Homo sapiens
agaagtttcacctgtgatttcctcttccccagagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 8908 - DNA, 201 bp, Homo sapiens; identical to SEQ ID NO: 8725

SEQ ID NO: 8909 - DNA, 201 bp, Homo sapiens; identical to SEQ ID NO: 8724

SEQ ID NO: 8910 - DNA, 201 bp, Homo sapiens
ggttgggacagcagacctgtgtgttaaacatcaatgtgaagttacttccaggaagaagtttcacctgtgatttcctcttccccagagccccacagtcttcsttataacctcacggtgctgtcctgggatggatctgtgcagtcagggtttcttgctgaggtacatctggatggtcagcccttcctgcgctatgacaggcag

SEQ ID NO: 8911 - DNA, 201 bp, Homo sapiens
aggctgggggtgaggaatgggggtcagtggaactcagcagggaggtgagccggcactcagcccacacagggaggcatggaggagggccagggaggcatacyccctgggctgagttcctcacttgggtggaaaggtgatgggttcgggaatggagaagtcactgctgggtgggggcaggcttgcattccctccaggagatta

SEQ ID NO: 8912 - DNA, 201 bp, Homo sapiens; identical to SEQ ID NO: 8686

SEQ ID NO: 8913 - DNA, 201 bp, Homo sapiens; identical to SEQ ID NO: 8687

SEQ ID NO: 8914 - DNA, 201 bp, Homo sapiens; identical to SEQ ID NO: 8688

SEQ ID NO: 8915 - DNA, 201 bp, Homo sapiens
gctgaagcagagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 8916 - DNA, 201 bp, Homo sapiens; identical to SEQ ID NO: 8690

SEQ ID NO: 8917 - DNA, 201 bp, Homo sapiens
tgaggttcggtgggcacagtggctcacgcctggatttccagcactttgggaggctgaagcagagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 8918 - DNA, 201 bp, Homo sapiens; identical to SEQ ID NO: 8692

SEQ ID NO: 8919 - DNA, 201 bp, Homo sapiens; identical to SEQ ID NO: 8693

SEQ ID NO: 8920 - DNA, 201 bp, Homo sapiens; identical to SEQ ID NO: 8785

SEQ ID NO: 8921 - DNA, 201 bp, Homo sapiens; identical to SEQ ID NO: 8695

SEQ ID NO: 8922 - DNA, 201 bp, Homo sapiens; identical to SEQ ID NO: 8696

SEQ ID NO: 8923 - DNA, 201 bp, Homo sapiens; identical to SEQ ID NO: 8697

SEQ ID NO: 8924 - DNA, 201 bp, Homo sapiens; identical to SEQ ID NO: 8698

SEQ ID NO: 8925 - DNA, 201 bp, Homo sapiens; identical to SEQ ID NO: 8699

SEQ ID NO: 8926 - DNA, 201 bp, Homo sapiens; identical to SEQ ID NO: 8700

SEQ ID NO: 8927 - DNA, 201 bp, Homo sapiens; identical to SEQ ID NO: 8701

SEQ ID NO: 8928 - DNA, 201 bp, Homo sapiens; identical to SEQ ID NO: 8702

SEQ ID NO: 8929 - DNA, 201 bp, Homo sapiens; identical to SEQ ID NO: 8703

SEQ ID NO: 8930 - DNA, 201 bp, Homo sapiens; identical to SEQ ID NO: 8704

SEQ ID NO: 8931 - DNA, 201 bp, Homo sapiens; identical to SEQ ID NO: 8706

SEQ ID NO: 8932 - DNA, 201 bp, Homo sapiens; identical to SEQ ID NO: 8707

SEQ ID NO: 8933 - DNA, 201 bp, Homo sapiens; identical to SEQ ID NO: 8709

SEQ ID NO: 8934 - DNA, 201 bp, Homo sapiens; identical to SEQ ID NO: 8710

SEQ ID NO: 8935 - DNA, 201 bp, Homo sapiens; identical to SEQ ID NO: 8711

SEQ ID NO: 8936 - DNA, 201 bp, Homo sapiens; identical to SEQ ID NO: 8712

SEQ ID NO: 8937 - DNA, 201 bp, Homo sapiens; identical to SEQ ID NO: 8713

SEQ ID NO: 8938 - DNA, 201 bp, Homo sapiens; identical to SEQ ID NO: 8714

SEQ ID NO: 8939 - DNA, 201 bp, Homo sapiens; identical to SEQ ID NO: 8806

SEQ ID NO: 8940 - DNA, 201 bp, Homo sapiens; identical to SEQ ID NO: 8718

SEQ ID NO: 8941 - DNA, 198 bp, Homo sapiens
atgtttgtctttttgtttctggcttatttcacttataatatttttgaggttcggtgggcacagtggctcacgcctggatttccagcactttgggaggytgaagcagagccccacagtcttcgttataacctcacggtgctgtcctgggatggatctgtgcagtcagggtttcttgctgaggtacatctggatggtcag

SEQ ID NO: 8942 - DNA, 201 bp, Homo sapiens; identical to SEQ ID NO: 8720

SEQ ID NO: 8943 - DNA, 201 bp, Homo sapiens
ctggatttccagcactttgggaggctgaagcagagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 8944 - DNA, 201 bp, Homo sapiens; identical to SEQ ID NO: 8721

SEQ ID NO: 8945 - DNA, 201 bp, Homo sapiens; identical to SEQ ID NO: 8723

SEQ ID NO: 8946 - DNA, 201 bp, Homo sapiens
tggatttccagcactttgggaggctgaagcagagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 8947 - DNA, 201 bp, Homo sapiens; identical to SEQ ID NO: 8725

SEQ ID NO: 8948 - DNA, 201 bp, Homo sapiens; identical to SEQ ID NO: 8724

SEQ ID NO: 8949 - DNA, 201 bp, Homo sapiens
gcttatttcacttataatatttttgaggttcggtgggcacagtggctcacgcctggatttccagcactttgggaggctgaagcagagccccacagtcttcsttataacctcacggtgctgtcctgggatggatctgtgcagtcagggtttcttgctgaggtacatctggatggtcagcccttcctgcgctatgacaggcag

SEQ ID NO: 8950 - DNA, 201 bp, Homo sapiens; identical to SEQ ID NO: 8678

SEQ ID NO: 8951 - DNA, 201 bp, Homo sapiens; identical to SEQ ID NO: 8679

SEQ ID NO: 8952 - DNA, 121 bp, Homo sapiens
atggggctgggcccggtcttyctgcttctggctggcatcttcccttttgcacctccgggagctgctgctgagccccacagtcttcgttacaacctcatggtgctgtcccaggatggatctg

SEQ ID NO: 8953 - DNA, 201 bp, Homo sapiens; identical to SEQ ID NO: 8681

SEQ ID NO: 8954 - DNA, 201 bp, Homo sapiens; identical to SEQ ID NO: 8682

SEQ ID NO: 8955 - DNA, 201 bp, Homo sapiens; identical to SEQ ID NO: 8683

SEQ ID NO: 8956 - DNA, 201 bp, Homo sapiens; identical to SEQ ID NO: 8684

SEQ ID NO: 8957 - DNA, 201 bp, Homo sapiens; identical to SEQ ID NO: 8685

SEQ ID NO: 8958 - DNA, 201 bp, Homo sapiens
gccctctgggaaagtgctggtgcttcagagtcattggcagacattccatgtttctgctgttgctgctgctgctatttttgttattattattttctatgtcygttgttgtaagaagaaaacatcagctgcagagggtccagagctcgtgagcctgcaggtcctggatcaacacccagttgggacgagtgaccacagggatgc

SEQ ID NO: 8959 - DNA, 201 bp, Homo sapiens
agaacagtgccccccatggtgaatgtcacccgcagcgaggcctcagagggcaacattaccgtgacatgcagggcttctggcttctatccctggaatatcayactgagctggcgtcaggatggggtatctttgagccacgacacccagcagtggggggatgtcctgcctgatgggaatggaacctaccagacctgggtggcc

SEQ ID NO: 8960 - DNA, 201 bp, Homo sapiens; identical to SEQ ID NO: 8712

SEQ ID NO: 8961 - DNA, 201 bp, Homo sapiens
ggcgacgtcggggccatggggctgggcccggtcttcctgcttctggctggcatcttcccttttgcacctccgggagctgctgctgagccccacagtcttcsttataacctcacggtgctgtcctgggatggatctgtgcagtcagggtttctcactgaggtacatctggatggtcagcccttcctgcgctgtgacaggcag

SEQ ID NO: 8962 - DNA, 201 bp, Homo sapiens
ctggatggtcagcccttcctgcgctgtgacaggcagaaatgcagggcaaagccccagggacagtgggcagaagatgtcctgggaaataagacatgggacasagagaccagagacttgacagggaacggaaaggacctcaggatgaccctggctcatatcaaggaccagaaagaaggcttgcattccctccaggagattagg

SEQ ID NO: 8963 - DNA, 201 bp, Homo sapiens
tcttcccttttgcacctccgggagctgctgctgagccccacagtcttcgttataacctcacggtgctgtcctgggatggatctgtgcagtcagggtttctyactgaggtacatctggatggtcagcccttcctgcgctgtgacaggcagaaatgcagggcaaagccccagggacagtgggcagaagatgtcctgggaaata

SEQ ID NO: 8964 - DNA, 201 bp, Homo sapiens
cttcccttttgcacctccgggagctgctgctgagccccacagtcttcgttataacctcacggtgctgtcctgggatggatctgtgcagtcagggtttctcrctgaggtacatctggatggtcagcccttcctgcgctgtgacaggcagaaatgcagggcaaagccccagggacagtgggcagaagatgtcctgggaaataa

SEQ ID NO: 8965 - DNA, 201 bp, Homo sapiens
cacagtcttcgttataacctcacggtgctgtcctgggatggatctgtgcagtcagggtttctcactgaggtacatctggatggtcagcccttcctgcgctrtgacaggcagaaatgcagggcaaagccccagggacagtgggcagaagatgtcctgggaaataagacatgggacagagagaccagagacttgacagggaac

SEQ ID NO: 8966 - DNA, 201 bp, Homo sapiens
agcccttcctgcgctgtgacaggcagaaatgcagggcaaagccccagggacagtgggcagaagatgtcctgggaaataagacatgggacagagagaccagrgacttgacagggaacggaaaggacctcaggatgaccctggctcatatcaaggaccagaaagaaggcttgcattccctccaggagattagggtctgtgaga

SEQ ID NO: 8967 - DNA, 201 bp, Homo sapiens
ttccctccaggagattagggtctgtgagatccatgaagacaacagcaccaggagctcccagcatttctactacgatggggagctcttcctctcccaaaacstggagactaaggaatggacaatgccccagtcctccagagctcagaccttggccatgaacgtcaggaatttcttgaaggaagatgccatgaagaccaagac

SEQ ID NO: 8968 - DNA, 201 bp, Homo sapiens
ggagattagggtctgtgagatccatgaagacaacagcaccaggagctcccagcatttctactacgatggggagctcttcctctcccaaaacctggagactraggaatggacaatgccccagtcctccagagctcagaccttggccatgaacgtcaggaatttcttgaaggaagatgccatgaagaccaagacacactatca

SEQ ID NO: 8969 - DNA, 201 bp, Homo sapiens
gcatttctactacgatggggagctcttcctctcccaaaacctggagactaaggaatggacaatgccccagtcctccagagctcagaccttggccatgaacrtcaggaatttcttgaaggaagatgccatgaagaccaagacacactatcacgctatgcatgcagactgcctgcaggaactacggcgatatctaaaatccgg

SEQ ID NO: 8970 - DNA, 201 bp, Homo sapiens
ctgtgagatccatgaagacaacagcaccaggagctcccagcatttctactacgatggggagctcttcctctcccaaaacctggagactaaggaatggacartgccccagtcctccagagctcagaccttggccatgaacgtcaggaatttcttgaaggaagatgccatgaagaccaagacacactatcacgctatgcatgc

SEQ ID NO: 8971 - DNA, 201 bp, Homo sapiens
cgtcaggaatttcttgaaggaagatgccatgaagaccaagacacactatcacgctatgcatgcagactgcctgcaggaactacggcgatatctaaaatccrgcgtagtcctgaggagaacagtgccccccatggtgaatgtcacccgcagcgaggcctcagagggcaacattaccgtgacatgcagggcttctggcttcta

SEQ ID NO: 8972 - DNA, 201 bp, Homo sapiens
gggcccggtcttcctgcttctggctggcatcttcccttttgcacctccgggagctgctgctgagccccacagtcttcgttataacctcacggtgctgtcckgggatggatctgtgcagtcagggtttctcactgaggtacatctggatggtcagcccttcctgcgctgtgacaggcagaaatgcagggcaaagccccaggg

SEQ ID NO: 8973 - DNA, 201 bp, Homo sapiens
ggatcaacacccagttgggacgagtgaccacagggatgccacacagctcggatttcagcctctgatgtcagatcttgggtccactggctccactgagggcrcctagactctacagccaggcagctgggattcaattccctgcctggatctcacgagcactttccctcttggtgcctcagtttcctgacctatgaaacagag

SEQ ID NO: 8974 - DNA, 201 bp, Homo sapiens
gctgctgctgagccccacagtcttcgttataacctcacggtgctgtcctgggatggatctgtgcagtcagggtttctcactgaggtacatctggatggtcwgcccttcctgcgctgtgacaggcagaaatgcagggcaaagccccagggacagtgggcagaagatgtcctgggaaataagacatgggacagagagaccaga

SEQ ID NO: 8975 - DNA, 201 bp, Homo sapiens
gtgctgtcctgggatggatctgtgcagtcagggtttctcactgaggtacatctggatggtcagcccttcctgcgctgtgacaggcagaaatgcagggcaargccccagggacagtgggcagaagatgtcctgggaaataagacatgggacagagagaccagagacttgacagggaacggaaaggacctcaggatgaccctg

SEQ ID NO: 8976 - DNA, 201 bp, Homo sapiens
cctctcccaaaacctggagactaaggaatggacaatgccccagtcctccagagctcagaccttggccatgaacgtcaggaatttcttgaaggaagatgccrtgaagaccaagacacactatcacgctatgcatgcagactgcctgcaggaactacggcgatatctaaaatccggcgtagtcctgaggagaacagtgccccc

SEQ ID NO: 8977 - DNA, 201 bp, Homo sapiens
atatcaaggaccagaaagaaggcttgcattccctccaggagattagggtctgtgagatccatgaagacaacagcaccaggagctcccagcatttctactaygatggggagctcttcctctcccaaaacctggagactaaggaatggacaatgccccagtcctccagagctcagaccttggccatgaacgtcaggaatttct

SEQ ID NO: 8978 - DNA, 201 bp, Homo sapiens
gagactaaggaatggacaatgccccagtcctccagagctcagaccttggccatgaacgtcaggaatttcttgaaggaagatgccatgaagaccaagacacwctatcacgctatgcatgcagactgcctgcaggaactacggcgatatctaaaatccggcgtagtcctgaggagaacagtgccccccatggtgaatgtcacc

SEQ ID NO: 8979 - DNA, 201 bp, Homo sapiens
tatcaaggaccagaaagaaggcttgcattccctccaggagattagggtctgtgagatccatgaagacaacagcaccaggagctcccagcatttctactacratggggagctcttcctctcccaaaacctggagactaaggaatggacaatgccccagtcctccagagctcagaccttggccatgaacgtcaggaatttctt

SEQ ID NO: 8980 - DNA, 201 bp, Homo sapiens
tctgggaaagtgctggtgcttcagagtcattggcagacattccatgtttctgctgttgctgctgctgctatttttgttattattattttctatgtccgttyttgtaagaagaaaacatcagctgcagagggtccagagctcgtgagcctgcaggtcctggatcaacacccagttgggacgagtgaccacagggatgccaca

SEQ ID NO: 8981 - DNA, 201 bp, Homo sapiens
gaccttggccatgaacgtcaggaatttcttgaaggaagatgccatgaagaccaagacacactatcacgctatgcatgcagactgcctgcaggaactacggygatatctaaaatccggcgtagtcctgaggagaacagtgccccccatggtgaatgtcacccgcagcgaggcctcagagggcaacattaccgtgacatgcag

SEQ ID NO: 8982 - DNA, 201 bp, Homo sapiens
gtgccccccatggtgaatgtcacccgcagcgaggcctcagagggcaacattaccgtgacatgcagggcttctggcttctatccctggaatatcacactgasctggcgtcaggatggggtatctttgagccacgacacccagcagtggggggatgtcctgcctgatgggaatggaacctaccagacctgggtggccaccagg

SEQ ID NO: 8983 - DNA, 201 bp, Homo sapiens
catgaacgtcaggaatttcttgaaggaagatgccatgaagaccaagacacactatcacgctatgcatgcagactgcctgcaggaactacggcgatatctaraatccggcgtagtcctgaggagaacagtgccccccatggtgaatgtcacccgcagcgaggcctcagagggcaacattaccgtgacatgcagggcttctgg

SEQ ID NO: 8984 - DNA, 201 bp, Homo sapiens
caaggaccagaaagaaggcttgcattccctccaggagattagggtctgtgagatccatgaagacaacagcaccaggagctcccagcatttctactacgatrgggagctcttcctctcccaaaacctggagactaaggaatggacaatgccccagtcctccagagctcagaccttggccatgaacgtcaggaatttcttgaa

SEQ ID NO: 8985 - DNA, 201 bp, Homo sapiens
agtcctgaggagaacagtgccccccatggtgaatgtcacccgcagcgaggcctcagagggcaacattaccgtgacatgcagggcttctggcttctatcccyggaatatcacactgagctggcgtcaggatggggtatctttgagccacgacacccagcagtggggggatgtcctgcctgatgggaatggaacctaccagac

SEQ ID NO: 8986 - DNA, 201 bp, Homo sapiens
tgagctggcgtcaggatggggtatctttgagccacgacacccagcagtggggggatgtcctgcctgatgggaatggaacctaccagacctgggtggccacyaggatttgccaaggagaggagcagaggttcacctgctacatggaacacagcgggaatcacagcactcaccctgtgccctctgggaaagtgctggtgcttc

SEQ ID NO: 8987 - DNA, 201 bp, Homo sapiens
gaatggaacctaccagacctgggtggccaccaggatttgccaaggagaggagcagaggttcacctgctacatggaacacagcgggaatcacagcactcacsctgtgccctctgggaaagtgctggtgcttcagagtcattggcagacattccatgtttctgctgttgctgctgctgctatttttgttattattattttcta

SEQ ID NO: 8988 - DNA, 201 bp, Homo sapiens
ttgtcaatggtaccgtgacacagggggaccaaagagtctccatgccctatgcctccaaagggctgtatctagaaactgaggctgggtactacaagctgtcyggtgaggcctatggctttgtggccaggatcgatggcagcggcaactttcaagtcctgctgtcagacagatacttcaacaagacctgcgggctgtgtggca

SEQ ID NO: 8989 - DNA, 201 bp, Homo sapiens
gggctgtatctagaaactgaggctgggtactacaagctgtccggtgaggcctatggctttgtggccaggatcgatggcagcggcaactttcaagtcctgcwgtcagacagatacttcaacaagacctgcgggctgtgtggcaactttaacatctttgctgaagatgactttatgacccaagaagggaccttgacctcggac

SEQ ID NO: 8990 - DNA, 201 bp, Homo sapiens
gcatccagcgtacagtgacggcctccgtgcgcctcagctacggggaggacctgcagatggactgggatggccgcgggaggctgctggtgaagctgtccccygtctatgccgggaagacctgcggcctgtgtgggaattacaatggcaaccagggcgacgacttccttaccccctctgggctggcggagccccgggtggagg

SEQ ID NO: 8991 - DNA, 201 bp, Homo sapiens
ccgttgcacgatttctactgcagcaggctactggacctggtcttcctgctggatggctcctccaggctgtccgaggctgagtttgaagtgctgaaggcctytgtggtggacatgatggagcggctgcgcatctcccagaagtgggtccgcgtggccgtggtggagtaccacgacggctcccacgcctacatcgggctcaag

SEQ ID NO: 8992 - DNA, 201 bp, Homo sapiens
tggagcggctgcgcatctcccagaagtgggtccgcgtggccgtggtggagtaccacgacggctcccacgcctacatcgggctcaaggaccggaagcgaccstcagagctgcggcgcattgccagccaggtgaagtatgcgggcagccaggtggcctccaccagcgaggtcttgaaatacacactgttccaaatcttcagca

SEQ ID NO: 8993 - DNA, 201 bp, Homo sapiens
gaagcccctcctcctactctgccccccgacatggcacaagtcactgtgggcccggggctcttgggggtttcgaccctggggcccaagaggaactccatggytctggatgtggcgttcgtcctggaaggatcggacaaaattggtgaagccgacttcaacaggagcaaggagttcatggaggaggtgattcagcggatggat

SEQ ID NO: 8994 - DNA, 201 bp, Homo sapiens
gatttgccactgtgatgttgtcaacctcacctgtgaagcctgccaggagccgggaggcctggtggtgcctcccacagatgccccggtgagccccaccactytgtatgtggaggacatctcggaaccgccgttgcacgatttctactgcagcaggctactggacctggtcttcctgctggatggctcctccaggctgtccga

SEQ ID NO: 8995 - DNA, 201 bp, Homo sapiens
gagctggagcagcaaagggacgagatcgttagctacctctgtgaccttgcccctgaagcccctcctcctactctgccccccgacatggcacaagtcactgygggcccggggctcttgggggtttcgaccctggggcccaagaggaactccatggttctggatgtggcgttcgtcctggaaggatcggacaaaattggtgaa

SEQ ID NO: 8996 - DNA, 201 bp, Homo sapiens
gtgctgagcagtgtggatgagctggagcagcaaagggacgagatcgttagctacctctgtgaccttgcccctgaagcccctcctcctactctgccccccgrcatggcacaagtcactgtgggcccggggctcttgggggtttcgaccctggggcccaagaggaactccatggttctggatgtggcgttcgtcctggaagga

SEQ ID NO: 8997 - DNA, 201 bp, Homo sapiens
cggcgcattgccagccaggtgaagtatgcgggcagccaggtggcctccaccagcgaggtcttgaaatacacactgttccaaatcttcagcaagatcgaccrccctgaagcctcccgcatcaccctgctcctgatggccagccaggagccccaacggatgtcccggaactttgtccgctacgtccagggcctgaagaagaag

SEQ ID NO: 8998 - DNA, 201 bp, Homo sapiens
cgtccagggcctgaagaagaagaaggtcattgtgatcccggtgggcattgggccccatgccaacctcaagcagatccgcctcatcgagaagcaggcccctragaacaaggccttcgtgctgagcagtgtggatgagctggagcagcaaagggacgagatcgttagctacctctgtgaccttgcccctgaagcccctcctcc

SEQ ID NO: 8999 - DNA, 201 bp, Homo sapiens
aatgcaatgaggcctgcctggagggctgcttctgccccccagggctctacatggatgagaggggggactgcgtgcccaaggcccagtgcccctgttactaygacggtgagatcttccagccagaagacatcttctcagaccatcacaccatgtgctactgtgaggatggcttcatgcactgtaccatgagtggagtccccg

SEQ ID NO: 9000 - DNA, 201 bp, Homo sapiens
tctctcttacccggatgaggaatgcaatgaggcctgcctggagggctgcttctgccccccagggctctacatggatgagaggggggactgcgtgcccaagrcccagtgcccctgttactatgacggtgagatcttccagccagaagacatcttctcagaccatcacaccatgtgctactgtgaggatggcttcatgcactg

SEQ ID NO: 9001 - DNA, 201 bp, Homo sapiens
tgtgaagaggcccatgaaggatgagactcactttgaggtggtggagtctggccggtacatcattctgctgctgggcaaagccctctccgtggtctgggacygccacctgagcatctccgtggtcctgaagcagacataccaggagaaagtgtgtggcctgtgtgggaattttgatggcatccagaacaatgacctcaccag

SEQ ID NO: 9002 - DNA, 201 bp, Homo sapiens
cactgccagatttgccactgtgatgttgtcaacctcacctgtgaagcctgccaggagccgggaggcctggtggtgcctcccacagatgccccggtgagccscaccactctgtatgtggaggacatctcggaaccgccgttgcacgatttctactgcagcaggctactggacctggtcttcctgctggatggctcctccagg

SEQ ID NO: 9003 - DNA, 201 bp, Homo sapiens
gacctgcgggctgtgtggcaactttaacatctttgctgaagatgactttatgacccaagaagggaccttgacctcggacccttatgactttgccaactcawgggctctgagcagtggagaacagtggtgtgaacgggcatctcctcccagcagctcatgcaacatctcctctggggaaatgcagaagggcctgtgggagca

SEQ ID NO: 9004 - DNA, 201 bp, Homo sapiens
ctgtatgtggaggacatctcggaaccgccgttgcacgatttctactgcagcaggctactggacctggtcttcctgctggatggctcctccaggctgtccgdggctgagtttgaagtgctgaaggcctttgtggtggacatgatggagcggctgcgcatctcccagaagtgggtccgcgtggccgtggtggagtaccacgac

SEQ ID NO: 9005 - DNA, 201 bp, Homo sapiens
tcgtgctgagcagtgtggatgagctggagcagcaaagggacgagatcgttagctacctctgtgaccttgcccctgaagcccctcctcctactctgcccccmgacatggcacaagtcactgtgggcccggggctcttgggggtttcgaccctggggcccaagaggaactccatggttctggatgtggcgttcgtcctggaag

SEQ ID NO: 9006 - DNA, 201 bp, Homo sapiens
gcagcaaagggacgagatcgttagctacctctgtgaccttgcccctgaagcccctcctcctactctgccccccgacatggcacaagtcactgtgggcccgkggctcttgggggtttcgaccctggggcccaagaggaactccatggttctggatgtggcgttcgtcctggaaggatcggacaaaattggtgaagccgactt

SEQ ID NO: 9007 - DNA, 201 bp, Homo sapiens
ttcatgcactgtaccatgagtggagtccccggaagcttgctgcctgacgctgtcctcagcagtcccctgtctcatcgcagcaaaaggagcctatcctgtcrgccccccatggtcaagctggtgtgtcccgctgacaacctgcgggctgaagggctcgagtgtaccaaaacgtgccagaactatgacctggagtgcatgagc

SEQ ID NO: 9008 - DNA, 201 bp, Homo sapiens
ccctgaagcccctcctcctactctgccccccgacatggcacaagtcactgtgggcccggggctcttgggggtttcgaccctggggcccaagaggaactccrtggttctggatgtggcgttcgtcctggaaggatcggacaaaattggtgaagccgacttcaacaggagcaaggagttcatggaggaggtgattcagcggat

SEQ ID NO: 9009 - DNA, 201 bp, Homo sapiens
gcactgtaccatgagtggagtccccggaagcttgctgcctgacgctgtcctcagcagtcccctgtctcatcgcagcaaaaggagcctatcctgtcggcccyccatggtcaagctggtgtgtcccgctgacaacctgcgggctgaagggctcgagtgtaccaaaacgtgccagaactatgacctggagtgcatgagcatggg

SEQ ID NO: 9010 - DNA, 201 bp, Homo sapiens
caggagccccaacggatgtcccggaactttgtccgctacgtccagggcctgaagaagaagaaggtcattgtgatcccggtgggcattgggccccatgccarcctcaagcagatccgcctcatcgagaagcaggcccctgagaacaaggccttcgtgctgagcagtgtggatgagctggagcagcaaagggacgagatcgtt

SEQ ID NO: 9011 - DNA, 201 bp, Homo sapiens
caagtggaggaagaccctgtggactttgggaactcctggaaagtgagctcgcagtgtgctgacaccagaaaagtgcctctggactcatcccctgccacctkccataacaacatcatgaagcagacgatggtggattcctcctgtagaatccttaccagtgacgtcttccaggactgcaacaagctggtggaccccgagcca

SEQ ID NO: 9012 - DNA, 201 bp, Homo sapiens
gaaggcagctgtgtccctgaagaggcctgcactcagtgcattggtgaggatggagtccagcaccagttcctggaagcctgggtcccggaccaccagccctktcagatctgcacatgcctcagcgggcggaaggtcaactgcacaacgcagccctgccccacggccaaagctcccacgtgtggcctgtgtgaagtagcccgc

SEQ ID NO: 9013 - DNA, 201 bp, Homo sapiens
gaagcttgctgcctgacgctgtcctcagcagtcccctgtctcatcgcagcaaaaggagcctatcctgtcggccccccatggtcaagctggtgtgtcccgckgacaacctgcgggctgaagggctcgagtgtaccaaaacgtgccagaactatgacctggagtgcatgagcatgggctgtgtctctggctgcctctgccccc

SEQ ID NO: 9014 - DNA, 201 bp, Homo sapiens
acctggagtgcatgagcatgggctgtgtctctggctgcctctgccccccgggcatggtccggcatgagaacagatgtgtggccctggaaaggtgtccctgmttccatcagggcaaggagtatgcccctggagaaacagtgaagattggctgcaacacttgtgtctgtcgggaccggaagtggaactgcacagaccatgtgt

SEQ ID NO: 9015 - DNA, 201 bp, Homo sapiens
tggccctcattttgccagggaccctttgtgcagaaggaactcgcggcaggtcatccacggcccgatgcagccttttcggaagtgacttcgtcaacaccttygatgggagcatgtacagctttgcgggatactgcagttacctcctggcagggggctgccagaaacgctccttctcgattattggggacttccagaatggca

SEQ ID NO: 9016 - DNA, 201 bp, Homo sapiens
ggtgaagccgacttcaacaggagcaaggagttcatggaggaggtgattcagcggatggatgtgggccaggacagcatccacgtcacggtgctgcagtactmctacatggtgaccgtggagtaccccttcagcgaggcacagtccaaaggggacatcctgcagcgggtgcgagagatccgctaccagggcggcaacaggacc

SEQ ID NO: 9017 - DNA, 201 bp, Homo sapiens
cagcaacctccaagtggaggaagaccctgtggactttgggaactcctggaaagtgagctcgcagtgtgctgacaccagaaaagtgcctctggactcatccrctgccacctgccataacaacatcatgaagcagacgatggtggattcctcctgtagaatccttaccagtgacgtcttccaggactgcaacaagctggtgga

SEQ ID NO: 9018 - DNA, 201 bp, Homo sapiens
cctctccgtcgagctgcacagtgacatggaggtgacggtgaatgggagactggtctctgttccttacgtgggtgggaacatggaagtcaacgtttatggtkccatcatgcatgaggtcagattcaatcaccttggtcacatcttcacattcactccacaaaacaatgagttccaactgcagctcagccccaagacttttgc

SEQ ID NO: 9019 - DNA, 201 bp, Homo sapiens
tcacatcttcacattcactccacaaaacaatgagttccaactgcagctcagccccaagacttttgcttcaaagacgtatggtctgtgtgggatctgtgatkagaacggagccaatgacttcatgctgagggatggcacagtcaccacagactggaaaacacttgttcaggaatggactgtgcagcggccagggcagacgtg

SEQ ID NO: 9020 - DNA, 201 bp, Homo sapiens
ggctgcctctgccccccgggcatggtccggcatgagaacagatgtgtggccctggaaaggtgtccctgcttccatcagggcaaggagtatgcccctggagraacagtgaagattggctgcaacacttgtgtctgtcgggaccggaagtggaactgcacagaccatgtgtgtgatgccacgtgctccacgatcggcatggcc

SEQ ID NO: 9021 - DNA, 201 bp, Homo sapiens
gtcccccacattcgaggcctgccatcgtgccgtcagcccgctgccctacctgcggaactgccgctacgacgtgtgctcctgctcggacggccgcgagtgcytgtgcggcgccctggccagctatgccgcggcctgcgcggggagaggcgtgcgcgtcgcgtggcgcgagccaggccgctgtgagctgaactgcccgaaagg

SEQ ID NO: 9022 - DNA, 201 bp, Homo sapiens
gcggcgccctggccagctatgccgcggcctgcgcggggagaggcgtgcgcgtcgcgtggcgcgagccaggccgctgtgagctgaactgcccgaaaggccargtgtacctgcagtgcgggaccccctgcaacctgacctgccgctctctctcttacccggatgaggaatgcaatgaggcctgcctggagggctgcttctgcc

SEQ ID NO: 9023 - DNA, 201 bp, Homo sapiens
ttgacaacagatacttcaccttcagtgggatctgccagtacctgctggcccgggattgccaggaccactccttctccattgtcattgagactgtccagtgygctgatgaccgcgacgctgtgtgcacccgctccgtcaccgtccggctgcctggcctgcacaacagccttgtgaaactgaagcatggggcaggagttgcca

SEQ ID NO: 9024 - DNA, 201 bp, Homo sapiens
actgcaccaatggctctgttgtgtaccatgaggttctcaatgccatggagtgcaaatgctcccccaggaagtgcagcaagtgaggctgctgcagctgcatyggtgcctgctgctgcctgccttggcctgatggccaggccagagtgctgccagtcctctgcatgttctgctcttgtgcccttctgagcccacaataaaggc

SEQ ID NO: 9025 - DNA, 201 bp, Homo sapiens
tgcaacctgacctgccgctctctctcttacccggatgaggaatgcaatgaggcctgcctggagggctgcttctgccccccagggctctacatggatgagargggggactgcgtgcccaaggcccagtgcccctgttactatgacggtgagatcttccagccagaagacatcttctcagaccatcacaccatgtgctactgt

SEQ ID NO: 9026 - DNA, 201 bp, Homo sapiens
ggtgagccccaccactctgtatgtggaggacatctcggaaccgccgttgcacgatttctactgcagcaggctactggacctggtcttcctgctggatggcwcctccaggctgtccgaggctgagtttgaagtgctgaaggcctttgtggtggacatgatggagcggctgcgcatctcccagaagtgggtccgcgtggccgt

SEQ ID NO: 9027 - DNA, 201 bp, Homo sapiens
gcccgatgcagccttttcggaagtgacttcgtcaacacctttgatgggagcatgtacagctttgcgggatactgcagttacctcctggcagggggctgccwgaaacgctccttctcgattattggggacttccagaatggcaagagagtgagcctctccgtgtatcttggggaattttttgacatccatttgtttgtcaat

SEQ ID NO: 9028 - DNA, 201 bp, Homo sapiens
  misc_feature (1)...(201): n = A,T,C or G, or insertion/deletion polymorphism (see Tables 1-2)
atttgccactgtgatgttgtcaacctcacctgtgaagcctgccaggagccgggaggcctggtggtgcctcccacagatgccccggtgagccccaccactcngtatgtggaggacatctcggaaccgccgttgcacgatttctactgcagcaggctactggacctggtcttcctgctggatggctcctccaggctgtccgag

SEQ ID NO: 9029 - DNA, 201 bp, Homo sapiens
gcctcaggaaagaaagtcaccttgaatcccagtgaccctgagcactgccagatttgccactgtgatgttgtcaacctcacctgtgaagcctgccaggagcsgggaggcctggtggtgcctcccacagatgccccggtgagccccaccactctgtatgtggaggacatctcggaaccgccgttgcacgatttctactgcagc

SEQ ID NO: 9030 - DNA, 201 bp, Homo sapiens
tgtgcacctgcctgtcaagtcacgtgtcagcaccctgagccactggcctgccctgtgcagtgtgtggagggctgccatgcccactgccctccagggaaaaycctggatgagcttttgcagacctgcgttgaccctgaagactgtccagtgtgtgaggtggctggccggcgttttgcctcaggaaagaaagtcaccttgaat

SEQ ID NO: 9031 - DNA, 201 bp, Homo sapiens
acctgcctgtcaagtcacgtgtcagcaccctgagccactggcctgccctgtgcagtgtgtggagggctgccatgcccactgccctccagggaaaatcctgsatgagcttttgcagacctgcgttgaccctgaagactgtccagtgtgtgaggtggctggccggcgttttgcctcaggaaagaaagtcaccttgaatcccag

SEQ ID NO: 9032 - DNA, 201 bp, Homo sapiens
tccagtgtgtgaggtggctggccggcgttttgcctcaggaaagaaagtcaccttgaatcccagtgaccctgagcactgccagatttgccactgtgatgttbtcaacctcacctgtgaagcctgccaggagccgggaggcctggtggtgcctcccacagatgccccggtgagccccaccactctgtatgtggaggacatctc

SEQ ID NO: 9033 - DNA, 201 bp, Homo sapiens
gagccccaacggatgtcccggaactttgtccgctacgtccagggcctgaagaagaagaaggtcattgtgatcccggtgggcattgggccccatgccaaccycaagcagatccgcctcatcgagaagcaggcccctgagaacaaggccttcgtgctgagcagtgtggatgagctggagcagcaaagggacgagatcgttagc

SEQ ID NO: 9034 - DNA, 201 bp, Homo sapiens
ccggggctcttgggggtttcgaccctggggcccaagaggaactccatggttctggatgtggcgttcgtcctggaaggatcggacaaaattggtgaagccgrcttcaacaggagcaaggagttcatggaggaggtgattcagcggatggatgtgggccaggacagcatccacgtcacggtgctgcagtactcctacatggtg

SEQ ID NO: 9035 - DNA, 201 bp, Homo sapiens
agcagtgtcttgtccccgacagctcccactgccaggtcctcctcttaccactgtttgctgaatgccacaaggtcctggctccagccacattctatgccatytgccagcaggacagttgccaccaggagcaagtgtgtgaggtgatcgcctcttatgcccacctctgtcggaccaacggggtctgcgttgactggaggacac

SEQ ID NO: 9036 - DNA, 201 bp, Homo sapiens
gaggaactccatggttctggatgtggcgttcgtcctggaaggatcggacaaaattggtgaagccgacttcaacaggagcaaggagttcatggaggaggtgrttcagcggatggatgtgggccaggacagcatccacgtcacggtgctgcagtactcctacatggtgaccgtggagtaccccttcagcgaggcacagtccaa

SEQ ID NO: 9037 - DNA, 201 bp, Homo sapiens
gaatgcaatgaggcctgcctggagggctgcttctgccccccagggctctacatggatgagaggggggactgcgtgcccaaggcccagtgcccctgttactrtgacggtgagatcttccagccagaagacatcttctcagaccatcacaccatgtgctactgtgaggatggcttcatgcactgtaccatgagtggagtcccc

SEQ ID NO: 9038 - DNA, 201 bp, Homo sapiens
acgatgcagcccagctacggatcttggcaggcccagcaggcgactccaacgtggtgaagctccagcgaatcgaagacctccctaccatggtcaccttgggyaattccttcctccacaaactgtgctctggatttgttaggatttgcatggatgaggatgggaatgagaagaggcccggggacgtctggaccttgccagacc

SEQ ID NO: 9039 - DNA, 201 bp, Homo sapiens
agaggaggacagatcatgacactgaagcgtgatgagacgctccaggatggctgtgatactcacttctgcaaggtcaatgagagaggagagtacttctgggrgaagagggtcacaggctgcccaccctttgatgaacacaagtgtctggctgagggaggtaaaattatgaaaattccaggcacctgctgtgacacatgtgag

SEQ ID NO: 9040 - DNA, 201 bp, Homo sapiens
gagaagagggtcacaggctgcccaccctttgatgaacacaagtgtctggctgagggaggtaaaattatgaaaattccaggcacctgctgtgacacatgtgrggagcctgagtgcaacgacatcactgccaggctgcagtatgtcaaggtgggaagctgtaagtctgaagtagaggtggatatccactactgccagggcaaa

SEQ ID NO: 9041 - DNA, 201 bp, Homo sapiens
cccggggctcttgggggtttcgaccctggggcccaagaggaactccatggttctggatgtggcgttcgtcctggaaggatcggacaaaattggtgaagccbacttcaacaggagcaaggagttcatggaggaggtgattcagcggatggatgtgggccaggacagcatccacgtcacggtgctgcagtactcctacatggt

SEQ ID NO: 9042 - DNA, 201 bp, Homo sapiens
cccaagaggaactccatggttctggatgtggcgttcgtcctggaaggatcggacaaaattggtgaagccgacttcaacaggagcaaggagttcatggaggwggtgattcagcggatggatgtgggccaggacagcatccacgtcacggtgctgcagtactcctacatggtgaccgtggagtaccccttcagcgaggcacag

SEQ ID NO: 9043 - DNA, 201 bp, Homo sapiens
tggaagcatcaccaccattgacgtgccatggaacgtggtcccggagaaagcccatttgctgagccttgtggacgtcatgcagcgggagggaggccccagcyaaatcggggatgccttgggctttgctgtgcgatacttgacttcagaaatgcatggtgccaggccgggagcctcaaaggcggtggtcatcctggtcacgga

SEQ ID NO: 9044 - DNA, 201 bp, Homo sapiens
gctgtgcacctgcctgtcaagtcacgtgtcagcaccctgagccactggcctgccctgtgcagtgtgtggagggctgccatgcccactgccctccagggaaratcctggatgagcttttgcagacctgcgttgaccctgaagactgtccagtgtgtgaggtggctggccggcgttttgcctcaggaaagaaagtcaccttga

SEQ ID NO: 9045 - DNA, 201 bp, Homo sapiens
tgccctgtgcagtgtgtggagggctgccatgcccactgccctccagggaaaatcctggatgagcttttgcagacctgcgttgaccctgaagactgtccagkgtgtgaggtggctggccggcgttttgcctcaggaaagaaagtcaccttgaatcccagtgaccctgagcactgccagatttgccactgtgatgttgtcaac

SEQ ID NO: 9046 - DNA, 201 bp, Homo sapiens
cagtgtgtggagggctgccatgcccactgccctccagggaaaatcctggatgagcttttgcagacctgcgttgaccctgaagactgtccagtgtgtgaggyggctggccggcgttttgcctcaggaaagaaagtcaccttgaatcccagtgaccctgagcactgccagatttgccactgtgatgttgtcaacctcacctgt

SEQ ID NO: 9047 - DNA, 201 bp, Homo sapiens
tgcaacacctgcatttgccgaaacagccagtggatctgcagcaatgaagaatgtccaggggagtgccttgtcacaggtcaatcacacttcaagagctttgrcaacagatacttcaccttcagtgggatctgccagtacctgctggcccgggattgccaggaccactccttctccattgtcattgagactgtccagtgtgct

SEQ ID NO: 9048 - DNA, 201 bp, Homo sapiens
agccgacttcaacaggagcaaggagttcatggaggaggtgattcagcggatggatgtgggccaggacagcatccacgtcacggtgctgcagtactcctacrtggtgaccgtggagtaccccttcagcgaggcacagtccaaaggggacatcctgcagcgggtgcgagagatccgctaccagggcggcaacaggaccaacac

SEQ ID NO: 9049 - DNA, 201 bp, Homo sapiens
cggaaagcgctaccctcccggcacctccctctctcgagactgcaacacctgcatttgccgaaacagccagtggatctgcagcaatgaagaatgtccagggragtgccttgtcacaggtcaatcacacttcaagagctttgacaacagatacttcaccttcagtgggatctgccagtacctgctggcccgggattgccagga

SEQ ID NO: 9050 - DNA, 201 bp, Homo sapiens
ggaaccgccgttgcacgatttctactgcagcaggctactggacctggtcttcctgctggatggctcctccaggctgtccgaggctgagtttgaagtgctgraggcctttgtggtggacatgatggagcggctgcgcatctcccagaagtgggtccgcgtggccgtggtggagtaccacgacggctcccacgcctacatcgg

SEQ ID NO: 9051 - DNA, 201 bp, Homo sapiens
gacttcaacaggagcaaggagttcatggaggaggtgattcagcggatggatgtgggccaggacagcatccacgtcacggtgctgcagtactcctacatggwgaccgtggagtaccccttcagcgaggcacagtccaaaggggacatcctgcagcgggtgcgagagatccgctaccagggcggcaacaggaccaacactggg

SEQ ID NO: 9052 - DNA, 201 bp, Homo sapiens
aacgggcatctcctcccagcagctcatgcaacatctcctctggggaaatgcagaagggcctgtgggagcagtgccagcttctgaagagcacctcggtgttwgcccgctgccaccctctggtggaccccgagccttttgtggccctgtgtgagaagactttgtgtgagtgtgctggggggctggagtgcgcctgccctgccc

SEQ ID NO: 9053 - DNA, 201 bp, Homo sapiens
tctctctcttacccggatgaggaatgcaatgaggcctgcctggagggctgcttctgccccccagggctctacatggatgagaggggggactgcgtgcccarggcccagtgcccctgttactatgacggtgagatcttccagccagaagacatcttctcagaccatcacaccatgtgctactgtgaggatggcttcatgcac

SEQ ID NO: 9054 - DNA, 201 bp, Homo sapiens
ttgtcattgagactgtccagtgtgctgatgaccgcgacgctgtgtgcacccgctccgtcaccgtccggctgcctggcctgcacaacagccttgtgaaactraagcatggggcaggagttgccatggatggccaggacgtccagctccccctcctgaaaggtgacctccgcatccagcgtacagtgacggcctccgtgcgcc

SEQ ID NO: 9055 - DNA, 201 bp, Homo sapiens
acctgccgctctctctcttacccggatgaggaatgcaatgaggcctgcctggagggctgcttctgccccccagggctctacatggatgagaggggggactrcgtgcccaaggcccagtgcccctgttactatgacggtgagatcttccagccagaagacatcttctcagaccatcacaccatgtgctactgtgaggatggc

SEQ ID NO: 9056 - DNA, 201 bp, Homo sapiens
gggccaggacagcatccacgtcacggtgctgcagtactcctacatggtgaccgtggagtaccccttcagcgaggcacagtccaaaggggacatcctgcagygggtgcgagagatccgctaccagggcggcaacaggaccaacactgggctggccctgcggtacctctctgaccacagcttcttggtcagccagggtgaccg

SEQ ID NO: 9057 - DNA, 201 bp, Homo sapiens
gaggaggtgattcagcggatggatgtgggccaggacagcatccacgtcacggtgctgcagtactcctacatggtgaccgtggagtaccccttcagcgaggyacagtccaaaggggacatcctgcagcgggtgcgagagatccgctaccagggcggcaacaggaccaacactgggctggccctgcggtacctctctgaccac

SEQ ID NO: 9058 - DNA, 201 bp, Homo sapiens
acctgctcctgtgagtccattggggactgcgcctgcttctgcgacaccattgctgcctatgcccacgtgtgtgcccagcatggcaaggtggtgacctggargacggccacattgtgcccccagagctgcgaggagaggaatctccgggagaacgggtatgagtgtgagtggcgctataacagctgtgcacctgcctgtcaa

SEQ ID NO: 9059 - DNA, 201 bp, Homo sapiens
catggaggaggtgattcagcggatggatgtgggccaggacagcatccacgtcacggtgctgcagtactcctacatggtgaccgtggagtaccccttcagcraggcacagtccaaaggggacatcctgcagcgggtgcgagagatccgctaccagggcggcaacaggaccaacactgggctggccctgcggtacctctctga

SEQ ID NO: 9060 - DNA, 201 bp, Homo sapiens
tgctgatgaccgcgacgctgtgtgcacccgctccgtcaccgtccggctgcctggcctgcacaacagccttgtgaaactgaagcatggggcaggagttgccrtggatggccaggacgtccagctccccctcctgaaaggtgacctccgcatccagcgtacagtgacggcctccgtgcgcctcagctacggggaggacctgca

SEQ ID NO: 9061 - DNA, 201 bp, Homo sapiens
acctgcgttgaccctgaagactgtccagtgtgtgaggtggctggccggcgttttgcctcaggaaagaaagtcaccttgaatcccagtgaccctgagcactdccagatttgccactgtgatgttgtcaacctcacctgtgaagcctgccaggagccgggaggcctggtggtgcctcccacagatgccccggtgagccccacc

SEQ ID NO: 9062 - DNA, 201 bp, Homo sapiens
gacctgcgttgaccctgaagactgtccagtgtgtgaggtggctggccggcgttttgcctcaggaaagaaagtcaccttgaatcccagtgaccctgagcacygccagatttgccactgtgatgttgtcaacctcacctgtgaagcctgccaggagccgggaggcctggtggtgcctcccacagatgccccggtgagccccac

SEQ ID NO: 9063 - DNA, 201 bp, Homo sapiens
gccactggcctgccctgtgcagtgtgtggagggctgccatgcccactgccctccagggaaaatcctggatgagcttttgcagacctgcgttgaccctgaaractgtccagtgtgtgaggtggctggccggcgttttgcctcaggaaagaaagtcaccttgaatcccagtgaccctgagcactgccagatttgccactgtga

SEQ ID NO: 9064 - DNA, 201 bp, Homo sapiens
ggcctccaccagcgaggtcttgaaatacacactgttccaaatcttcagcaagatcgaccgccctgaagcctcccgcatcaccctgctcctgatggccagcsaggagccccaacggatgtcccggaactttgtccgctacgtccagggcctgaagaagaagaaggtcattgtgatcccggtgggcattgggccccatgccaa

SEQ ID NO: 9065 - DNA, 201 bp, Homo sapiens
agtcacgtgtcagcaccctgagccactggcctgccctgtgcagtgtgtggagggctgccatgcccactgccctccagggaaaatcctggatgagcttttgbagacctgcgttgaccctgaagactgtccagtgtgtgaggtggctggccggcgttttgcctcaggaaagaaagtcaccttgaatcccagtgaccctgagca

SEQ ID NO: 9066 - DNA, 201 bp, Homo sapiens
acgatgtgcaggaccagtgctcctgctgctctccgacacggacggagcccatgcaggtggccctgcactgcaccaatggctctgttgtgtaccatgaggtyctcaatgccatggagtgcaaatgctcccccaggaagtgcagcaagtgaggctgctgcagctgcatgggtgcctgctgctgcctgccttggcctgatggcc

SEQ ID NO: 9067 - DNA, 201 bp, Homo sapiens
tgaagactgtccagtgtgtgaggtggctggccggcgttttgcctcaggaaagaaagtcaccttgaatcccagtgaccctgagcactgccagatttgccacygtgatgttgtcaacctcacctgtgaagcctgccaggagccgggaggcctggtggtgcctcccacagatgccccggtgagccccaccactctgtatgtgga

SEQ ID NO: 9068 - DNA, 201 bp, Homo sapiens
ccagggaaaatcctggatgagcttttgcagacctgcgttgaccctgaagactgtccagtgtgtgaggtggctggccggcgttttgcctcaggaaagaaagycaccttgaatcccagtgaccctgagcactgccagatttgccactgtgatgttgtcaacctcacctgtgaagcctgccaggagccgggaggcctggtggtg

SEQ ID NO: 9069 - DNA, 201 bp, Homo sapiens
tgtcattgggcccgggaagactgtgatgatcgatgtgtgcacgacctgccgctgcatggtgcaggtgggggtcatctctggattcaagctggagtgcaggragaccacctgcaacccctgccccctgggttacaaggaagaaaataacacaggtgaatgttgtgggagatgtttgcctacggcttgcaccattcagctaag

SEQ ID NO: 9070 - DNA, 201 bp, Homo sapiens
ccagtgtgtgaggtggctggccggcgttttgcctcaggaaagaaagtcaccttgaatcccagtgaccctgagcactgccagatttgccactgtgatgttgwcaacctcacctgtgaagcctgccaggagccgggaggcctggtggtgcctcccacagatgccccggtgagccccaccactctgtatgtggaggacatctcg

SEQ ID NO: 9071 - DNA, 201 bp, Homo sapiens
ctgtggctgtaccacaaccacctgccttcccgacaaggtgtgtgtccaccgaagcaccatctaccctgtgggccagttctgggaggagggctgcgatgtgygcacctgcaccgacatggaggatgccgtgatgggcctccgcgtggcccagtgctcccagaagccctgtgaggacagctgtcggtcgggcttcacttacgt

SEQ ID NO: 9072 - DNA, 201 bp, Homo sapiens
gaccctggggcccaagaggaactccatggttctggatgtggcgttcgtcctggaaggatcggacaaaattggtgaagccgacttcaacaggagcaaggagktcatggaggaggtgattcagcggatggatgtgggccaggacagcatccacgtcacggtgctgcagtactcctacatggtgaccgtggagtaccccttcag

SEQ ID NO: 9073 - DNA, 201 bp, Homo sapiens
cctgtgcccaggagggaatggtgctgtacggctggaccgaccacagcgcgtgcagcccagtgtgccctgctggtatggagtataggcagtgtgtgtccccwtgcgccaggacctgccagagcctgcacatcaatgaaatgtgtcaggagcgatgcgtggatggctgcagctgccctgagggacagctcctggatgaaggcc

SEQ ID NO: 9074 - DNA, 201 bp, Homo sapiens
agctgtcccccgtctatgccgggaagacctgcggcctgtgtgggaattacaatggcaaccagggcgacgacttccttaccccctctgggctggcggagccycgggtggaggacttcgggaacgcctggaagctgcacggggactgccaggacctgcagaagcagcacagcgatccctgcgccctcaacccgcgcatgacca

SEQ ID NO: 9075 - DNA, 201 bp, Homo sapiens
agcacagcgatccctgcgccctcaacccgcgcatgaccaggttctccgaggaggcgtgcgcggtcctgacgtcccccacattcgaggcctgccatcgtgcygtcagcccgctgccctacctgcggaactgccgctacgacgtgtgctcctgctcggacggccgcgagtgcctgtgcggcgccctggccagctatgccgcgg

SEQ ID NO: 9076 - DNA, 201 bp, Homo sapiens
tctggtggaccccgagccttttgtggccctgtgtgagaagactttgtgtgagtgtgctggggggctggagtgcgcctgccctgccctcctggagtacgccyggacctgtgcccaggagggaatggtgctgtacggctggaccgaccacagcgcgtgcagcccagtgtgccctgctggtatggagtataggcagtgtgtgtc

SEQ ID NO: 9077 - DNA, 201 bp, Homo sapiens
actttgggaactcctggaaagtgagctcgcagtgtgctgacaccagaaaagtgcctctggactcatcccctgccacctgccataacaacatcatgaagcakacgatggtggattcctcctgtagaatccttaccagtgacgtcttccaggactgcaacaagctggtggaccccgagccatatctggatgtctgcatttacg

SEQ ID NO: 9078 - DNA, 201 bp, Homo sapiens
agtgagctcgcagtgtgctgacaccagaaaagtgcctctggactcatcccctgccacctgccataacaacatcatgaagcagacgatggtggattcctccygtagaatccttaccagtgacgtcttccaggactgcaacaagctggtggaccccgagccatatctggatgtctgcatttacgacacctgctcctgtgagtc

SEQ ID NO: 9079 - DNA, 201 bp, Homo sapiens
ggaccccgagccttttgtggccctgtgtgagaagactttgtgtgagtgtgctggggggctggagtgcgcctgccctgccctcctggagtacgcccggaccwgtgcccaggagggaatggtgctgtacggctggaccgaccacagcgcgtgcagcccagtgtgccctgctggtatggagtataggcagtgtgtgtccccttg

SEQ ID NO: 9080 - DNA, 201 bp, Homo sapiens
caaggtggtgacctggaggacggccacattgtgcccccagagctgcgaggagaggaatctccgggagaacgggtatgagtgtgagtggcgctataacagcygtgcacctgcctgtcaagtcacgtgtcagcaccctgagccactggcctgccctgtgcagtgtgtggagggctgccatgcccactgccctccagggaaaat

SEQ ID NO: 9081 - DNA, 201 bp, Homo sapiens
ctgcaacacttgtgtctgtcgggaccggaagtggaactgcacagaccatgtgtgtgatgccacgtgctccacgatcggcatggcccactacctcaccttcracgggctcaaatacctgttccccggggagtgccagtacgttctggtgcaggattactgcggcagtaaccctgggacctttcggatcctagtggggaataa

SEQ ID NO: 9082 - DNA, 201 bp, Homo sapiens
gcggcgcattgccagccaggtgaagtatgcgggcagccaggtggcctccaccagcgaggtcttgaaatacacactgttccaaatcttcagcaagatcgacygccctgaagcctcccgcatcaccctgctcctgatggccagccaggagccccaacggatgtcccggaactttgtccgctacgtccagggcctgaagaagaa

SEQ ID NO: 9083 - DNA, 201 bp, Homo sapiens
aacagatgtgtggccctggaaaggtgtccctgcttccatcagggcaaggagtatgcccctggagaaacagtgaagattggctgcaacacttgtgtctgtcrggaccggaagtggaactgcacagaccatgtgtgtgatgccacgtgctccacgatcggcatggcccactacctcaccttcgacgggctcaaatacctgttc

SEQ ID NO: 9084 - DNA, 201 bp, Homo sapiens
gcttccatcagggcaaggagtatgcccctggagaaacagtgaagattggctgcaacacttgtgtctgtcgggaccggaagtggaactgcacagaccatgtktgtgatgccacgtgctccacgatcggcatggcccactacctcaccttcgacgggctcaaatacctgttccccggggagtgccagtacgttctggtgcagg

SEQ ID NO: 9085 - DNA, 201 bp, Homo sapiens
ggctcaaatacctgttccccggggagtgccagtacgttctggtgcaggattactgcggcagtaaccctgggacctttcggatcctagtggggaataagggmtgcagccacccctcagtgaaatgcaagaaacgggtcaccatcctggtggagggaggagagattgagctgtttgacggggaggtgaatgtgaagaggccca

SEQ ID NO: 9086 - DNA, 201 bp, Homo sapiens
ctctgttccttacgtgggtgggaacatggaagtcaacgtttatggtgccatcatgcatgaggtcagattcaatcaccttggtcacatcttcacattcactycacaaaacaatgagttccaactgcagctcagccccaagacttttgcttcaaagacgtatggtctgtgtgggatctgtgatgagaacggagccaatgactt

SEQ ID NO: 9087 - DNA, 201 bp, Homo sapiens
cagggtgaccgggagcaggcgcccaacctggtctacatggtcaccggaaatcctgcctctgatgagatcaagaggctgcctggagacatccaggtggtgcmcattggagtgggccctaatgccaacgtgcaggagctggagaggattggctggcccaatgcccctatcctcatccaggactttgagacgctcccccgagag

SEQ ID NO: 9088 - DNA, 201 bp, Homo sapiens
ccaggtggtgcccattggagtgggccctaatgccaacgtgcaggagctggagaggattggctggcccaatgcccctatcctcatccaggactttgagacgmtcccccgagaggctcctgacctggtgctgcagaggtgctgctccggagaggggctgcagatccccaccctctcccctgcacctgactgcagccagcccct

SEQ ID NO: 9089 - DNA, 201 bp, Homo sapiens
cattggggactgcgcctgcttctgcgacaccattgctgcctatgcccacgtgtgtgcccagcatggcaaggtggtgacctggaggacggccacattgtgcrcccagagctgcgaggagaggaatctccgggagaacgggtatgagtgtgagtggcgctataacagctgtgcacctgcctgtcaagtcacgtgtcagcaccc

SEQ ID NO: 9090 - DNA, 201 bp, Homo sapiens
cttcatgctgagggatggcacagtcaccacagactggaaaacacttgttcaggaatggactgtgcagcggccagggcagacgtgccagcccatcctggagkagcagtgtcttgtccccgacagctcccactgccaggtcctcctcttaccactgtttgctgaatgccacaaggtcctggctccagccacattctatgccat

SEQ ID NO: 9091 - DNA, 201 bp, Homo sapiens
ggtcctcctcttaccactgtttgctgaatgccacaaggtcctggctccagccacattctatgccatctgccagcaggacagttgccaccaggagcaagtgkgtgaggtgatcgcctcttatgcccacctctgtcggaccaacggggtctgcgttgactggaggacacctgatttctgtgctatgtcatgcccaccatctct

SEQ ID NO: 9092 - DNA, 201 bp, Homo sapiens
ctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtgctactgtgaggatggcttcatgcactgtac

SEQ ID NO: 9093 - DNA, 201 bp, Homo sapiens
tacgttctggtgcaggattactgcggcagtaaccctgggacctttcggatcctagtggggaataagggatgcagccacccctcagtgaaatgcaagaaacrggtcaccatcctggtggagggaggagagattgagctgtttgacggggaggtgaatgtgaagaggcccatgaaggatgagactcactttgaggtggtggag

SEQ ID NO: 9094 - DNA, 201 bp, Homo sapiens
gcccctgttactatgacggtgagatcttccagccagaagacatcttctcagaccatcacaccatgtgctactgtgaggatggcttcatgcactgtaccatragtggagtccccggaagcttgctgcctgacgctgtcctcagcagtcccctgtctcatcgcagcaaaaggagcctatcctgtcggccccccatggtcaagc

SEQ ID NO: 9095 - DNA, 201 bp, Homo sapiens
agcgtacagtgacggcctccgtgcgcctcagctacggggaggacctgcagatggactgggatggccgcgggaggctgctggtgaagctgtcccccgtctaygccgggaagacctgcggcctgtgtgggaattacaatggcaaccagggcgacgacttccttaccccctctgggctggcggagccccgggtggaggacttcg

SEQ ID NO: 9096 - DNA, 165 bp, Homo sapiens
atggcaacggtgggcaggggctgagttctgagaccggttctgaggaaggaagcacaggccccatctgcaagcctcagtgtcagtgtgagatactgccaacytctggggaagagtgatgtctttgcctccaggggtgggaaaggcatagcatggggtaggcctctt

SEQ ID NO: 9097 - DNA, 201 bp, Homo sapiens
cctgacgctgtcctcagcagtcccctgtctcatcgcagcaaaaggagcctatcctgtcggccccccatggtcaagctggtgtgtcccgctgacaacctgcrggctgaagggctcgagtgtaccaaaacgtgccagaactatgacctggagtgcatgagcatgggctgtgtctctggctgcctctgccccccgggcatggtc

SEQ ID NO: 9098 - DNA, 201 bp, Homo sapiens; identical to SEQ ID NO: 8989

SEQ ID NO: 9099 - DNA, 201 bp, Homo sapiens
ccattgacatcaacgatgtgcaggaccagtgctcctgctgctctccgacacggacggagcccatgcaggtggccctgcactgcaccaatggctctgttgtktaccatgaggttctcaatgccatggagtgcaaatgctcccccaggaagtgcagcaagtgaggctgctgcagctgcatgggtgcctgctgctgcctgcctt

SEQ ID NO: 9100 - DNA, 201 bp, Homo sapiens
acctgtgaagcctgccaggagccgggaggcctggtggtgcctcccacagatgccccggtgagccccaccactctgtatgtggaggacatctcggaaccgcygttgcacgatttctactgcagcaggctactggacctggtcttcctgctggatggctcctccaggctgtccgaggctgagtttgaagtgctgaaggccttt

SEQ ID NO: 9101 - DNA, 201 bp, Homo sapiens
tgaagcctgccaggagccgggaggcctggtggtgcctcccacagatgccccggtgagccccaccactctgtatgtggaggacatctcggaaccgccgttgsacgatttctactgcagcaggctactggacctggtcttcctgctggatggctcctccaggctgtccgaggctgagtttgaagtgctgaaggcctttgtggt

SEQ ID NO: 9102 - DNA, 201 bp, Homo sapiens
atggcacaagtcactgtgggcccggggctcttgggggtttcgaccctggggcccaagaggaactccatggttctggatgtggcgttcgtcctggaaggatyggacaaaattggtgaagccgacttcaacaggagcaaggagttcatggaggaggtgattcagcggatggatgtgggccaggacagcatccacgtcacggtg

SEQ ID NO: 9103 - DNA, 201 bp, Homo sapiens
cgggtgcgagagatccgctaccagggcggcaacaggaccaacactgggctggccctgcggtacctctctgaccacagcttcttggtcagccagggtgaccrggagcaggcgcccaacctggtctacatggtcaccggaaatcctgcctctgatgagatcaagaggctgcctggagacatccaggtggtgcccattggagtg

SEQ ID NO: 9104 - DNA, 201 bp, Homo sapiens
agcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccagttcctggaagcctgggtcccggaccaccagccctgtcaga

SEQ ID NO: 9105 - DNA, 201 bp, Homo sapiens
gaccaacactgggctggccctgcggtacctctctgaccacagcttcttggtcagccagggtgaccgggagcaggcgcccaacctggtctacatggtcaccrgaaatcctgcctctgatgagatcaagaggctgcctggagacatccaggtggtgcccattggagtgggccctaatgccaacgtgcaggagctggagaggat

SEQ ID NO: 9106 - DNA, 201 bp, Homo sapiens
aaaaggagcctatcctgtcggccccccatggtcaagctggtgtgtcccgctgacaacctgcgggctgaagggctcgagtgtaccaaaacgtgccagaactrtgacctggagtgcatgagcatgggctgtgtctctggctgcctctgccccccgggcatggtccggcatgagaacagatgtgtggccctggaaaggtgtccc

SEQ ID NO: 9107 - DNA, 201 bp, Homo sapiens
gccacattgtgcccccagagctgcgaggagaggaatctccgggagaacgggtatgagtgtgagtggcgctataacagctgtgcacctgcctgtcaagtcaygtgtcagcaccctgagccactggcctgccctgtgcagtgtgtggagggctgccatgcccactgccctccagggaaaatcctggatgagcttttgcagacc

SEQ ID NO: 9108 - DNA, 201 bp, Homo sapiens
agctgtaagtctgaagtagaggtggatatccactactgccagggcaaatgtgccagcaaagccatgtactccattgacatcaacgatgtgcaggaccagtrctcctgctgctctccgacacggacggagcccatgcaggtggccctgcactgcaccaatggctctgttgtgtaccatgaggttctcaatgccatggagtgc

SEQ ID NO: 9109 - DNA, 201 bp, Homo sapiens
caccatgtgctactgtgaggatggcttcatgcactgtaccatgagtggagtccccggaagcttgctgcctgacgctgtcctcagcagtcccctgtctcatygcagcaaaaggagcctatcctgtcggccccccatggtcaagctggtgtgtcccgctgacaacctgcgggctgaagggctcgagtgtaccaaaacgtgcca

SEQ ID NO: 9110 - DNA, 201 bp, Homo sapiens
gcgggtgcgagagatccgctaccagggcggcaacaggaccaacactgggctggccctgcggtacctctctgaccacagcttcttggtcagccagggtgacbgggagcaggcgcccaacctggtctacatggtcaccggaaatcctgcctctgatgagatcaagaggctgcctggagacatccaggtggtgcccattggagt

SEQ ID NO: 9111 - DNA, 201 bp, Homo sapiens
tgctcctgctgctctccgacacggacggagcccatgcaggtggccctgcactgcaccaatggctctgttgtgtaccatgaggttctcaatgccatggagtrcaaatgctcccccaggaagtgcagcaagtgaggctgctgcagctgcatgggtgcctgctgctgcctgccttggcctgatggccaggccagagtgctgcca

SEQ ID NO: 9112 - DNA, 201 bp, Homo sapiens
aacaggaccaacactgggctggccctgcggtacctctctgaccacagcttcttggtcagccagggtgaccgggagcaggcgcccaacctggtctacatggwcaccggaaatcctgcctctgatgagatcaagaggctgcctggagacatccaggtggtgcccattggagtgggccctaatgccaacgtgcaggagctggag

SEQ ID NO: 9113 - DNA, 201 bp, Homo sapiens
agtgacagtgttccctattggaattggagatcgctacgatgcagcccagctacggatcttggcaggcccagcaggcgactccaacgtggtgaagctccagygaatcgaagacctccctaccatggtcaccttgggcaattccttcctccacaaactgtgctctggatttgttaggatttgcatggatgaggatgggaatga

SEQ ID NO: 9114 - DNA, 201 bp, Homo sapiens
tcacctgtgaagcctgccaggagccgggaggcctggtggtgcctcccacagatgccccggtgagccccaccactctgtatgtggaggacatctcggaaccrccgttgcacgatttctactgcagcaggctactggacctggtcttcctgctggatggctcctccaggctgtccgaggctgagtttgaagtgctgaaggcct

SEQ ID NO: 9115 - DNA, 201 bp, Homo sapiens
gatgccccggtgagccccaccactctgtatgtggaggacatctcggaaccgccgttgcacgatttctactgcagcaggctactggacctggtcttcctgckggatggctcctccaggctgtccgaggctgagtttgaagtgctgaaggcctttgtggtggacatgatggagcggctgcgcatctcccagaagtgggtccgc

SEQ ID NO: 9116 - DNA, 201 bp, Homo sapiens
ctgcacaacagccttgtgaaactgaagcatggggcaggagttgccatggatggccaggacgtccagctccccctcctgaaaggtgacctccgcatccagcrtacagtgacggcctccgtgcgcctcagctacggggaggacctgcagatggactgggatggccgcgggaggctgctggtgaagctgtcccccgtctatgcc

SEQ ID NO: 9117 - DNA, 201 bp, Homo sapiens
gtgagccccaccactctgtatgtggaggacatctcggaaccgccgttgcacgatttctactgcagcaggctactggacctggtcttcctgctggatggctyctccaggctgtccgaggctgagtttgaagtgctgaaggcctttgtggtggacatgatggagcggctgcgcatctcccagaagtgggtccgcgtggccgtg

SEQ ID NO: 9118 - DNA, 201 bp, Homo sapiens
tgaccgggagcaggcgcccaacctggtctacatggtcaccggaaatcctgcctctgatgagatcaagaggctgcctggagacatccaggtggtgcccattrgagtgggccctaatgccaacgtgcaggagctggagaggattggctggcccaatgcccctatcctcatccaggactttgagacgctcccccgagaggctcc

SEQ ID NO: 9119 - DNA, 201 bp, Homo sapiens
cgctgtgtgcacccgctccgtcaccgtccggctgcctggcctgcacaacagccttgtgaaactgaagcatggggcaggagttgccatggatggccaggacrtccagctccccctcctgaaaggtgacctccgcatccagcgtacagtgacggcctccgtgcgcctcagctacggggaggacctgcagatggactgggatgg

SEQ ID NO: 9120 - DNA, 201 bp, Homo sapiens
cgggagcaggcgcccaacctggtctacatggtcaccggaaatcctgcctctgatgagatcaagaggctgcctggagacatccaggtggtgcccattggagwgggccctaatgccaacgtgcaggagctggagaggattggctggcccaatgcccctatcctcatccaggactttgagacgctcccccgagaggctcctgac

SEQ ID NO: 9121 - DNA, 201 bp, Homo sapiens
gaagtatgcgggcagccaggtggcctccaccagcgaggtcttgaaatacacactgttccaaatcttcagcaagatcgaccgccctgaagcctcccgcatcrccctgctcctgatggccagccaggagccccaacggatgtcccggaactttgtccgctacgtccagggcctgaagaagaagaaggtcattgtgatcccggt

SEQ ID NO: 9122 - DNA, 201 bp, Homo sapiens
tctcatcgcagcaaaaggagcctatcctgtcggccccccatggtcaagctggtgtgtcccgctgacaacctgcgggctgaagggctcgagtgtaccaaaaygtgccagaactatgacctggagtgcatgagcatgggctgtgtctctggctgcctctgccccccgggcatggtccggcatgagaacagatgtgtggccctg

SEQ ID NO: 9123 - DNA, 201 bp, Homo sapiens
ggaccgaccacagcgcgtgcagcccagtgtgccctgctggtatggagtataggcagtgtgtgtccccttgcgccaggacctgccagagcctgcacatcaawgaaatgtgtcaggagcgatgcgtggatggctgcagctgccctgagggacagctcctggatgaaggcctctgcgtggagagcaccgagtgtccctgcgtgc

SEQ ID NO: 9124 - DNA, 201 bp, Homo sapiens
agtcccctgtctcatcgcagcaaaaggagcctatcctgtcggccccccatggtcaagctggtgtgtcccgctgacaacctgcgggctgaagggctcgagtrtaccaaaacgtgccagaactatgacctggagtgcatgagcatgggctgtgtctctggctgcctctgccccccgggcatggtccggcatgagaacagatgt

SEQ ID NO: 9125 - DNA, 201 bp, Homo sapiens
ggtgcccattggagtgggccctaatgccaacgtgcaggagctggagaggattggctggcccaatgcccctatcctcatccaggactttgagacgctccccygagaggctcctgacctggtgctgcagaggtgctgctccggagaggggctgcagatccccaccctctcccctgcacctgactgcagccagcccctggacgt

SEQ ID NO: 9126 - DNA, 201 bp, Homo sapiens
cagcagtcccctgtctcatcgcagcaaaaggagcctatcctgtcggccccccatggtcaagctggtgtgtcccgctgacaacctgcgggctgaagggctcragtgtaccaaaacgtgccagaactatgacctggagtgcatgagcatgggctgtgtctctggctgcctctgccccccgggcatggtccggcatgagaacag

SEQ ID NO: 9127 - DNA, 201 bp, Homo sapiens
gtcctcagcagtcccctgtctcatcgcagcaaaaggagcctatcctgtcggccccccatggtcaagctggtgtgtcccgctgacaacctgcgggctgaagrgctcgagtgtaccaaaacgtgccagaactatgacctggagtgcatgagcatgggctgtgtctctggctgcctctgccccccgggcatggtccggcatgag

SEQ ID NO: 9128 - DNA, 201 bp, Homo sapiens
tgagatcaagaggctgcctggagacatccaggtggtgcccattggagtgggccctaatgccaacgtgcaggagctggagaggattggctggcccaatgccyctatcctcatccaggactttgagacgctcccccgagaggctcctgacctggtgctgcagaggtgctgctccggagaggggctgcagatccccaccctctc

SEQ ID NO: 9129 - DNA, 201 bp, Homo sapiens
atggtcaccggaaatcctgcctctgatgagatcaagaggctgcctggagacatccaggtggtgcccattggagtgggccctaatgccaacgtgcaggagcyggagaggattggctggcccaatgcccctatcctcatccaggactttgagacgctcccccgagaggctcctgacctggtgctgcagaggtgctgctccgga

SEQ ID NO: 9130 - DNA, 201 bp, Homo sapiens
gcctgacgctgtcctcagcagtcccctgtctcatcgcagcaaaaggagcctatcctgtcggccccccatggtcaagctggtgtgtcccgctgacaacctgygggctgaagggctcgagtgtaccaaaacgtgccagaactatgacctggagtgcatgagcatgggctgtgtctctggctgcctctgccccccgggcatggt

SEQ ID NO: 9131 - DNA, 201 bp, Homo sapiens
ctacatggtcaccggaaatcctgcctctgatgagatcaagaggctgcctggagacatccaggtggtgcccattggagtgggccctaatgccaacgtgcagragctggagaggattggctggcccaatgcccctatcctcatccaggactttgagacgctcccccgagaggctcctgacctggtgctgcagaggtgctgctc

SEQ ID NO: 9132 - DNA, 201 bp, Homo sapiens
ggtgaccgggagcaggcgcccaacctggtctacatggtcaccggaaatcctgcctctgatgagatcaagaggctgcctggagacatccaggtggtgcccaytggagtgggccctaatgccaacgtgcaggagctggagaggattggctggcccaatgcccctatcctcatccaggactttgagacgctcccccgagaggct

SEQ ID NO: 9133 - DNA, 201 bp, Homo sapiens
gcccacaataaaggctgagctcttatcttgcaaaaggctgctggtgcactgtgtcgtagggctgagatggcaacggtgggcaggggctgagttctgagacyggttctgaggaaggaagcacaggccccatctgcaagcctcagtgtcagtgtgagatactgccaacctctggggaagagtgatgtctttgcctccaggggt

SEQ ID NO: 9134 - DNA, 201 bp, Homo sapiens
cctggtcttcctgctggatggctcctccaggctgtccgaggctgagtttgaagtgctgaaggcctttgtggtggacatgatggagcggctgcgcatctccyagaagtgggtccgcgtggccgtggtggagtaccacgacggctcccacgcctacatcgggctcaaggaccggaagcgaccgtcagagctgcggcgcattgc

SEQ ID NO: 9135 - DNA, 201 bp, Homo sapiens
tcggaaccgccgttgcacgatttctactgcagcaggctactggacctggtcttcctgctggatggctcctccaggctgtccgaggctgagtttgaagtgcygaaggcctttgtggtggacatgatggagcggctgcgcatctcccagaagtgggtccgcgtggccgtggtggagtaccacgacggctcccacgcctacatc

SEQ ID NO: 9136 - DNA, 201 bp, Homo sapiens
cctgacgtcccccacattcgaggcctgccatcgtgccgtcagcccgctgccctacctgcggaactgccgctacgacgtgtgctcctgctcggacggccgckagtgcctgtgcggcgccctggccagctatgccgcggcctgcgcggggagaggcgtgcgcgtcgcgtggcgcgagccaggccgctgtgagctgaactgccc

SEQ ID NO: 9137 - DNA, 201 bp, Homo sapiens
ctgctggatggctcctccaggctgtccgaggctgagtttgaagtgctgaaggcctttgtggtggacatgatggagcggctgcgcatctcccagaagtgggwccgcgtggccgtggtggagtaccacgacggctcccacgcctacatcgggctcaaggaccggaagcgaccgtcagagctgcggcgcattgccagccaggtg

SEQ ID NO: 9138 - DNA, 201 bp, Homo sapiens
tggagcggctgcgcatctcccagaagtgggtccgcgtggccgtggtggagtaccacgacggctcccacgcctacatcgggctcaaggaccggaagcgaccrtcagagctgcggcgcattgccagccaggtgaagtatgcgggcagccaggtggcctccaccagcgaggtcttgaaatacacactgttccaaatcttcagca

SEQ ID NO: 9139 - DNA, 201 bp, Homo sapiens
ccacattcgaggcctgccatcgtgccgtcagcccgctgccctacctgcggaactgccgctacgacgtgtgctcctgctcggacggccgcgagtgcctgtgsggcgccctggccagctatgccgcggcctgcgcggggagaggcgtgcgcgtcgcgtggcgcgagccaggccgctgtgagctgaactgcccgaaaggccagg

SEQ ID NO: 9140 - DNA, 201 bp, Homo sapiens
ccacgcctacatcgggctcaaggaccggaagcgaccgtcagagctgcggcgcattgccagccaggtgaagtatgcgggcagccaggtggcctccaccagcraggtcttgaaatacacactgttccaaatcttcagcaagatcgaccgccctgaagcctcccgcatcaccctgctcctgatggccagccaggagccccaacg

SEQ ID NO: 9141 - DNA, 201 bp, Homo sapiens
ccaggtgaagtatgcgggcagccaggtggcctccaccagcgaggtcttgaaatacacactgttccaaatcttcagcaagatcgaccgccctgaagcctccygcatcaccctgctcctgatggccagccaggagccccaacggatgtcccggaactttgtccgctacgtccagggcctgaagaagaagaaggtcattgtgat

SEQ ID NO: 9142 - DNA, 201 bp, Homo sapiens
ccagggcggcaacaggaccaacactgggctggccctgcggtacctctctgaccacagcttcttggtcagccagggtgaccgggagcaggcgcccaacctgktctacatggtcaccggaaatcctgcctctgatgagatcaagaggctgcctggagacatccaggtggtgcccattggagtgggccctaatgccaacgtgca

SEQ ID NO: 9143 - DNA, 201 bp, Homo sapiens
gcgggcagccaggtggcctccaccagcgaggtcttgaaatacacactgttccaaatcttcagcaagatcgaccgccctgaagcctcccgcatcaccctgcycctgatggccagccaggagccccaacggatgtcccggaactttgtccgctacgtccagggcctgaagaagaagaaggtcattgtgatcccggtgggcatt

SEQ ID NO: 9144 - DNA, 201 bp, Homo sapiens
aggagccccaacggatgtcccggaactttgtccgctacgtccagggcctgaagaagaagaaggtcattgtgatcccggtgggcattgggccccatgccaasctcaagcagatccgcctcatcgagaagcaggcccctgagaacaaggccttcgtgctgagcagtgtggatgagctggagcagcaaagggacgagatcgtta

SEQ ID NO: 9145 - DNA, 201 bp, Homo sapiens
accgtggagtaccccttcagcgaggcacagtccaaaggggacatcctgcagcgggtgcgagagatccgctaccagggcggcaacaggaccaacactgggcyggccctgcggtacctctctgaccacagcttcttggtcagccagggtgaccgggagcaggcgcccaacctggtctacatggtcaccggaaatcctgcctct

SEQ ID NO: 9146 - DNA, 201 bp, Homo sapiens
acggatgtcccggaactttgtccgctacgtccagggcctgaagaagaagaaggtcattgtgatcccggtgggcattgggccccatgccaacctcaagcagwtccgcctcatcgagaagcaggcccctgagaacaaggccttcgtgctgagcagtgtggatgagctggagcagcaaagggacgagatcgttagctacctctg

SEQ ID NO: 9147 - DNA, 201 bp, Homo sapiens
gatgtgggccaggacagcatccacgtcacggtgctgcagtactcctacatggtgaccgtggagtaccccttcagcgaggcacagtccaaaggggacatccygcagcgggtgcgagagatccgctaccagggcggcaacaggaccaacactgggctggccctgcggtacctctctgaccacagcttcttggtcagccagggt

SEQ ID NO: 9148 - DNA, 201 bp, Homo sapiens
gcgcatctcccagaagtgggtccgcgtggccgtggtggagtaccacgacggctcccacgcctacatcgggctcaaggaccggaagcgaccgtcagagctgyggcgcattgccagccaggtgaagtatgcgggcagccaggtggcctccaccagcgaggtcttgaaatacacactgttccaaatcttcagcaagatcgaccg

SEQ ID NO: 9149 - DNA, 201 bp, Homo sapiens
cctgaagaagaagaaggtcattgtgatcccggtgggcattgggccccatgccaacctcaagcagatccgcctcatcgagaagcaggcccctgagaacaagrccttcgtgctgagcagtgtggatgagctggagcagcaaagggacgagatcgttagctacctctgtgaccttgcccctgaagcccctcctcctactctgcc

SEQ ID NO: 9150 - DNA, 201 bp, Homo sapiens
gaggtgattcagcggatggatgtgggccaggacagcatccacgtcacggtgctgcagtactcctacatggtgaccgtggagtaccccttcagcgaggcacrgtccaaaggggacatcctgcagcgggtgcgagagatccgctaccagggcggcaacaggaccaacactgggctggccctgcggtacctctctgaccacagc

SEQ ID NO: 9151 - DNA, 201 bp, Homo sapiens
atccgcctcatcgagaagcaggcccctgagaacaaggccttcgtgctgagcagtgtggatgagctggagcagcaaagggacgagatcgttagctacctctrtgaccttgcccctgaagcccctcctcctactctgccccccgacatggcacaagtcactgtgggcccggggctcttgggggtttcgaccctggggcccaag

SEQ ID NO: 9152 - DNA, 201 bp, Homo sapiens
ggtgaagccgacttcaacaggagcaaggagttcatggaggaggtgattcagcggatggatgtgggccaggacagcatccacgtcacggtgctgcagtactyctacatggtgaccgtggagtaccccttcagcgaggcacagtccaaaggggacatcctgcagcgggtgcgagagatccgctaccagggcggcaacaggacc

SEQ ID NO: 9153 - DNA, 201 bp, Homo sapiens
ggtttcgaccctggggcccaagaggaactccatggttctggatgtggcgttcgtcctggaaggatcggacaaaattggtgaagccgacttcaacaggagcraggagttcatggaggaggtgattcagcggatggatgtgggccaggacagcatccacgtcacggtgctgcagtactcctacatggtgaccgtggagtaccc

SEQ ID NO: 9154 - DNA, 201 bp, Homo sapiens
gacaaaattggtgaagccgacttcaacaggagcaaggagttcatggaggaggtgattcagcggatggatgtgggccaggacagcatccacgtcacggtgcygcagtactcctacatggtgaccgtggagtaccccttcagcgaggcacagtccaaaggggacatcctgcagcgggtgcgagagatccgctaccagggcggc

SEQ ID NO: 9155 - DNA, 201 bp, Homo sapiens
gtagcccgcctccgccagaatgcagaccagtgctgccccgagtatgagtgtgtgtgtgacccagtgagctgtgacctgcccccagtgcctcactgtgaacrtggcctccagcccacactgaccaaccctggcgagtgcagacccaacttcacctgcgcctgcaggaaggaggagtgcaaaagagtgtccccaccctcctgc

SEQ ID NO: 9156 - DNA, 201 bp, Homo sapiens
aaaggagcctatcctgtcggccccccatggtcaagctggtgtgtcccgctgacaacctgcgggctgaagggctcgagtgtaccaaaacgtgccagaactaygacctggagtgcatgagcatgggctgtgtctctggctgcctctgccccccgggcatggtccggcatgagaacagatgtgtggccctggaaaggtgtccct

SEQ ID NO: 9157 - DNA, 201 bp, Homo sapiens
tcccctgtctcatcgcagcaaaaggagcctatcctgtcggccccccatggtcaagctggtgtgtcccgctgacaacctgcgggctgaagggctcgagtgtrccaaaacgtgccagaactatgacctggagtgcatgagcatgggctgtgtctctggctgcctctgccccccgggcatggtccggcatgagaacagatgtgt

SEQ ID NO: 9158 - DNA, 201 bp, Homo sapiens
gagcggctgcgcatctcccagaagtgggtccgcgtggccgtggtggagtaccacgacggctcccacgcctacatcgggctcaaggaccggaagcgaccgtsagagctgcggcgcattgccagccaggtgaagtatgcgggcagccaggtggcctccaccagcgaggtcttgaaatacacactgttccaaatcttcagcaag

SEQ ID NO: 9159 - DNA, 201 bp, Homo sapiens
gtgggtccgcgtggccgtggtggagtaccacgacggctcccacgcctacatcgggctcaaggaccggaagcgaccgtcagagctgcggcgcattgccagcyaggtgaagtatgcgggcagccaggtggcctccaccagcgaggtcttgaaatacacactgttccaaatcttcagcaagatcgaccgccctgaagcctcccg

SEQ ID NO: 9160 - DNA, 201 bp, Homo sapiens
gtcaagtcacgtgtcagcaccctgagccactggcctgccctgtgcagtgtgtggagggctgccatgcccactgccctccagggaaaatcctggatgagctkttgcagacctgcgttgaccctgaagactgtccagtgtgtgaggtggctggccggcgttttgcctcaggaaagaaagtcaccttgaatcccagtgaccctg

SEQ ID NO: 9161 - DNA, 201 bp, Homo sapiens
tcaacaggagcaaggagttcatggaggaggtgattcagcggatggatgtgggccaggacagcatccacgtcacggtgctgcagtactcctacatggtgacygtggagtaccccttcagcgaggcacagtccaaaggggacatcctgcagcgggtgcgagagatccgctaccagggcggcaacaggaccaacactgggctgg

SEQ ID NO: 9162 - DNA, 201 bp, Homo sapiens
aggaggtgattcagcggatggatgtgggccaggacagcatccacgtcacggtgctgcagtactcctacatggtgaccgtggagtaccccttcagcgaggcmcagtccaaaggggacatcctgcagcgggtgcgagagatccgctaccagggcggcaacaggaccaacactgggctggccctgcggtacctctctgaccaca

SEQ ID NO: 9163 - DNA, 201 bp, Homo sapiens
cggcgcattgccagccaggtgaagtatgcgggcagccaggtggcctccaccagcgaggtcttgaaatacacactgttccaaatcttcagcaagatcgaccdccctgaagcctcccgcatcaccctgctcctgatggccagccaggagccccaacggatgtcccggaactttgtccgctacgtccagggcctgaagaagaag

SEQ ID NO: 9164 - DNA, 201 bp, Homo sapiens
ccctgagggacagctcctggatgaaggcctctgcgtggagagcaccgagtgtccctgcgtgcattccggaaagcgctaccctcccggcacctccctctctygagactgcaacacctgcatttgccgaaacagccagtggatctgcagcaatgaagaatgtccaggggagtgccttgtcacaggtcaatcacacttcaagag

SEQ ID NO: 9165 - DNA, 201 bp, Homo sapiens
ccaggacagcatccacgtcacggtgctgcagtactcctacatggtgaccgtggagtaccccttcagcgaggcacagtccaaaggggacatcctgcagcggktgcgagagatccgctaccagggcggcaacaggaccaacactgggctggccctgcggtacctctctgaccacagcttcttggtcagccagggtgaccggga

SEQ ID NO: 9166 - DNA, 201 bp, Homo sapiens
cgacgtgtgctcctgctcggacggccgcgagtgcctgtgcggcgccctggccagctatgccgcggcctgcgcggggagaggcgtgcgcgtcgcgtggcgckagccaggccgctgtgagctgaactgcccgaaaggccaggtgtacctgcagtgcgggaccccctgcaacctgacctgccgctctctctcttacccggatga

SEQ ID NO: 9167 - DNA, 201 bp, Homo sapiens
ggtgaccgtggagtaccccttcagcgaggcacagtccaaaggggacatcctgcagcgggtgcgagagatccgctaccagggcggcaacaggaccaacactrggctggccctgcggtacctctctgaccacagcttcttggtcagccagggtgaccgggagcaggcgcccaacctggtctacatggtcaccggaaatcctgc

SEQ ID NO: 9168 - DNA, 201 bp, Homo sapiens
tgtgtggccctggaaaggtgtccctgcttccatcagggcaaggagtatgcccctggagaaacagtgaagattggctgcaacacttgtgtctgtcgggaccrgaagtggaactgcacagaccatgtgtgtgatgccacgtgctccacgatcggcatggcccactacctcaccttcgacgggctcaaatacctgttccccggg

SEQ ID NO: 9169 - DNA, 201 bp, Homo sapiens
gacatggcacaagtcactgtgggcccggggctcttgggggtttcgaccctggggcccaagaggaactccatggttctggatgtggcgttcgtcctggaagratcggacaaaattggtgaagccgacttcaacaggagcaaggagttcatggaggaggtgattcagcggatggatgtgggccaggacagcatccacgtcacg

SEQ ID NO: 9170 - DNA, 201 bp, Homo sapiens
cccttcagcgaggcacagtccaaaggggacatcctgcagcgggtgcgagagatccgctaccagggcggcaacaggaccaacactgggctggccctgcggtrcctctctgaccacagcttcttggtcagccagggtgaccgggagcaggcgcccaacctggtctacatggtcaccggaaatcctgcctctgatgagatcaag

SEQ ID NO: 9171 - DNA, 201 bp, Homo sapiens
atgtgtggccctggaaaggtgtccctgcttccatcagggcaaggagtatgcccctggagaaacagtgaagattggctgcaacacttgtgtctgtcgggacyggaagtggaactgcacagaccatgtgtgtgatgccacgtgctccacgatcggcatggcccactacctcaccttcgacgggctcaaatacctgttccccgg

SEQ ID NO: 9172 - DNA, 201 bp, Homo sapiens
cgacatggcacaagtcactgtgggcccggggctcttgggggtttcgaccctggggcccaagaggaactccatggttctggatgtggcgttcgtcctggaasgatcggacaaaattggtgaagccgacttcaacaggagcaaggagttcatggaggaggtgattcagcggatggatgtgggccaggacagcatccacgtcac

SEQ ID NO: 9173 - DNA, 201 bp, Homo sapiens
tgcgcctgcttctgcgacaccattgctgcctatgcccacgtgtgtgcccagcatggcaaggtggtgacctggaggacggccacattgtgcccccagagctkcgaggagaggaatctccgggagaacgggtatgagtgtgagtggcgctataacagctgtgcacctgcctgtcaagtcacgtgtcagcaccctgagccactg

SEQ ID NO: 9174 - DNA, 201 bp, Homo sapiens
tggctcctccagtttcccagcttcttattttgatgaaatgaagagtttcgccaaggctttcatttcaaaagccaatatagggcctcgtctcactcaggtgwcagtgctgcagtatggaagcatcaccaccattgacgtgccatggaacgtggtcccggagaaagcccatttgctgagccttgtggacgtcatgcagcggga

SEQ ID NO: 9175 - DNA, 201 bp, Homo sapiens
ccagtgagctgtgacctgcccccagtgcctcactgtgaacgtggcctccagcccacactgaccaaccctggcgagtgcagacccaacttcacctgcgcctkcaggaaggaggagtgcaaaagagtgtccccaccctcctgccccccgcaccgtttgcccacccttcggaagacccagtgctgtgatgagtatgagtgtgcc

SEQ ID NO: 9176 - DNA, 201 bp, Homo sapiens
agcctgagtgcaacgacatcactgccaggctgcagtatgtcaaggtgggaagctgtaagtctgaagtagaggtggatatccactactgccagggcaaatgkgccagcaaagccatgtactccattgacatcaacgatgtgcaggaccagtgctcctgctgctctccgacacggacggagcccatgcaggtggccctgcact

SEQ ID NO: 9177 - DNA, 201 bp, Homo sapiens
ggggaggacctgcagatggactgggatggccgcgggaggctgctggtgaagctgtcccccgtctatgccgggaagacctgcggcctgtgtgggaattacartggcaaccagggcgacgacttccttaccccctctgggctggcggagccccgggtggaggacttcgggaacgcctggaagctgcacggggactgccaggac

SEQ ID NO: 9178 - DNA, 201 bp, Homo sapiens; identical to SEQ ID NO: 8988

SEQ ID NO: 9179 - DNA, 201 bp, Homo sapiens
aagctgtaagtctgaagtagaggtggatatccactactgccagggcaaatgtgccagcaaagccatgtactccattgacatcaacgatgtgcaggaccagwgctcctgctgctctccgacacggacggagcccatgcaggtggccctgcactgcaccaatggctctgttgtgtaccatgaggttctcaatgccatggagtg

SEQ ID NO: 9180 - DNA, 201 bp, Homo sapiens
tgcctcatcaatgagtgtgtccgagtgaaggaggaggtctttatacaacaaaggaacgtctcctgcccccagctggaggtccctgtctgcccctcgggctwtcagctgagctgtaagacctcagcgtgctgcccaagctgtcgctgtgagcgcatggaggcctgcatgctcaatggcactgtcattgggcccgggaagact

SEQ ID NO: 9181 - DNA, 201 bp, Homo sapiens
tcctggtggagggaggagagattgagctgtttgacggggaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggagaaagtgtgtg

SEQ ID NO: 9182 - DNA, 201 bp, Homo sapiens
tgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtgtgtgtccaccgaagcaccatctaccctgtgggccagttctgggaggagg

SEQ ID NO: 9183 - DNA, 201 bp, Homo sapiens
gcgaccgtcagagctgcggcgcattgccagccaggtgaagtatgcgggcagccaggtggcctccaccagcgaggtcttgaaatacacactgttccaaatcwtcagcaagatcgaccgccctgaagcctcccgcatcaccctgctcctgatggccagccaggagccccaacggatgtcccggaactttgtccgctacgtcca

SEQ ID NO: 9184 - DNA, 201 bp, Homo sapiens
cagtcccctgtctcatcgcagcaaaaggagcctatcctgtcggccccccatggtcaagctggtgtgtcccgctgacaacctgcgggctgaagggctcgagygtaccaaaacgtgccagaactatgacctggagtgcatgagcatgggctgtgtctctggctgcctctgccccccgggcatggtccggcatgagaacagatg

SEQ ID NO: 9185 - DNA, 201 bp, Homo sapiens
  misc_feature (1)...(201): n = A,T,C or G, or insertion/deletion polymorphism (see Tables 1-2)
cgcatctcccagaagtgggtccgcgtggccgtggtggagtaccacgacggctcccacgcctacatcgggctcaaggaccggaagcgaccgtcagagctgcngcgcattgccagccaggtgaagtatgcgggcagccaggtggcctccaccagcgaggtcttgaaatacacactgttccaaatcttcagcaagatcgaccgc

SEQ ID NO: 9186 - DNA, 201 bp, Homo sapiens
atggagcggctgcgcatctcccagaagtgggtccgcgtggccgtggtggagtaccacgacggctcccacgcctacatcgggctcaaggaccggaagcgacygtcagagctgcggcgcattgccagccaggtgaagtatgcgggcagccaggtggcctccaccagcgaggtcttgaaatacacactgttccaaatcttcagc

SEQ ID NO: 9187 - DNA, 201 bp, Homo sapiens
gctgagtttgaagtgctgaaggcctttgtggtggacatgatggagcggctgcgcatctcccagaagtgggtccgcgtggccgtggtggagtaccacgacgsctcccacgcctacatcgggctcaaggaccggaagcgaccgtcagagctgcggcgcattgccagccaggtgaagtatgcgggcagccaggtggcctccacc

SEQ ID NO: 9188 - DNA, 201 bp, Homo sapiens
ggctgagtttgaagtgctgaaggcctttgtggtggacatgatggagcggctgcgcatctcccagaagtgggtccgcgtggccgtggtggagtaccacgacrgctcccacgcctacatcgggctcaaggaccggaagcgaccgtcagagctgcggcgcattgccagccaggtgaagtatgcgggcagccaggtggcctccac

SEQ ID NO: 9189 - DNA, 201 bp, Homo sapiens
ggatggctcctccaggctgtccgaggctgagtttgaagtgctgaaggcctttgtggtggacatgatggagcggctgcgcatctcccagaagtgggtccgcrtggccgtggtggagtaccacgacggctcccacgcctacatcgggctcaaggaccggaagcgaccgtcagagctgcggcgcattgccagccaggtgaagta

SEQ ID NO: 9190 - DNA, 201 bp, Homo sapiens
gctggatggctcctccaggctgtccgaggctgagtttgaagtgctgaaggcctttgtggtggacatgatggagcggctgcgcatctcccagaagtgggtcygcgtggccgtggtggagtaccacgacggctcccacgcctacatcgggctcaaggaccggaagcgaccgtcagagctgcggcgcattgccagccaggtgaa

SEQ ID NO: 9191 - DNA, 201 bp, Homo sapiens
cctgctggatggctcctccaggctgtccgaggctgagtttgaagtgctgaaggcctttgtggtggacatgatggagcggctgcgcatctcccagaagtggbtccgcgtggccgtggtggagtaccacgacggctcccacgcctacatcgggctcaaggaccggaagcgaccgtcagagctgcggcgcattgccagccaggt

SEQ ID NO: 9192 - DNA, 201 bp, Homo sapiens
tcctgctggatggctcctccaggctgtccgaggctgagtttgaagtgctgaaggcctttgtggtggacatgatggagcggctgcgcatctcccagaagtgsgtccgcgtggccgtggtggagtaccacgacggctcccacgcctacatcgggctcaaggaccggaagcgaccgtcagagctgcggcgcattgccagccagg

SEQ ID NO: 9193 - DNA, 201 bp, Homo sapiens
gacctggtcttcctgctggatggctcctccaggctgtccgaggctgagtttgaagtgctgaaggcctttgtggtggacatgatggagcggctgcgcatctyccagaagtgggtccgcgtggccgtggtggagtaccacgacggctcccacgcctacatcgggctcaaggaccggaagcgaccgtcagagctgcggcgcatt

SEQ ID NO: 9194 - DNA, 201 bp, Homo sapiens
  misc_feature (1)...(201): n = A,T,C or G, or insertion/deletion polymorphism (see Tables 1-2)
accactgtttgctgaatgccacaaggtcctggctccagccacattctatgccatctgccagcaggacagttgccaccaggagcaagtgtgtgaggtgatcncctcttatgcccacctctgtcggaccaacggggtctgcgttgactggaggacacctgatttctgtgctatgtcatgcccaccatctctggtctacaacca

SEQ ID NO: 9195 - DNA, 201 bp, Homo sapiens
atcgggtcaactgtgaccgggggctgaggccttcgtgccctaacagccagtcccctgttaaagtggaagagacctgtggctgccgctggacctgcccctgygtgtgcacaggcagctccactcggcacatcgtgacctttgatgggcagaatttcaagctgactggcagctgttcttatgtcctatttcaaaacaaggagc

SEQ ID NO: 9196 - DNA, 201 bp, Homo sapiens
tccctgaagaggcctgcactcagtgcattggtgaggatggagtccagcaccagttcctggaagcctgggtcccggaccaccagccctgtcagatctgcacrtgcctcagcgggcggaaggtcaactgcacaacgcagccctgccccacggccaaagctcccacgtgtggcctgtgtgaagtagcccgcctccgccagaatg

SEQ ID NO: 9197 - DNA, 201 bp, Homo sapiens
gggctcttgggggtttcgaccctggggcccaagaggaactccatggttctggatgtggcgttcgtcctggaaggatcggacaaaattggtgaagccgactkcaacaggagcaaggagttcatggaggaggtgattcagcggatggatgtgggccaggacagcatccacgtcacggtgctgcagtactcctacatggtgacc

SEQ ID NO: 9198 - DNA, 201 bp, Homo sapiens
tggtgaagctgtcccccgtctatgccgggaagacctgcggcctgtgtgggaattacaatggcaaccagggcgacgacttccttaccccctctgggctggcrgagccccgggtggaggacttcgggaacgcctggaagctgcacggggactgccaggacctgcagaagcagcacagcgatccctgcgccctcaacccgcgca

SEQ ID NO: 9199 - DNA, 201 bp, Homo sapiens
ggctgccatgcccactgccctccagggaaaatcctggatgagcttttgcagacctgcgttgaccctgaagactgtccagtgtgtgaggtggctggccggcrttttgcctcaggaaagaaagtcaccttgaatcccagtgaccctgagcactgccagatttgccactgtgatgttgtcaacctcacctgtgaagcctgccag

SEQ ID NO: 9200 - DNA, 201 bp, Homo sapiens
actggacctggtcttcctgctggatggctcctccaggctgtccgaggctgagtttgaagtgctgaaggcctttgtggtggacatgatggagcggctgcgcrtctcccagaagtgggtccgcgtggccgtggtggagtaccacgacggctcccacgcctacatcgggctcaaggaccggaagcgaccgtcagagctgcggcg

SEQ ID NO: 9201 - DNA, 201 bp, Homo sapiens
ctactggacctggtcttcctgctggatggctcctccaggctgtccgaggctgagtttgaagtgctgaaggcctttgtggtggacatgatggagcggctgcvcatctcccagaagtgggtccgcgtggccgtggtggagtaccacgacggctcccacgcctacatcgggctcaaggaccggaagcgaccgtcagagctgcgg

SEQ ID NO: 9202 - DNA, 201 bp, Homo sapiens
gctactggacctggtcttcctgctggatggctcctccaggctgtccgaggctgagtttgaagtgctgaaggcctttgtggtggacatgatggagcggctgygcatctcccagaagtgggtccgcgtggccgtggtggagtaccacgacggctcccacgcctacatcgggctcaaggaccggaagcgaccgtcagagctgcg

SEQ ID NO: 9203 - DNA, 201 bp, Homo sapiens
tgccgggaagacctgcggcctgtgtgggaattacaatggcaaccagggcgacgacttccttaccccctctgggctggcggagccccgggtggaggacttcrggaacgcctggaagctgcacggggactgccaggacctgcagaagcagcacagcgatccctgcgccctcaacccgcgcatgaccaggttctccgaggaggc

SEQ ID NO: 9204 - DNA, 201 bp, Homo sapiens
agcaggctactggacctggtcttcctgctggatggctcctccaggctgtccgaggctgagtttgaagtgctgaaggcctttgtggtggacatgatggagcdgctgcgcatctcccagaagtgggtccgcgtggccgtggtggagtaccacgacggctcccacgcctacatcgggctcaaggaccggaagcgaccgtcagag

SEQ ID NO: 9205 - DNA, 201 bp, Homo sapiens
cagcaggctactggacctggtcttcctgctggatggctcctccaggctgtccgaggctgagtttgaagtgctgaaggcctttgtggtggacatgatggagyggctgcgcatctcccagaagtgggtccgcgtggccgtggtggagtaccacgacggctcccacgcctacatcgggctcaaggaccggaagcgaccgtcaga

SEQ ID NO: 9206 - DNA, 201 bp, Homo sapiens
gcctcccacagatgccccggtgagccccaccactctgtatgtggaggacatctcggaaccgccgttgcacgatttctactgcagcaggctactggacctgrtcttcctgctggatggctcctccaggctgtccgaggctgagtttgaagtgctgaaggcctttgtggtggacatgatggagcggctgcgcatctcccagaa

SEQ ID NO: 9207 - DNA, 201 bp, Homo sapiens
ctggtggtgcctcccacagatgccccggtgagccccaccactctgtatgtggaggacatctcggaaccgccgttgcacgatttctactgcagcaggctacyggacctggtcttcctgctggatggctcctccaggctgtccgaggctgagtttgaagtgctgaaggcctttgtggtggacatgatggagcggctgcgcatc

SEQ ID NO: 9208 - DNA, 201 bp, Homo sapiens
cgtgctgagcagtgtggatgagctggagcagcaaagggacgagatcgttagctacctctgtgaccttgcccctgaagcccctcctcctactctgccccccsacatggcacaagtcactgtgggcccggggctcttgggggtttcgaccctggggcccaagaggaactccatggttctggatgtggcgttcgtcctggaagg

SEQ ID NO: 9209 - DNA, 201 bp, Homo sapiens
ggagccgggaggcctggtggtgcctcccacagatgccccggtgagccccaccactctgtatgtggaggacatctcggaaccgccgttgcacgatttctacbgcagcaggctactggacctggtcttcctgctggatggctcctccaggctgtccgaggctgagtttgaagtgctgaaggcctttgtggtggacatgatgga

SEQ ID NO: 9210 - DNA, 201 bp, Homo sapiens
ttggtgaagccgacttcaacaggagcaaggagttcatggaggaggtgattcagcggatggatgtgggccaggacagcatccacgtcacggtgctgcagtastcctacatggtgaccgtggagtaccccttcagcgaggcacagtccaaaggggacatcctgcagcgggtgcgagagatccgctaccagggcggcaacagga

SEQ ID NO: 9211 - DNA, 201 bp, Homo sapiens
gctggccctgcggtacctctctgaccacagcttcttggtcagccagggtgaccgggagcaggcgcccaacctggtctacatggtcaccggaaatcctgccyctgatgagatcaagaggctgcctggagacatccaggtggtgcccattggagtgggccctaatgccaacgtgcaggagctggagaggattggctggcccaa

SEQ ID NO: 9212 - DNA, 201 bp, Homo sapiens
taagtctgaagtagaggtggatatccactactgccagggcaaatgtgccagcaaagccatgtactccattgacatcaacgatgtgcaggaccagtgctccygctgctctccgacacggacggagcccatgcaggtggccctgcactgcaccaatggctctgttgtgtaccatgaggttctcaatgccatggagtgcaaatg

SEQ ID NO: 9213 - DNA, 201 bp, Homo sapiens
tgatactcacttctgcaaggtcaatgagagaggagagtacttctgggagaagagggtcacaggctgcccaccctttgatgaacacaagtgtctggctgagrgaggtaaaattatgaaaattccaggcacctgctgtgacacatgtgaggagcctgagtgcaacgacatcactgccaggctgcagtatgtcaaggtgggaag

SEQ ID NO: 9214 - DNA, 201 bp, Homo sapiens
ttcctggaagagtgtcggctcccagtgggcctccccggagaacccctgcctcatcaatgagtgtgtccgagtgaaggaggaggtctttatacaacaaaggwacgtctcctgcccccagctggaggtccctgtctgcccctcgggctttcagctgagctgtaagacctcagcgtgctgcccaagctgtcgctgtgagcgcat

SEQ ID NO: 9215 - DNA, 201 bp, Homo sapiens
cctactctgccccccgacatggcacaagtcactgtgggcccggggctcttgggggtttcgaccctggggcccaagaggaactccatggttctggatgtggmgttcgtcctggaaggatcggacaaaattggtgaagccgacttcaacaggagcaaggagttcatggaggaggtgattcagcggatggatgtgggccaggac

SEQ ID NO: 9216 - DNA, 201 bp, Homo sapiens
ggtgactggctcaccgcggggggactcccagtcttcctggaagagtgtcggctcccagtgggcctccccggagaacccctgcctcatcaatgagtgtgtcygagtgaaggaggaggtctttatacaacaaaggaacgtctcctgcccccagctggaggtccctgtctgcccctcgggctttcagctgagctgtaagacctc

SEQ ID NO: 9217 - DNA, 201 bp, Homo sapiens
ctcccggcacctccctctctcgagactgcaacacctgcatttgccgaaacagccagtggatctgcagcaatgaagaatgtccaggggagtgccttgtcacwggtcaatcacacttcaagagctttgacaacagatacttcaccttcagtgggatctgccagtacctgctggcccgggattgccaggaccactccttctcca

SEQ ID NO: 9218 - DNA, 201 bp, Homo sapiens
gccatcgtgccgtcagcccgctgccctacctgcggaactgccgctacgacgtgtgctcctgctcggacggccgcgagtgcctgtgcggcgccctggccagytatgccgcggcctgcgcggggagaggcgtgcgcgtcgcgtggcgcgagccaggccgctgtgagctgaactgcccgaaaggccaggtgtacctgcagtgcg

SEQ ID NO: 9219 - DNA, 201 bp, Homo sapiens
cctccctctctcgagactgcaacacctgcatttgccgaaacagccagtggatctgcagcaatgaagaatgtccaggggagtgccttgtcacaggtcaatcmcacttcaagagctttgacaacagatacttcaccttcagtgggatctgccagtacctgctggcccgggattgccaggaccactccttctccattgtcattg

SEQ ID NO: 9220 - DNA, 201 bp, Homo sapiens
agagagttattttattcctgaagtccggatctatgactcagggacatataaatgtactgtgattgtgaacaacaaagagaaaaccactgcagagtaccagstgttggtggaaggagtgcccagtcccagggtgacactggacaagaaagaggccatccaaggtgggatcgtgagggtcaactgttctgtcccagaggaaaa

SEQ ID NO: 9221 - DNA, 201 bp, Homo sapiens
ctgtttttgtctacactctttctcttttcctctaccatgctgaaggctgaaagacaggaagatggtgccatcagcaaatattattcttaattgaaaacttraaatgtgtatgtttcttactaatttttaaaaatgtattccttgccagggcaggcaaggtggctcacgcctgtaatcccagcacttcaggaggctgaggtg

SEQ ID NO: 9222 - DNA, 201 bp, Homo sapiens
tggagaatagtaccaagaactcaaatgatcctgcggtattcaaagacaaccccactgaagacgtcgaataccagtgtgttgcagataattgccattcccaygccaaaatgttaagtgaggttctgagggtgaaggtgatagccccggtggatgaggtccagatttctatcctgtcaagtaaggtggtggagtctggagagg

SEQ ID NO: 9223 - DNA, 201 bp, Homo sapiens
aatgtccaggccagcagtaccacttctgaactccaacaacgagaaaatgtcagatcccaatatggaagctaacagtcattacggtcacaatgacgatgtcrgaaaccatgcaatgaaaccaataaatgataataaagagcctctgaactcagacgtgcagtacacggaagttcaagtgtcctcagctgagtctcacaaaga

SEQ ID NO: 9224 - DNA, 201 bp, Homo sapiens
ttgggagcaccgcctgtgaaataccaacctgaagacaccgttcattcaggcaacgcacaaaacagaaaatgaaggtggaacaagcacagatgttcttcaamtgtttttgtctacactctttctcttttcctctaccatgctgaaggctgaaagacaggaagatggtgccatcagcaaatattattcttaattgaaaacttg

SEQ ID NO: 9225 - DNA, 201 bp, Homo sapiens
attgccattcccacgccaaaatgttaagtgaggttctgagggtgaaggtgatagccccggtggatgaggtccagatttctatcctgtcaagtaaggtggtrgagtctggagaggacattgtgctgcaatgtgctgtgaatgaaggatctggtcccatcacctataagttttacagagaaaaagagggcaaacccttctatc

SEQ ID NO: 9226 - DNA, 201 bp, Homo sapiens
acaaccccactgaagacgtcgaataccagtgtgttgcagataattgccattcccacgccaaaatgttaagtgaggttctgagggtgaaggtgatagccccrgtggatgaggtccagatttctatcctgtcaagtaaggtggtggagtctggagaggacattgtgctgcaatgtgctgtgaatgaaggatctggtcccatca

SEQ ID NO: 9227 - DNA, 201 bp, Homo sapiens
ggtcccatcacctataagttttacagagaaaaagagggcaaacccttctatcaaatgacctcaaatgccacccaggcattttggaccaagcagaaggctadcaaggaacaggagggagagtattactgcacagccttcaacagagccaaccacgcctccagtgtccccagaagcaaaatactgacagtcagagtcattctt

SEQ ID NO: 9228 - DNA, 201 bp, Homo sapiens
cagacagcctccccctgtcccctctatgacctcgccctccacaaatgggaaaaccagactacttgggagcaccgcctgtgaaataccaacctgaagacacsgttcattcaggcaacgcacaaaacagaaaatgaaggtggaacaagcacagatgttcttcaactgtttttgtctacactctttctcttttcctctaccatg

SEQ ID NO: 9229 - DNA, 201 bp, Homo sapiens
ccatctcaaaaaaaacaaaaaacaaaattgcttgctaaagaagtggtctcctgaggtcttaagacattcctgacagtgtcttgagtgggtgggagagaggytgctgtcattgcgctgtggaatttcacagatgagaaccacgcctagccaaaatcacttttcctgtttgcctcagtgacacagctgcagggaccctcgtgg

SEQ ID NO: 9230 - DNA, 201 bp, Homo sapiens
ctctcttgatcattgcggccaaatgttattttctgaggaaagccaaggccaagcagatgccagtggaaatgtccaggccagcagtaccacttctgaactcyaacaacgagaaaatgtcagatcccaatatggaagctaacagtcattacggtcacaatgacgatgtcggaaaccatgcaatgaaaccaataaatgataata

SEQ ID NO: 9231 - DNA, 201 bp, Homo sapiens
ccaattttcttttttatactcaatcatttctagcgcatggcctggttagaggctggttttttctcttttcctttggtccttcaaaggcttgtagttttggstagtccttgttctttggaaatacacagtgctgaccagacagcctccccctgtcccctctatgacctcgccctccacaaatgggaaaaccagactacttgg

SEQ ID NO: 9232 - DNA, 109 bp, Homo sapiens
agatgagaaccacgcctagccaaaatcacttttcctgtttgcctcagtgacacagctgcagggaccctcgtggatgttgtattaaataaatttgacctttrctctttgc

SEQ ID NO: 9233 - DNA, 201 bp, Homo sapiens
aatccatcctgctaagttaatgttgggtagaaagagatacagaggggctgttgaatttcccacataccctccttccaccaagttggaacatccttggaaaytggaagagcacaagaggagatccagggcaaggccattgggatattctgaaacttgaatattttgttttgtgcagagataaagaccttttccatgcaccct

SEQ ID NO: 9234 - DNA, 201 bp, Homo sapiens
aagcagatactctagaacggaaggctcccttgatggaacttagacagcaaggccagatgcacatccctggaaggacatccatgttccgagaagaacagatratccctgtatttcaagacctctgtgcacttatttatgaacctgccctgctcccacagaacacagcaattcctcaggctaagctgccggttcttaaatcca

SEQ ID NO: 9235 - DNA, 201 bp, Homo sapiens
tgttctttggaaatacacagtgctgaccagacagcctccccctgtcccctctatgacctcgccctccacaaatgggaaaaccagactacttgggagcacckcctgtgaaataccaacctgaagacaccgttcattcaggcaacgcacaaaacagaaaatgaaggtggaacaagcacagatgttcttcaactgtttttgtct

SEQ ID NO: 9236 - DNA, 201 bp, Homo sapiens
tgggcggatcacctgaggtcaggagtttgagaccagcctgatgaaaccctgtctctactaaaaatacaagaattagccgggcgtggtggcgcatgcctgtrgtatcagctactcaagaggctgaggtgagattatcgcttgaacccaggaaacggaggttgtagtgagcggagatcgcgccactgcactccagcctgagtg

SEQ ID NO: 9237 - DNA, 201 bp, Homo sapiens
gaatccatctcaaaaaaaacaaaaaacaaaattgcttgctaaagaagtggtctcctgaggtcttaagacattcctgacagtgtcttgagtgggtgggagaraggttgctgtcattgcgctgtggaatttcacagatgagaaccacgcctagccaaaatcacttttcctgtttgcctcagtgacacagctgcagggaccctc

SEQ ID NO: 9238 - DNA, 201 bp, Homo sapiens; identical to SEQ ID NO: 9220

SEQ ID NO: 9239 - DNA, 201 bp, Homo sapiens; identical to SEQ ID NO: 9221

SEQ ID NO: 9240 - DNA, 201 bp, Homo sapiens; identical to SEQ ID NO: 9222

SEQ ID NO: 9241 - DNA, 201 bp, Homo sapiens; identical to SEQ ID NO: 9223

SEQ ID NO: 9242 - DNA, 201 bp, Homo sapiens; identical to SEQ ID NO: 9224

SEQ ID NO: 9243 - DNA, 201 bp, Homo sapiens; identical to SEQ ID NO: 9225

SEQ ID NO: 9244 - DNA, 201 bp, Homo sapiens; identical to SEQ ID NO: 9226

SEQ ID NO: 9245 - DNA, 201 bp, Homo sapiens; identical to SEQ ID NO: 9227

SEQ ID NO: 9246 - DNA, 201 bp, Homo sapiens; identical to SEQ ID NO: 9228

SEQ ID NO: 9247 - DNA, 201 bp, Homo sapiens; identical to SEQ ID NO: 9229

SEQ ID NO: 9248 - DNA, 201 bp, Homo sapiens; identical to SEQ ID NO: 9230

SEQ ID NO: 9249 - DNA, 201 bp, Homo sapiens; identical to SEQ ID NO: 9231

SEQ ID NO: 9250 - DNA, 109 bp, Homo sapiens; identical to SEQ ID NO: 9232

SEQ ID NO: 9251 - DNA, 201 bp, Homo sapiens; identical to SEQ ID NO: 9233

SEQ ID NO: 9252 - DNA, 201 bp, Homo sapiens; identical to SEQ ID NO: 9234

SEQ ID NO: 9253 - DNA, 201 bp, Homo sapiens; identical to SEQ ID NO: 9235

SEQ ID NO: 9254 - DNA, 201 bp, Homo sapiens; identical to SEQ ID NO: 9236

SEQ ID NO: 9255 - DNA, 201 bp, Homo sapiens; identical to SEQ ID NO: 9237

SEQ ID NO: 9256 - DNA, 201 bp, Homo sapiens
ctgggaagctgccagtgagatttcagagaccaagagcgcgaaggggcgggcgatgtggcaatccgtctgggatgtgaaaagcgtggagcgcatttagaggmattcgacgaaaacacaggaaatcactcctctcccgctcctgggcgccgctgccactggggcagaggactgggaaccgcggcagcgggataagtggcccag

SEQ ID NO: 9257 - DNA, 201 bp, Homo sapiens
aagaggattaatgattgaaacttaaaattgagacaatcttgtgtttcctaaactgttacagtacatttctcagcatccttgtgacagaaagctgcaagaakggcactttttgattcatacagggatttcttatgtctttggctacactagatattttgtgattggcaagacatgtatttaaacaataaactaaaaggaaat

SEQ ID NO: 9258 - DNA, 201 bp, Homo sapiens
tagtttctgtctctaactttagtttcctttttcagcttccctgactaattctcttaacctccaattatctttaacagaagttactaattctgcaattcatrtattctggaactggaattatctttgttcctaagcaaccaagtatacatatgaaacggtctgtacattaatgcctcataatagcagctcttatttgggaaa

SEQ ID NO: 9259 - DNA, 201 bp, Homo sapiens
ccagatgccactagagtagctttgtaaagctcatttttcttatctttacttagtttctgtctctaactttagtttcctttttcagcttccctgactaattstcttaacctccaattatctttaacagaagttactaattctgcaattcatatattctggaactggaattatctttgttcctaagcaaccaagtatacatat

SEQ ID NO: 9260 - DNA, 201 bp, Homo sapiens
gcgcacgcgcgaactgcggccccgcctctcctttggggacgggagacgtgcgtcgggtcgcgggacgggggctgcgcatgcgccttcatttcgtcagcccrctgttgcgtgctgccagcgggaactgtgtaggggtagattttcgctgcagtgttccccgagcctgttagacgcagcgcgccgggagactgagagaggaaa

SEQ ID NO: 9261 - DNA, 201 bp, Homo sapiens
tggggaggacaaacatgtaagcaaatcactgttagaagtaacttgtacaaagtgtgtaaaaggacacagtggtgaaaggggtgacttttaggagaaacttyatagagcaaggaccagtaagtttacctaaaaggggaagaagaaatatggagaaattaagtgggaagatggggaggggaagtgtgctaatcacctaagaac

SEQ ID NO: 9262 - DNA, 201 bp, Homo sapiens
tgcatttcacaaataccactttggcagcatcaaggatcgattggaggaggcaagactggaggcaggaagactggttaaaaaaatgcatattaggaagataygagagaaaaatgataatggccttatcaaaggcagcaataatgttccttgcaataggaatgaacagaagtcaacaggaaatattaagagatgggatcaaaa

SEQ ID NO: 9263 - DNA, 201 bp, Homo sapiens
gatcgattggaggaggcaagactggaggcaggaagactggttaaaaaaatgcatattaggaagatacgagagaaaaatgataatggccttatcaaaggcarcaataatgttccttgcaataggaatgaacagaagtcaacaggaaatattaagagatgggatcaaaaggacatgactgcagattgctgtttagagttatgg

SEQ ID NO: 9264 - DNA, 201 bp, Homo sapiens
acaggtggtccaggctatccagcgccacatacactttgatgttgtaaagtgcatcctggtggccagcccaggatttgtgagggagcagttctgcgactacmtgtttcaacaagcagtgaagaccgacaacaaactgctcctggaaaaccggtccaaatttcttcaggtacatgcctcctccggacacaagtactccctgaa

SEQ ID NO: 9265 - DNA, 201 bp, Homo sapiens
ggagtttgggtttgaccattaggagaaacaattacaaagctgaagcagcatgctaaactgcatttcacaaataccactttggcagcatcaaggatcgattkgaggaggcaagactggaggcaggaagactggttaaaaaaatgcatattaggaagatacgagagaaaaatgataatggccttatcaaaggcagcaataatg

SEQ ID NO: 9266 - DNA, 201 bp, Homo sapiens
gtgacagacttggggatttcttgtaaacttcctaactagtctgaacctttttatttcttattgggaactgacacttccctatactttaaaactcacatatktatatttttgtacatctatctcctaattcaaaagtaattgagattgtcatttcattataattccgtgagtatctttaaattactatcaaatatgttacta

SEQ ID NO: 9267 - DNA, 201 bp, Homo sapiens
agccagaacttagatatggggtgtaaatatttatattacactaatcattaagagtaatatatttaattttatccatttttttagtgccttttttgaaccartcactgggctagatgtggggaggacaaacatgtaagcaaatcactgttagaagtaacttgtacaaagtgtgtaaaaggacacagtggtgaaaggggtgac

SEQ ID NO: 9268 - DNA, 201 bp, Homo sapiens
gctggtaaatctctggcaggggtccccagtcaggaaaaagatttgagtattaaggtctttcaaaaaagttaactggccatactcaactgtctataaaacckctataaatttctgtttttatgtctatgaattattaaataaaatttaactcatttttaagaaattacattttctgttatcaagaatacaattcttactaga

SEQ ID NO: 9269 - DNA, 201 bp, Homo sapiens
acttaggaagttgaagtttggcattaaaataaaggactcgccaccactctgtgcaccttcttgagggagttcattcgtccggagcgcctcacagcttagtrcgcctgcgcacgcgcgaactgcggccccgcctctcctttggggacgggagacgtgcgtcgggtcgcgggacgggggctgcgcatgcgccttcatttcgtc

SEQ ID NO: 9270 - DNA, 201 bp, Homo sapiens
acacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatat

SEQ ID NO: 9271 - DNA, 201 bp, Homo sapiens
gacacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattata

SEQ ID NO: 9272 - DNA, 201 bp, Homo sapiens
agtgcgcctgcgcacgcgcgaactgcggccccgcctctcctttggggacgggagacgtgcgtcgggtcgcgggacgggggctgcgcatgcgccttcatttmgtcagcccgctgttgcgtgctgccagcgggaactgtgtaggggtagattttcgctgcagtgttccccgagcctgttagacgcagcgcgccgggagactga

SEQ ID NO: 9273 - DNA, 201 bp, Homo sapiens
tgacacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattat

SEQ ID NO: 9274 - DNA, 201 bp, Homo sapiens
cttccctgttcccgaactttctgaccaagagggtgattccagttctgaagaggattaatgattgaaacttaaaattgagacaatcttgtgtttcctaaacwgttacagtacatttctcagcatccttgtgacagaaagctgcaagaatggcactttttgattcatacagggatttcttatgtctttggctacactagatat

SEQ ID NO: 9275 - DNA, 201 bp, Homo sapiens
ctgacacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttatta

SEQ ID NO: 9276 - DNA, 201 bp, Homo sapiens
ttcctttttcagcttccctgactaattctcttaacctccaattatctttaacagaagttactaattctgcaattcatatattctggaactggaattatctktgttcctaagcaaccaagtatacatatgaaacggtctgtacattaatgcctcataatagcagctcttatttgggaaagggttatagtacatttaaaccat

SEQ ID NO: 9277 - DNA, 201 bp, Homo sapiens
ctccgagtttaaaatattatttttattatttttggtgcacattcctaaaagttaaggaaggagcctcagtaatggaattgcttcttgaccttttgcaaacytcaatttagcaaaataattaggaacgatctaatagtgatgatacagtttttaactgctggatcagcgacgcctatttcaagtagtgatactaactaaact

SEQ ID NO: 9278 - DNA, 201 bp, Homo sapiens; identical to SEQ ID NO: 9256

SEQ ID NO: 9279 - DNA, 201 bp, Homo sapiens; identical to SEQ ID NO: 9257

SEQ ID NO: 9280 - DNA, 201 bp, Homo sapiens; identical to SEQ ID NO: 9258

SEQ ID NO: 9281 - DNA, 201 bp, Homo sapiens; identical to SEQ ID NO: 9259

SEQ ID NO: 9282 - DNA, 201 bp, Homo sapiens; identical to SEQ ID NO: 9260

SEQ ID NO: 9283 - DNA, 201 bp, Homo sapiens; identical to SEQ ID NO: 9261

SEQ ID NO: 9284 - DNA, 201 bp, Homo sapiens; identical to SEQ ID NO: 9262

SEQ ID NO: 9285 - DNA, 201 bp, Homo sapiens; identical to SEQ ID NO: 9263

SEQ ID NO: 9286 - DNA, 201 bp, Homo sapiens; identical to SEQ ID NO: 9264

SEQ ID NO: 9287 - DNA, 201 bp, Homo sapiens; identical to SEQ ID NO: 9265

SEQ ID NO: 9288 - DNA, 201 bp, Homo sapiens; identical to SEQ ID NO: 9266

SEQ ID NO: 9289 - DNA, 201 bp, Homo sapiens; identical to SEQ ID NO: 9267

SEQ ID NO: 9290 - DNA, 201 bp, Homo sapiens; identical to SEQ ID NO: 9268

SEQ ID NO: 9291 - DNA, 201 bp, Homo sapiens; identical to SEQ ID NO: 9269

SEQ ID NO: 9292 - DNA, 201 bp, Homo sapiens; identical to SEQ ID NO: 9270

SEQ ID NO: 9293 - DNA, 201 bp, Homo sapiens; identical to SEQ ID NO: 9271

SEQ ID NO: 9294 - DNA, 201 bp, Homo sapiens; identical to SEQ ID NO: 9272

SEQ ID NO: 9295 - DNA, 201 bp, Homo sapiens; identical to SEQ ID NO: 9273

SEQ ID NO: 9296 - DNA, 201 bp, Homo sapiens; identical to SEQ ID NO: 9274

SEQ ID NO: 9297 - DNA, 201 bp, Homo sapiens; identical to SEQ ID NO: 9275

SEQ ID NO: 9298 - DNA, 201 bp, Homo sapiens; identical to SEQ ID NO: 9276

SEQ ID NO: 9299 - DNA, 201 bp, Homo sapiens; identical to SEQ ID NO: 9277

SEQ ID NO: 9300 - DNA, 201 bp, Homo sapiens
aaggcacattacaaaaggctaaatgctgctgtttctaagtggaagcactgttgaacaacactcttaggtggaataagaaaattagggttaaactgtaacaytgtaatcggacgaacaaatcagcatctttgatcctcaggttaaaatttaatcttaaatttagaaattcaaagtaacagcctttaaccattaaccttgagg

SEQ ID NO: 9301 - DNA, 201 bp, Homo sapiens
ctgagacagattacacgatagacagatagatagatagatagatagatagatagatagatagatagatagatattgatagagaacatgttgtgtctatatamatatccaatgacacacagtataatcatgttttaaattatgccaaaagtactgattatatcaagcccagtaaacataatgctacacagcacccattcttta

SEQ ID NO: 9302 - DNA, 201 bp, Homo sapiens
aaagaggcttgtagtaaacagatatttttacaaaatttgatgcttctgcaaccataataattttatctataaatgcgtatatacatatatatatatatatwcacatacactcacatgcagatatttacatatatagatattctcttttccttttataaaatcaaagtctaggctcaattggaaaatggaaatatttgcacc

SEQ ID NO: 9303 - DNA, 201 bp, Homo sapiens
gaaaatgggtgcttattggttctccgttagttggccaacccaaaaacagaactggagatgtctataagtgtccagttgggagaggtgaatcattaccttgygtaaagttggatctaccagttaatacatcaattcccaatgtcacagaagtaaaggagaacatgacatttggatcaactttagtcaccaacccaaatggag

SEQ ID NO: 9304 - DNA, 201 bp, Homo sapiens; identical to SEQ ID NO: 9256

SEQ ID NO: 9305 - DNA, 201 bp, Homo sapiens
tatctttgttggtgagcagacactcagagatcctttaattatctgacacaccagggaaatcttggcaatcaactaaggacctgtgacactcataactatgwttacatttggctttagcatatttcaggtaatatctttatgaaaaaaagatgaagtatggaattgtaggaactcttttgcaatagactgagatccaatgtt

SEQ ID NO: 9306 - DNA, 201 bp, Homo sapiens
atatagcaaaagctttccccagtagctgatgaatttagaactttatacaagactccctagcattttcctcctcccacaggctggagaatttcagtgctatsagactgggcagtaggagccagagccaatttgcaggatctcttttccttctgccttccagttggcttctcttctcagctgcgtggtggggatgatttgggg

SEQ ID NO: 9307 - DNA, 201 bp, Homo sapiens
cctgcttttcacaacattgagaaacaggcccagagcctgtctcatgtgccaggtgcagtcacattattgttaaaataaagtggcttctgacaaatcagttyttcaaaatagcatcctatgtacttttcatttcttccaacaaccctcaggcccccttttgccagttttctcccccaggggagattttcaagactactggag

SEQ ID NO: 9308 - DNA, 201 bp, Homo sapiens
tatttaatgattaagaaatgtactagactctatcatttacttttaaaacatttaattagaaaaacaggtgatatttaagactatttataaacttattggcyaaattgccaaaaagtttctttttctctaactttggtattctaaataattgattattgctcccattgtaaactgaaccatgtatgcactctcttttctgac

SEQ ID NO: 9309 - DNA, 201 bp, Homo sapiens
acttcttctgacatcagccaagtcaatgtttcgcttatcttgtggaaaccaacttttataaaatcatatttttccagcttaaatcttactataaggggagracttcggagtgaaaatgcatctctggttttaagtagcagcaatcaaaaaagagagcttgctattcaaatatccaaagatgggctaccgggcagagtgcca

SEQ ID NO: 9310 - DNA, 201 bp, Homo sapiens
tagtaaagctaacggatccattgaaattcatactcagcatctgtgactactagacaaagcccatttactgaaccataagtgtgcacttttaaactaaattrttaactgaaagggaaaaaatagaaatgagggcattttgaagtttttagaaaagagaggaagagctgttggccagatcaaagagatacttataagcccggc

SEQ ID NO: 9311 - DNA, 201 bp, Homo sapiens
tttttaaactaatttccaaagaatttagctgaagactcagagtcagcctacctcttgactctccacatccgcatctaagatcctgaaggccaaaggaatgygcctgtgggatgccaaagccatcagtagctggaagaaagaatacctctttctagaggtttggtgtcctcttgctggcctgtcattatttggaaatacgcg

SEQ ID NO: 9312 - DNA, 201 bp, Homo sapiens
ccacatagaaattaaatgttataaatttatttttttaaactaatttccaaagaatttagctgaagactcagagtcagcctacctcttgactctccacatcygcatctaagatcctgaaggccaaaggaatgcgcctgtgggatgccaaagccatcagtagctggaagaaagaatacctctttctagaggtttggtgtcctc

SEQ ID NO: 9313 - DNA, 201 bp, Homo sapiens
aacctcctgaaaccctttctgataatgtagtaaacatttctatcccggtaaaatatgaagttggactacagttttacagctctgcaagtgaataccacatktcaattgctgccaatgagacagtccctgaagttattaattctactgaggacattggaaatgaaattaatatcttctacttgattagaaaaagtggatctt

SEQ ID NO: 9314 - DNA, 201 bp, Homo sapiens
gcactccttctacatgttgcatgactttcaggactctgtgagaataacgttggactttaatcttaccgatccagaaaatgggcctgttcttgatgattctytaccaaactcagtacatgaatatattccctttgccaaagattgtggaaataaggaaaaatgtatctcagacctcagcctgcatgtcgccaccactgaaaa

SEQ ID NO: 9315 - DNA, 201 bp, Homo sapiens
aatgaaatacgacagcagagaaagatgccactgaaatgctgaaattatctttgctgagcagcttttgaatgctaagggttccagtatgtgacccaaagaargagttgtctcaactccttggtacagggttcattcaaacccccaagctgtgagagtgtgtttatttttaattttttaaaaggtatttaatttccaaccaca

SEQ ID NO: 9316 - DNA, 201 bp, Homo sapiens
ctgcatgtgtgaactactgctgtaaagtttgctgacatttctgcaacaacatttctccatctgatttaccagaacctgtaacaagaccagaacatgtattyatccagaaactcctgggctctgctttgttcaaagaggagcaaatccacatagaaattaaatgttataaatttatttttttaaactaatttccaaagaatt

SEQ ID NO: 9317 - DNA, 201 bp, Homo sapiens
agtatattaaatgggttaaattaagcttttacagaacatgcttaattttgatattgagctctaaatgcaaaactcttttatactgaaaaaacacttaaagyagttttgtgtggcatcacagtgatttgtcatgaaaagccatatatgggggacatgctaaaatggcttctgaatgaaatacgacagcagagaaagatgcca

SEQ ID NO: 9318 - DNA, 201 bp, Homo sapiens
tgttcttatgccccaagatctgcaccttacatcaggcacccgggaatgcttctcattgaaattttaccataccaaaaaatatgtaagggtgactcatcacycctaactttggactccttgctttgagatcggtatttttttctctctctttacatatagcaaaagctttccccagtagctgatgaatttagaactttatac

SEQ ID NO: 9319 - DNA, 201 bp, Homo sapiens
caagtgaacccactgaaaagcatttcttcaatgtctctgatgaattggctctagtcaccattgttaaaactctgggagaaagaatatttgccctggaagcyacagctgaccagtcagcagcttcatttgaaatggaaatgtctcagactggcttcagtgctcattattcacaggactgggtcatgcttggagcagtaggag

SEQ ID NO: 9320 - DNA, 201 bp, Homo sapiens
tagtataatggaggagggacaaagcagaatatacttccaagctggaacatctttaagacatttacaaactgttatgggacactatcagcaactacgcctgkggaagctagcaggatttagctcttcaatggccctccaaatgcacccaacaatcgccaacctcacccatggaaatcatctaaaaaatgaaaagaagggcct

SEQ ID NO: 9321 - DNA, 201 bp, Homo sapiens
tatccacggagaaatggatttaaatggtgacggtctgacagatgtgactattgggggccttggtggtgctgccctcttctggtcccgagatgtggccgtarttaaagtgaccatgaattttgagccaaataaagtgaatattcaaaagaaaaactgccatatggagggaaaggaaacagtatgcataaatgctacagtgtg

SEQ ID NO: 9322 - DNA, 110 bp, Homo sapiens
ggtatttttgtataattctgtcttatctggtgcatcagctgtgtattttacgtcaaggtaaatgagcatcctgttttatatgttaaattttaaaaatgackttttcaaag

SEQ ID NO: 9323 - DNA, 201 bp, Homo sapiens
tgaagtagtcattatggttcattggaatctactgtagcataagctcctaggttgctccatttcttaggaaaatagcaatgaatgaatgtatagtagctgcwtgtgtgaactactgctgtaaagtttgctgacatttctgcaacaacatttctccatctgatttaccagaacctgtaacaagaccagaacatgtattcatcc

SEQ ID NO: 9324 - DNA, 201 bp, Homo sapiens
ttcttgaagtagtcattatggttcattggaatctactgtagcataagctcctaggttgctccatttcttaggaaaatagcaatgaatgaatgtatagtagytgcatgtgtgaactactgctgtaaagtttgctgacatttctgcaacaacatttctccatctgatttaccagaacctgtaacaagaccagaacatgtattc

SEQ ID NO: 9325 - DNA, 201 bp, Homo sapiens
cattcaggaacaaagaagcataacctttgttgactcttgtaatttattatatgcttcatttaaacccattttgtaaagaaatcaggtaacagtcatttaayctgatataattagaaatagctgagagagtaaaaaagcattttgaatgtcctatgtatggcatatcctgtacaccaattgaaggtcagagctttggtattt

SEQ ID NO: 9326 - DNA, 201 bp, Homo sapiens
aaaattaagtcaccaagaatacatttagcatctttgtgttgggttctatacctaaaaattttccctccctgcccaaggtgattggaaagtactgcaattgrgctaaaattttatctaggatggaaaatcaggatagactcgtttaaaaacaagtatattaaatgggttaaattaagcttttacagaacatgcttaattttg

SEQ ID NO: 9327 - DNA, 201 bp, Homo sapiens
actgttttatttctgatattgcctgccattactcaggatgcaagagatgctctgcattccttattaggaaaaattggcctgtaaggagaatggtatactgygtattactactgtgagactgtaaaattgttaatggacagtgtaaagaattgtattcattttattagcaagaaaaatattgcatacaagaactactgccct

SEQ ID NO: 9328 - DNA, 201 bp, Homo sapiens
aagaaaagaattacctgaaaaagatcatttctccctattcaaatgagaatattttcccttggtagaatccatatacaatatggattgaaaattaagtcacsaagaatacatttagcatctttgtgttgggttctatacctaaaaattttccctccctgcccaaggtgattggaaagtactgcaattgagctaaaattttat

SEQ ID NO: 9329 - DNA, 201 bp, Homo sapiens
ccaagaagtcactgctttttaggtgtgttgcatcaatatttaaataaaatcccagaaatgtattttaaagaatttcaggtttgaaaactcaaaccaacagraagatatcacacctttgtatgtgcttctttgttcttgaagtagtcattatggttcattggaatctactgtagcataagctcctaggttgctccatttctt

SEQ ID NO: 9330 - DNA, 201 bp, Homo sapiens
attaaccaaggctaatttcctggagtttaatacactttggattcaagtaaaaacaatcacttaatgcagcaacatctcagaccctcttcactctagaaccrttttatacaagagaactcaacatttactgttttatttctgatattgcctgccattactcaggatgcaagagatgctctgcattccttattaggaaaaatt

SEQ ID NO: 9331 - DNA, 201 bp, Homo sapiens
gatatccatgttcagcatgacagtcagcactcgtaaatgccaagaaaagaattacctgaaaaagatcatttctccctattcaaatgagaatattttccctyggtagaatccatatacaatatggattgaaaattaagtcaccaagaatacatttagcatctttgtgttgggttctatacctaaaaattttccctccctgcc

SEQ ID NO: 9332 - DNA, 201 bp, Homo sapiens
tctaggctcaattggaaaatggaaatatttgcaccaaaagaaaaaagtgccattgttgtgatcaatggagtaaagctggggtatagtagaggctggggaakccctgcccatgttctctccaaggccacagcttgcacaccgtgaatggtggccccactggctccatggagtgtgccttcacgcgggggaatgtccttgtcc

SEQ ID NO: 9333 - DNA, 201 bp, Homo sapiens
ctgggaagcagtgagccaacataattgtcctttcctctacagaatagctgtgcagaaggggaccaccacacttaggaccagtgccaggtgacaatctttcygtcatgctgctgcagcattttgcaccttgagagacaggaaaaaaaatgggggtgagggagtggaagatgatgaaactatttctcttttatgtctacatcc

SEQ ID NO: 9334 - DNA, 201 bp, Homo sapiens
tgccggattgttgctgttaatgctgctcattttagcactgtggaagattggattcttcaaaagaccactgaaaaagaaaatggagaaatgaaatattttaygaaagaaaataataacaattattcaataatctatcctcaggtttgcctcaaatatgtgacaagaaatgtataattcatgacatagtcatgtaactatgta

SEQ ID NO: 9335 - DNA, 201 bp, Homo sapiens
cacaatgaaagccagttgtggtcttgaaaaatctctctattgcattacttatcctcacccttgttttttaagaggtagagagagattactgggaagcagtkagccaacataattgtcctttcctctacagaatagctgtgcagaaggggaccaccacacttaggaccagtgccaggtgacaatctttccgtcatgctgctg

SEQ ID NO: 9336 - DNA, 201 bp, Homo sapiens
aaatcaggatagactcgtttaaaaacaagtatattaaatgggttaaattaagcttttacagaacatgcttaattttgatattgagctctaaatgcaaaacycttttatactgaaaaaacacttaaagtagttttgtgtggcatcacagtgatttgtcatgaaaagccatatatgggggacatgctaaaatggcttctgaat

SEQ ID NO: 9337 - DNA, 201 bp, Homo sapiens
aaagaagacacgatttatgaagctgatttgcagtaccgtgtcaccctagattcactaagacaaatatcacgaagttttttctctggaactcaagagagaarggttcaaaggaacatcacagttcgaaaatcagaatgcactaagcactccttctacatgttgcatgactttcaggactctgtgagaataacgttggacttt

SEQ ID NO: 9338 - DNA, 201 bp, Homo sapiens
tctggagatgtgctctatattgctggacagcctcggtacaatcatacaggccaggtcattatctacaggatggaagatggaaacatcaaaattctccagaygctcagtggagaacagattggttcctactttggcagtattttaacaacaactgacattgacaaggattctaatactgacattcttctagtcggagcccct

SEQ ID NO: 9339 - DNA, 201 bp, Homo sapiens
gtgttacagcttttttaaatgaccttcttgaaagaatggatattggtcctaaacagacacaggttggaattgtacagtatggagaaaacgtgacccatgarttcaacctcaataagtattcttccaccgaagaggtacttgttgcagcaaagaaaatagtccagagaggtggccgccagactatgacagctcttggaatag

SEQ ID NO: 9340 - DNA, 201 bp, Homo sapiens
tggcttctgacaaatcagtttttcaaaatagcatcctatgtacttttcatttcttccaacaaccctcaggcccccttttgccagttttctcccccaggggrgattttcaagactactggagaaaaatctgttaataaaacatttgctctgagtaccagcttcagtgactcaatcatttatacaggatttcagtgttttgtt

SEQ ID NO: 9341 - DNA, 201 bp, Homo sapiens
ccaggtgcctggcagtggcatggcagcactgggtggatgcccaaggggcagagcagctggtgcggaccctgccagccttccagaagtctgtgccacagccrcgcaccgtggagctttccctgcttgccagccccggggccccttcgttttcaggggaggggggaacggggcagcatcaggcctccacagccaggcaaaagg

SEQ ID NO: 9342 - DNA, 201 bp, Homo sapiens
ctaggaggtggaagggtacagcactttgccacatctcttctacgatgccaccagtgcctgatgcccttgcgtgttttgcctgtactgcacgggctccaagkgtaagttcactgggagtcccaggctggctctggaggctgccttggttcgagggcttagttggcaacaaccactctcctcgccttctcaggaggtgccacc

SEQ ID NO: 9343 - DNA, 201 bp, Homo sapiens
ttctataaattgagcccgcagcctcccgcttcgctctctgctcctcctgttcgacagtcagccgcatcttcttttgcgtcgccagccgagccacatcgctsagacaccatggggaaggtgaaggtcggagtcaacggatttggtcgtattgggcgcctggtcaccagggctgcttttaactctggtaaagtggatattgtt

SEQ ID NO: 9344 - DNA, 201 bp, Homo sapiens
ctcctccacctttgacgctggggctggcattgccctcaacgaccactttgtcaagctcatttcctggtatgacaacgaatttggctacagcaacagggtgrtggacctcatggcccacatggcctccaaggagtaagacccctggaccaccagccccagcaagagcacaagaggaagagagagaccctcactgctggggag

SEQ ID NO: 9345 - DNA, 201 bp, Homo sapiens
gcaaggtcatccctgagctgaacgggaagctcactggcatggccttccgtgtccccactgccaacgtgtcagtggtggacctgacctgccgtctagaaaamcctgccaaatatgatgacatcaagaaggtggtgaagcaggcgtcggagggccccctcaagggcatcctgggctacactgagcaccaggtggtctcctctg

SEQ ID NO: 9346 - DNA, 201 bp, Homo sapiens
gtcagtggtggacctgacctgccgtctagaaaaacctgccaaatatgatgacatcaagaaggtggtgaagcaggcgtcggagggccccctcaagggcatcytgggctacactgagcaccaggtggtctcctctgacttcaacagcgacacccactcctccacctttgacgctggggctggcattgccctcaacgaccactt

SEQ ID NO: 9347 - DNA, 201 bp, Homo sapiens
gtggtgaagcaggcgtcggagggccccctcaagggcatcctgggctacactgagcaccaggtggtctcctctgacttcaacagcgacacccactcctccayctttgacgctggggctggcattgccctcaacgaccactttgtcaagctcatttcctggtatgacaacgaatttggctacagcaacagggtggtggacctc

SEQ ID NO: 9348 - DNA, 201 bp, Homo sapiens
tgaagcaggcgtcggagggccccctcaagggcatcctgggctacactgagcaccaggtggtctcctctgacttcaacagcgacacccactcctccaccttygacgctggggctggcattgccctcaacgaccactttgtcaagctcatttcctggtatgacaacgaatttggctacagcaacagggtggtggacctcatgg

SEQ ID NO: 9349 - DNA, 201 bp, Homo sapiens
acgtcgtggagtccactggcgtcttcaccaccatggagaaggctggggctcatttgcaggggggagccaaaagggtcatcatctctgccccctctgctgaygcccccatgttcgtcatgggtgtgaaccatgagaagtatgacaacagcctcaagatcatcagcaatgcctcctgcaccaccaactgcttagcacccctgg

SEQ ID NO: 9350 - DNA, 189 bp, Homo sapiens
gccccagcaagagcacaagaggaagagagagaccctcactgctggggagtccctgccacactcagtcccccaccacactgaatctcccctcctcacagttkccatgtagaccccttgaagaggggaggggcctagggagccgcaccttgtcatgtaccatcaataaagtaccctgtgctcaaccagtta

SEQ ID NO: 9351 - DNA, 201 bp, Homo sapiens
cgtgtcagtggtggacctgacctgccgtctagaaaaacctgccaaatatgatgacatcaagaaggtggtgaagcaggcgtcggagggccccctcaagggcrtcctgggctacactgagcaccaggtggtctcctctgacttcaacagcgacacccactcctccacctttgacgctggggctggcattgccctcaacgacca

SEQ ID NO: 9352 - DNA, 201 bp, Homo sapiens
acctgccaaatatgatgacatcaagaaggtggtgaagcaggcgtcggagggccccctcaagggcatcctgggctacactgagcaccaggtggtctcctctkacttcaacagcgacacccactcctccacctttgacgctggggctggcattgccctcaacgaccactttgtcaagctcatttcctggtatgacaacgaatt

SEQ ID NO: 9353 - DNA, 201 bp, Homo sapiens
gacagaaccagaccctgtctttaaaaagggagttggtggggagaggttctagaatgtcatgtagcaaccagtttaaggactgggactcagggatccaactsccacagtttccctgtgtgaccctaggcatttgacttagcctttctgagcctcaggttttttgtttctgaagtaaaaggattggactaggtaatctccaag

SEQ ID NO: 9354 - DNA, 201 bp, Homo sapiens
ttagacacttcagaattttgatcacctaatgttgatttcagatgtaaaagtcaagagaagactctaaaaatagcaaagatgcttttgagccagaatgcctycatcttcagatcacttaatttggttctcatggtgtatatcagcctcgtgtttggtatttcatatgattcgcctgattacacagatgaatcttgcactttc

SEQ ID NO: 9355 - DNA, 201 bp, Homo sapiens
gtggagagaaggggggccctgcacaaggaaacagggaagagccatcgaagtttcagtcggtgagccttgggcacctcacccatgtcacatcctgtctcctrcaattggaattccaccttgtccagccctccccagttaaagtggggaagacagactttaggatcacgtgtgtgactaatacagaaaggaaacatggcgtcg

SEQ ID NO: 9356 - DNA, 201 bp, Homo sapiens
ctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctca

SEQ ID NO: 9357 - DNA, 201 bp, Homo sapiens
  misc_feature (1)...(201): n = A,T,C or G, or insertion/deletion polymorphism (see Tables 1-2)
cacttcagaattttgatcacctaatgttgatttcagatgtaaaagtcaagagaagactctaaaaatagcaaagatgcttttgagccagaatgccttcatcntcagatcacttaatttggttctcatggtgtatatcagcctcgtgtttggtatttcatatgattcgcctgattacacagatgaatcttgcactttcaagat

SEQ ID NO: 9358 - DNA, 201 bp, Homo sapiens
tggcatgtgcctgttgtcccagctacttgggaggctgaggtgggagaatggcttgagcccaggaagcggaggttgcagtgagccaagatcatgtcactgcrcttcagcctgggtgacagaaccagaccctgtctttaaaaagggagttggtggggagaggttctagaatgtcatgtagcaaccagtttaaggactgggact

SEQ ID NO: 9359 - DNA, 201 bp, Homo sapiens
cctcccaggttcaagtgattctcctgcctcagcctccctcgcaagtagctgggattacaggcgcctgccaccatgcctagcaaatttttgtatttttagtrgagacaggattttaccatgttggccaggctggtctcaaactcctgacctcaagtgatctgccctcctcagcctcgtaaagtgctgggattacaggggtga

SEQ ID NO: 9360 - DNA, 201 bp, Homo sapiens
tcctcagcctcgtaaagtgctgggattacaggggtgagccgctgtgcctggctggccctgtgatatttctgtgaaataaattgggccagggtgggagcagrgaaagaaaaggaaaatagtagcaagagctgcaaagcaggcaggaagggaggaggagagccaggtgagcagtggagagaaggggggccctgcacaaggaaa

SEQ ID NO: 9361 - DNA, 201 bp, Homo sapiens
ctcttctttcgttcttttttttttttttttttgagacagagtctcgttctgtcgcccaagctggagcgcaatggtgtgatcttggctcactgcaacatccscctcccaggttcaagtgattctcctgcctcagcctccctcgcaagtagctgggattacaggcgcctgccaccatgcctagcaaatttttgtatttttagt

SEQ ID NO: 9362 - DNA, 201 bp, Homo sapiens
ctgcatcatgtctaccagggagcagggttccccacagtttcagaggtggtccaggaccctatgatatttctcttctttcgttcttttttttttttttttgtgacagagtctcgttctgtcgcccaagctggagcgcaatggtgtgatcttggctcactgcaacatccgcctcccgggttcaggtgattctcctgcctcagc

SEQ ID NO: 9363 - DNA, 201 bp, Homo sapiens
ctcttctttcgttcttttttttttttttttgagacagagtctcgttctgtcgcccaagctggagcgcaatggtgtgatcttggctcactgcaacatccgcstcccgggttcaggtgattctcctgcctcagcctccctcgcaagtagctgggattacaggcgcctgccaccatgcctagcaaatttttgtatttttagtgg

SEQ ID NO: 9364 - DNA, 201 bp, Homo sapiens; identical to SEQ ID NO: 9354

SEQ ID NO: 9365 - DNA, 201 bp, Homo sapiens; identical to SEQ ID NO: 9360

SEQ ID NO: 9366 - DNA, 201 bp, Homo sapiens; identical to SEQ ID NO: 9355

SEQ ID NO: 9367 - DNA, 201 bp, Homo sapiens
cctcccgggttcaggtgattctcctgcctcagcctccctcgcaagtagctgggattacaggcgcctgccaccatgcctagcaaatttttgtatttttagtrgagacaggattttaccatgttggccaggctggtctcgaactcctgacctcaagtgatctgccctcctcagcctcgtaaagtgctgggattacaggggtga

SEQ ID NO: 9368 - DNA, 201 bp, Homo sapiens; identical to SEQ ID NO: 9357
  misc_feature (1)...(201): n = A,T,C or G, or insertion/deletion polymorphism (see Tables 1-2)

SEQ ID NO: 9369 - DNA, 201 bp, Homo sapiens
aggccccctgcagccgcggagcagtgggcgtccaaagcccagtgcagcagccaggacccgcccgacgcgcagcagaagcacggcgcccaggcgcttaggcrtctcttggagagcaaaggctgcgccaaaacgctgagcctagaatcaaccaaggagcctgagcccaggaaggggctgcgtggctcacagcgctgcggctcc

SEQ ID NO: 9370 - DNA, 201 bp, Homo sapiens
gcccgcgcgtgcctctgcctacaagacctggggcgtcctggccagatctggatggcaggtccctccgccacccccggcccggttccgggggcgtggcttgrcgcgggggcgggtttaagtcaccgcgggtgtctgaccactctgacaggtctccaaatttctcccagtcgcctggcgcccgcggtgcgtttcagagctcca

SEQ ID NO: 9371 - DNA, 201 bp, Homo sapiens
caaagaacgaaataaaggggatgagaactgtgtgctgcgacccttcgaaagcacagctgaaagcgttgacctcgtcttatagctcaggctgggaccctggrgcgagagtccccacaccccctccgggagggatgcttctggccagagccagcgctgcgctgtcagtccttgctcccgaactaggaaagagcctaggaggga

SEQ ID NO: 9372 - DNA, 161 bp, Homo sapiens
actttgttgtcacccagcggcacagagcctggagcccaggctgaaggcaccgacaaatctgatttgccataaaagcattttctttctgttttttttttttttgtatttcttttatatataaaataaatatactaataaaaaggtttaattttttttagaac

SEQ ID NO: 9373 - DNA, 162 bp, Homo sapiens
gactttgttgtcacccagcggcacagagcctggagcccaggctgaaggcaccgacaaatctgatttgccataaaagcattttctttctgttttttttttttttgtatttcttttatatataaaataaatatactaataaaaaggtttaattttttttagaac

SEQ ID NO: 9374 - DNA, 201 bp, Homo sapiens
gatcctcctagctccgagccaaatggactccaaagaacgaaataaaggggatgagaactgtgtgctgcgacccttcgaaagcacagctgaaagcgttgacstcgtcttatagctcaggctgggaccctggggcgagagtccccacaccccctccgggagggatgcttctggccagagccagcgctgcgctgtcagtccttg

SEQ ID NO: 9375 - DNA, 201 bp, Homo sapiens
ttgggatgtggatattgcaaacaaactcgaatctggaggaatccctgggaggattcacatttccaaagccacgctggactgtctcaacggtgactataacrtggaagagggccatggtaaagagaggaatgaattcctgaggaagcataatatcgaaacttacttaattaagcagcctgaggacagtctgctgtccttgcc

SEQ ID NO: 9376 - DNA, 201 bp, Homo sapiens
ggagcagcgcttcattcacgggcaccggggaggcagcggcagcgggagtggaggctcgggcaaagcctcggaccctgcgggcggcggccccaaccaccacrcgccgcagctgtcaggcgactcggcgctgcccctctactcgctgggcccgggagagcgagcgcacagcacctgcggcaccaaagtcttcccggaacgcag

SEQ ID NO: 9377 - DNA, 201 bp, Homo sapiens
tggcccgccatttcctagagaaggaccgagacaatgaggagctgtattctcaatcctatgatgctgttggggtgatgtttgcctccatcccaggatttgcrgacttttactctcagactgaaatgaataaccagggagtggaatgcctgcgcttgctcaatgagatcattgctgacttcgatgagttgcttggtgaagacc

SEQ ID NO: 9378 - DNA, 201 bp, Homo sapiens
gctcggtgctgtgcggtgttttgggactaaggaagtggcagtttgatgtctggtcttgggatgtggatattgcaaacaaactcgaatctggaggaatcccygggaggattcacatttccaaagccacgctggactgtctcaacggtgactataacgtggaagagggccatggtaaagagaggaatgaattcctgaggaagc

SEQ ID NO: 9379 - DNA, 201 bp, Homo sapiens
tgccctttgcccctgggcacagtatgacccgacctacagggagccctagcgcagggctcctgcaacggggcagcctaggataaaaaggatccttgccaagctcctaccaggccgcctttgagtctttaggaacccctcctccggctgcctccccaaggttctgggcctccttccctgcggcccagagccatggagctctcc

SEQ ID NO: 9380 - DNA, 201 bp, Homo sapiens
gatcaaaaccatcaggtatgtgcggtcaaggacaaaacacgatgttgacatgaggattggaatccactccggctcggtgctgtgcggtgttttgggactamggaagtggcagtttgatgtctggtcttgggatgtggatattgcaaacaaactcgaatctggaggaatccctgggaggattcacatttccaaagccacgct

SEQ ID NO: 9381 - DNA, 201 bp, Homo sapiens
cctggccggcctgggcacctcgctgctgcaggtcatcctccaagtggtcataccccggctggcggtcatttccatcaaccaggttgtggcccaggcagtgytattcatgtgtatgaacacagctggaatcttcatcagttacctgtcagaccgggcccagcgccaagctttcctggagactcggaggtgtgtggaggccag

SEQ ID NO: 9382 - DNA, 201 bp, Homo sapiens
tctatgattgcggcctcttgggggattttgcgtttagcccgaaagttggctttgccaaaagacgcacgggtaggaagggcgaaaaggaaaccctgtattcygtcgcgctgggctctccgagtccgtgcgcaaagcggcctacgagtcctggctccgcacctgcagaggacaagagccaatgcctaaaaaagaacagcggag

SEQ ID NO: 9383 - DNA, 201 bp, Homo sapiens
caaccaaggagcctgagcccaggaaggggctgcgtggctcacagcgctgcggctcctgaggacaaatagccactgccgctgcgtacccaagctgcgccggytggcgggagagcagcacgcaaggacgccgaggtccgccgcgatcttccaggtgccctttgcccctgggcacagtatgacccgacctacagggagccctag

SEQ ID NO: 9384 - DNA, 201 bp, Homo sapiens
ctctatgattgcggcctcttgggggattttgcgtttagcccgaaagttggctttgccaaaagacgcacgggtaggaagggcgaaaaggaaaccctgtattycgtcgcgctgggctctccgagtccgtgcgcaaagcggcctacgagtcctggctccgcacctgcagaggacaagagccaatgcctaaaaaagaacagcgga

SEQ ID NO: 9385 - DNA, 201 bp, Homo sapiens
ccattggcagcacctacatggccgtgtcaggcctgtcacctgaaaaacagcaatgtgaagacaagtggggacatttgtgtgctctggctgacttctcactygccctgacagaaagcatacaggagatcaacaagcattcattcaacaattttgaactccggattggcatcagccacggctcagtggtagctggcgttatcg

SEQ ID NO: 9386 - DNA, 201 bp, Homo sapiens
ggacagtggaatacctctatagtcaggatggcagcttccacttcttggagctgaatcctcgcttgcaggtggaacatccctgcacagaaatgattgctgaygttaatctgccggccgcccagctacagggttttaagccgagctccgggactgtccaggaactgaatttccggagcagcaagaacgtgtggggttacttca

SEQ ID NO: 9387 - DNA, 201 bp, Homo sapiens
atttttgtatttttggtagagacagagtttcaccaggttggtcaggctggtctcaaactcttgacttcaggtaatccacccaccttggcctcccaaagtgmtgggattacaggcatgagccaccatcttcagccagatgatttttttattgagagagtgaaatgctattttgttccccaaatggcgctagtgaatcactag

SEQ ID NO: 9388 - DNA, 201 bp, Homo sapiens
aatgagtcgggctactacctggacatcagcctctacaaagaagtgactgactccagatctggaaatatcatgtttcactccttcggcaacaagcaagggcsccagcacgggatgctgatcaatactccctacgtcaccaaggatctgctccaggccaagcgattccaggcccagaccctgggaaccacctacatctatgac

SEQ ID NO: 9389 - DNA, 201 bp, Homo sapiens
ccaggtcctcccagcggattcactactgaacctcgtagatgtggaattaatttacggaggtgttaagtacattctcaaggtggcccggcagtctctgaccrtgttcgttctcatcatgaatggctgccacatcgagattgatgcccaccggctgaatgatggggggctcctgctctcctacaatgggaacagctacaccac

SEQ ID NO: 9390 - DNA, 201 bp, Homo sapiens
tcgcgactgctccatccagcggcggcatcagaagatcgttgaggaagcaccggccaccatcgccccgctggccatattcgagttcatggagcagtgtgccrtccgcctggccaagaccgtgggctatgtgagtgcagggacagtggaatacctctatagtcaggatggcagcttccacttcttggagctgaatcctcgctt

SEQ ID NO: 9391 - DNA, 201 bp, Homo sapiens
ttgcggattcccaatttgggcactgcttctcctggggagagaaccgggaagaggccatttcgaacatggtggtggctttgaaggaactgtccatccgaggygactttaggactaccgtggaatacctcattaacctcctggagaccgagagcttccagaacaacgacatcgacaccgggtggttggactacctcattgctg

SEQ ID NO: 9392 - DNA, 201 bp, Homo sapiens
agtccctgcagaccctgccaacctggattctgaggccaagataattcagcaggcaggacaggtgtggttcccagactcagcctacaaaaccgcccaggccrtcaaggacttcaaccgggagaagttgcccctgatgatctttgccaactggagggggttctccggtggcatgaaagacatgtatgaccaggtgctgaagtt

SEQ ID NO: 9393 - DNA, 201 bp, Homo sapiens
agcaagctggctccccctccaaagaagacaagaagcaggcaaacatcaagaggcagctgatgaccaacttcatcctgggctcttttgatgactactcctcygacgaggactctgttgctggctcatctcgtgagtctacccggaagggcagccgggccagcttgggggccctgtccctggaggcttatctgaccacaggtg

SEQ ID NO: 9394 - DNA, 119 bp, Homo sapiens
atggtcttgcttctttgtytatcttgtctgattttctcctgtctgaccttttcctggttaaaaatctgggggaaaatgacggactccaagccgatcaccaagagtaaatcagaagcaaa

SEQ ID NO: 9395 - DNA, 201 bp, Homo sapiens
cagcctctacaaagaagtgactgactccagatctggaaatatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggcaag

SEQ ID NO: 9396 - DNA, 201 bp, Homo sapiens
atcaccgtgccagatgactttgagggggtttataccatcctggagtggctgtcctatatgccaaaggataatcacagccctgtccctatcatcacacccaytgaccccattgacagagaaattgaattcctcccatccagagctccctacgacccccggtggatgcttgcaggaaggcctcacccaactctgaagggaacg

SEQ ID NO: 9397 - DNA, 201 bp, Homo sapiens
aagaatttcccaagtttttcacattcagagcaagagatgagtttgcagaagatcgcatttaccgtcacttggaacctgccctggccttccagctggaactyaaccggatgcgtaacttcgatctgaccgccgtgccctgtgccaaccacaagatgcacctttacctgggtgctgccaaggtgaaggaaggtgtggaagtga

SEQ ID NO: 9398 - DNA, 201 bp, Homo sapiens
cccgtcacctggaagttcagatcctcgctgaccagtatgggaatgctgtgtctctgtttggtcgcgactgctccatccagcggcggcatcagaagatcgtkgaggaagcaccggccaccatcgccccgctggccatattcgagttcatggagcagtgtgccatccgcctggccaagaccgtgggctatgtgagtgcaggga

SEQ ID NO: 9399 - DNA, 201 bp, Homo sapiens
ccatgccgatttgctcagggagaacgttgcaatgcacccagcagctcctggctctgcaggcggcacagcctggggccctgtgatcctctggtttcttccaytggggcggagtcgggggtggagggagctggccacaacccactgctctgatgggtggtttgtccaaggatgctgaatgtaatgcctggtcaatgtggaagc

SEQ ID NO: 9400 - DNA, 201 bp, Homo sapiens
tgtgatatacctgagccagcacatcagcccagctgagcgggcgcaggtcgttcacctgctgtctaccatggacagcccggcctccacctgaccgtggcccrcccagccactcccgggaccacggcaaaaggaaccacccagacccaccacccgtacaccctcagcagaccctgaagacttgcttttaaacaaagaaaatcc

SEQ ID NO: 9401 - DNA, 201 bp, Homo sapiens
agcctggggccctgtgatcctctggtttcttccattggggcggagtcgggggtggagggagctggccacaacccactgctctgatgggtggtttgtccaargatgctgaatgtaatgcctggtcaatgtggaagcccatgaggttgcccagggaagcctccaaaagctgggatgcttgagggtatccaagttgaaaaagac

SEQ ID NO: 9402 - DNA, 201 bp, Homo sapiens
acccgtacaccctcagcagaccctgaagacttgcttttaaacaaagaaaatcctgggcacttctgcagggctgctggttccgagctgacacccgtcttaayaaaaggcccaggagtgcctcttccaaacaaaaacagcctcctctccatagctgggaagtttattttgttttgtctctgaagacagcagttttattgcatc

SEQ ID NO: 9403 - DNA, 201 bp, Homo sapiens
cgcaaacaaagtcgtgtgcatggcgtccttggaggtttacgtgcggaggggctacatcgcctatgagttaaacagcctgcagcaccggcagctcccggacrgcacctgcgtggtagaattccagttcatgctgccgtcctcccacccaaaccggatgaccgtgcccatcagcatcaccaaccctgacctgctgaggcacag

SEQ ID NO: 9404 - DNA, 201 bp, Homo sapiens
ctgaaccgttcacaggagaactccctgcccagcagacactgcccatcctcggagagaaactgcaccaggtcttccacagcgtcctggaaaacctcaccaaygtcatgagtggcttttgtctgccagagcccgtttttagcataaagctgaaggagtgggtgcagaagctcatgatgaccctccggcacccgtcactgccgc

SEQ ID NO: 9405 - DNA, 201 bp, Homo sapiens
ataactcaggggagacaccgcagagaaatggggagggccacactctgcccaagacacccagccaggccgagccagcctcccacaaaggccccaaagatgcyggtcggcggagaaactccctaccaccctcccaccagaagcccccaagaaaccccctttcttccagtgacgcagcaccctccccagagcttcaagccaacg

SEQ ID NO: 9406 - DNA, 201 bp, Homo sapiens
gggtgaagtacatcaagcgtccaggtgccgtgctggaagcaggctgcgtggtggccaggctggagctcgatgacccttctaaagtccacccggctgaaccrttcacaggagaactccctgcccagcagacactgcccatcctcggagagaaactgcaccaggtcttccacagcgtcctggaaaacctcaccaacgtcatga

SEQ ID NO: 9407 - DNA, 201 bp, Homo sapiens
acagagactttaccgtggcttctcccgctgagtttgtcacacgctttgggggggatcgggtcatcgagaaggtgcttattgccaacaacgggattgccgcygtgaagtgcatgcgctccatccgcaggtgggcctatgagatgttccgcaacgagcgggccatccggtttgttgtgatggtgacccccgaggaccttaagg

SEQ ID NO: 9408 - DNA, 201 bp, Homo sapiens
gtacccggaaggacgggatgtgatcgtcatcggcaatgacatcacctttcgcattggatcctttggccctggagaggaccttctgtacctgcgggcatccragatggcccgggcagagggcattcccaaaatttacgtggcagccaacagtggcgcccgtattggcatggcagaggagatcaaacacatgttccacgtggc

SEQ ID NO: 9409 - DNA, 201 bp, Homo sapiens
acggccttagacaatacaaacagcccatcctgatctatatcccgccctatgcggagctccggggaggctcctgggtggtcatagatgccaccatcaaccckctgtgcatagaaatgtatgcagacaaagagagcaggggtggtgttctggaaccagaggggacagtggagattaagttccgaaagaaagatctgataaagt

SEQ ID NO: 9410 - DNA, 201 bp, Homo sapiens
gactccccaagactacaccagaatcagctccctgaactccgtccactgtaaacacatcgaggaaggaggagagtccagatacatgatcacggatatcatcrggaaggatgatggcttgggcgtggagaatctgaggggctcaggcatgattgctggggagtcctctctggcttacgaagagatcgtcaccattagcttggt

SEQ ID NO: 9411 - DNA, 201 bp, Homo sapiens
gggagaacgttgcaatgcacccagcagctcctggctctgcaggcggcacagcctggggccctgtgatcctctggtttcttccattggggcggagtcggggrtggagggagctggccacaacccactgctctgatgggtggtttgtccaaggatgctgaatgtaatgcctggtcaatgtggaagcccatgaggttgcccagg

SEQ ID NO: 9412 - DNA, 201 bp, Homo sapiens
aattcctcccatccagagctccctacgacccccggtggatgcttgcaggaaggcctcacccaactctgaagggaacgtggcagagcggattctttgaccayggcagtttcaaggaaatcatggcaccctgggcgcagaccgtggtgacaggacgagcaaggcttggggggattcccgtgggagtgattgctgtggagacac

SEQ ID NO: 9413 - DNA, 201 bp, Homo sapiens
tggaggtggcagtccctgcagaccctgccaacctggattctgaggccaagataattcagcaggcaggacaggtgtggttcccagactcagcctacaaaacygcccaggccatcaaggacttcaaccgggagaagttgcccctgatgatctttgccaactggagggggttctccggtggcatgaaagacatgtatgaccagg

SEQ ID NO: 9414 - DNA, 201 bp, Homo sapiens
ggacagtggaatacctctatagtcaggatggcagcttccacttcttggagctgaatcctcgcttgcaggtggaacatccctgcacagaaatgattgctgaygttaatctgccggccgcccagctacagatcgccatgggcgtgccactgcaccggctgaaggatatccggcttctgtatggagagtcaccatggggagtga

SEQ ID NO: 9415 - DNA, 201 bp, Homo sapiens; identical to SEQ ID NO: 9387

SEQ ID NO: 9416 - DNA, 201 bp, Homo sapiens; identical to SEQ ID NO: 9388

SEQ ID NO: 9417 - DNA, 201 bp, Homo sapiens; identical to SEQ ID NO: 9389

SEQ ID NO: 9418 - DNA, 201 bp, Homo sapiens; identical to SEQ ID NO: 9390

SEQ ID NO: 9419 - DNA, 201 bp, Homo sapiens
gctactggaggcctgcacgagtttgcggattcccaatttgggcactgcttctcctggggagagaaccgggaagaggccatttcgaactgtccatccgaggygactttaggactaccgtggaatacctcattaacctcctggagaccgagagcttccagaacaacgacatcgacaccgggtggttggactacctcattgctg

SEQ ID NO: 9420 - DNA, 201 bp, Homo sapiens
ggatatccggcttctgtatggagagtcaccatggggagtgactcccatttcttttgaaaccccctcaaaccctcccctcgcccgaggccacgtcattgccrccagaatcaccagcgaaaacccagacgaggcaaccgagctccgggactgtccaggaactgaatttccggagcagcaagaacgtgtggggttacttcagcg

SEQ ID NO: 9421 - DNA, 201 bp, Homo sapiens; identical to SEQ ID NO: 9392

SEQ ID NO: 9422 - DNA, 201 bp, Homo sapiens; identical to SEQ ID NO: 9393

SEQ ID NO: 9423 - DNA, 201 bp, Homo sapiens
cagcctctacaaagaagtgactgactccagatctggaaatatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggcaaa

SEQ ID NO: 9424 - DNA, 119 bp, Homo sapiens; identical to SEQ ID NO: 9394

SEQ ID NO: 9425 - DNA, 201 bp, Homo sapiens; identical to SEQ ID NO: 9396

SEQ ID NO: 9426 - DNA, 201 bp, Homo sapiens; identical to SEQ ID NO: 9397

SEQ ID NO: 9427 - DNA, 201 bp, Homo sapiens; identical to SEQ ID NO: 9398

SEQ ID NO: 9428 - DNA, 201 bp, Homo sapiens; identical to SEQ ID NO: 9399

SEQ ID NO: 9429 - DNA, 201 bp, Homo sapiens; identical to SEQ ID NO: 9400

SEQ ID NO: 9430 - DNA, 201 bp, Homo sapiens
catcttcgacgtcctgcctactttcttctatcacgcaaacaaagtcgtgtgcatggcgtccttggagttaaacagcctgcagcaccggcagctcccggacrgcacctgcgtggtagaattccagttcatgctgccgtcctcccacccaaaccggcacagcacagagctcttcatggacagcggcttctccccactgtgcca

SEQ ID NO: 9431 - DNA, 201 bp, Homo sapiens; identical to SEQ ID NO: 9402

SEQ ID NO: 9432 - DNA, 201 bp, Homo sapiens; identical to SEQ ID NO: 9401

SEQ ID NO: 9433 - DNA, 201 bp, Homo sapiens; identical to SEQ ID NO: 9404

SEQ ID NO: 9434 - DNA, 201 bp, Homo sapiens; identical to SEQ ID NO: 9405

SEQ ID NO: 9435 - DNA, 201 bp, Homo sapiens; identical to SEQ ID NO: 9406

SEQ ID NO: 9436 - DNA, 201 bp, Homo sapiens; identical to SEQ ID NO: 9407

SEQ ID NO: 9437 - DNA, 201 bp, Homo sapiens; identical to SEQ ID NO: 9409

SEQ ID NO: 9438 - DNA, 201 bp, Homo sapiens; identical to SEQ ID NO: 9408

SEQ ID NO: 9439 - DNA, 201 bp, Homo sapiens; identical to SEQ ID NO: 9410

SEQ ID NO: 9440 - DNA, 201 bp, Homo sapiens; identical to SEQ ID NO: 9411

SEQ ID NO: 9441 - DNA, 201 bp, Homo sapiens; identical to SEQ ID NO: 9412

SEQ ID NO: 9442 - DNA, 201 bp, Homo sapiens; identical to SEQ ID NO: 9413

SEQ ID NO: 9443 - DNA, 201 bp, Homo sapiens; identical to SEQ ID NO: 9414

SEQ ID NO: 9444 - DNA, 201 bp, Homo sapiens; identical to SEQ ID NO: 9387

SEQ ID NO: 9445 - DNA, 201 bp, Homo sapiens; identical to SEQ ID NO: 9388

SEQ ID NO: 9446 - DNA, 201 bp, Homo sapiens; identical to SEQ ID NO: 9389

SEQ ID NO: 9447 - DNA, 201 bp, Homo sapiens; identical to SEQ ID NO: 9390

SEQ ID NO: 9448 - DNA, 201 bp, Homo sapiens; identical to SEQ ID NO: 9391

SEQ ID NO: 9449 - DNA, 201 bp, Homo sapiens
ggatatccggcttctgtatggagagtcaccatggggagtgactcccatttcttttgaaaccccctcaaaccctcccctcgcccgaggccacgtcattgccrccagaatcaccagcgaaaacccagacgagggttttaagccgagctccgggactgtccaggaactgaatttccggagcagcaagaacgtgtggggttactt

SEQ ID NO: 9450 - DNA, 201 bp, Homo sapiens; identical to SEQ ID NO: 9392

SEQ ID NO: 9451 - DNA, 201 bp, Homo sapiens; identical to SEQ ID NO: 9393

SEQ ID NO: 9452 - DNA, 201 bp, Homo sapiens
cagcctctacaaagaagtgactgactccagatctggaaatatcatgtttcactccttcggcaacaagcaagggccccagcacgggatgctgatcaatactscctacgtcaccaaggatctgctccaggccaagcgattccaggcccagaccctgggaaccacctacatctatgacttcccggaaatgttcaggcaggctct

SEQ ID NO: 9453 - DNA, 119 bp, Homo sapiens; identical to SEQ ID NO: 9394

SEQ ID NO: 9454 - DNA, 201 bp, Homo sapiens; identical to SEQ ID NO: 9396

SEQ ID NO: 9455 - DNA, 201 bp, Homo sapiens; identical to SEQ ID NO: 9397

SEQ ID NO: 9456 - DNA, 201 bp, Homo sapiens; identical to SEQ ID NO: 9398

SEQ ID NO: 9457 - DNA, 201 bp, Homo sapiens; identical to SEQ ID NO: 9399

SEQ ID NO: 9458 - DNA, 201 bp, Homo sapiens; identical to SEQ ID NO: 9400

SEQ ID NO: 9459 - DNA, 201 bp, Homo sapiens; identical to SEQ ID NO: 9403

SEQ ID NO: 9460 - DNA, 201 bp, Homo sapiens; identical to SEQ ID NO: 9402

SEQ ID NO: 9461 - DNA, 201 bp, Homo sapiens; identical to SEQ ID NO: 9401

SEQ ID NO: 9462 - DNA, 201 bp, Homo sapiens; identical to SEQ ID NO: 9404

SEQ ID NO: 9463 - DNA, 201 bp, Homo sapiens; identical to SEQ ID NO: 9405

SEQ ID NO: 9464 - DNA, 201 bp, Homo sapiens; identical to SEQ ID NO: 9406

SEQ ID NO: 9465 - DNA, 201 bp, Homo sapiens; identical to SEQ ID NO: 9407

SEQ ID NO: 9466 - DNA, 201 bp, Homo sapiens; identical to SEQ ID NO: 9409

SEQ ID NO: 9467 - DNA, 201 bp, Homo sapiens; identical to SEQ ID NO: 9408

SEQ ID NO: 9468 - DNA, 201 bp, Homo sapiens; identical to SEQ ID NO: 9410

SEQ ID NO: 9469 - DNA, 201 bp, Homo sapiens; identical to SEQ ID NO: 9411

SEQ ID NO: 9470 - DNA, 201 bp, Homo sapiens; identical to SEQ ID NO: 9412

SEQ ID NO: 9471 - DNA, 201 bp, Homo sapiens; identical to SEQ ID NO: 9413

SEQ ID NO: 9472 - DNA, 201 bp, Homo sapiens
ccaggtcctcccagcggattcactactgaacctcgtagatgtggaattaatttacgagggtgtaaagtacattctaaaggtgacccggcagtctctgaccrtgttcgttctcatcatgaatggctgccacatcgagattgatgcccaccggctgaatgatggggggctcctgctctcctacaatgggaacagctacaccac

SEQ ID NO: 9473 - DNA, 201 bp, Homo sapiens; identical to SEQ ID NO: 9396

SEQ ID NO: 9474 - DNA, 201 bp, Homo sapiens
aagaatttcccaagtttttcacattcagagcaagagatgagtttgcagaagatcgcatttaccgtcacttggaacctgccctggctttccagctggaactyaaccggatgcgtaacttcgatctgaccgccgtgccctgtgccaaccacaagatgcacctttacctgggtgctgccaaggtggaaggaaggtatgaagtga

SEQ ID NO: 9475 - DNA, 201 bp, Homo sapiens; identical to SEQ ID NO: 9392

SEQ ID NO: 9476 - DNA, 201 bp, Homo sapiens
gtacccggaaggacgggatgtgatcgtcatcggcaatgacatcacctttcgcattggatcctttggccctggagaggaccttctgtacctgcgggcatccragatggcccgggcagaggcgattcccaaaatttacgtggcagccaacagtggcgcccgtattggcatggcagaggagatcaaacacatgttccacgtggc

SEQ ID NO: 9477 - DNA, 201 bp, Homo sapiens
ggacagtggaatacctctatagtcaggatggtagcttccacttcttggagctgaatcctcgcttgcaggtggaacatccctgcacagaaatgattgctgaygttaatctgccggccgcccagctacagatcgccatgggtgccccactgcaccggctgaaagatatccggcttctgtatggagagtcaccctggggagact

SEQ ID NO: 9478 - DNA, 201 bp, Homo sapiens; identical to SEQ ID NO: 9388

SEQ ID NO: 9479 - DNA, 201 bp, Homo sapiens
tcgcgactgctccatccagcggcggcatcagaagatcgttgaggaagcaccggccaccatcgcgccgctggccatattcgagttcatggagcagtgtgccrttcgcctggccaagaccgtgggctatgtgagtgcagggacagtggaatacctctatagtcaggatggtagcttccacttcttggagctgaatcctcgctt

SEQ ID NO: 9480 - DNA, 201 bp, Homo sapiens
agcaagctggtcccctccaaagaagacaagaagcaggcaaacatcaagaggcagctgatgaccaacttcatcctgggctcttttgatgactactcctccgycgaggactctgttgctggctcatctcgtgagtctacccggaagggcagccgggccagcttgggggccctgtccctggaggcttatctgaccacaggtgaa

SEQ ID NO: 9481 - DNA, 201 bp, Homo sapiens
cccgtcacctggaagttcagatcctcgctgaccagtatgggaatgctgtgtctctgtttggtcgcgactgctccatccagcggcggcatcagaagatcgtkgaggaagcaccggccaccatcgcgccgctggccatattcgagttcatggagcagtgtgccattcgcctggccaagaccgtgggctatgtgagtgcaggga

SEQ ID NO: 9482 - DNA, 201 bp, Homo sapiens
cgcaaacaaagtcgtgtgcatggcgtccttggaggtttacgtggggggggcttacatcgcctatgtgttaaacagcctgcagcaccggcagctcccggacrgcacctgcgtggtagaattccagttcatgctgccgtcctcccacccaaaccggatgaccgtgcccatcagcatcaccaaccctgacctgctgaggcacac

SEQ ID NO: 9483 - DNA, 201 bp, Homo sapiens; identical to SEQ ID NO: 9412

SEQ ID NO: 9484 - DNA, 201 bp, Homo sapiens; identical to SEQ ID NO: 9413

SEQ ID NO: 9485 - DNA, 201 bp, Homo sapiens
acagagactttaccgtggcttctcccgctgagtttgtcacacgctttgggggggatcgggtcatcgagaaggtgcttattgccaacaacgggattgccgcygtgaagtgcatgcgctccatccgcaggtgggcctatgagatgttccgcaacgagcgggccatccggtttgttcgcatggtgacccccgaggaccttaagg

SEQ ID NO: 9486 - DNA, 201 bp, Homo sapiens; identical to SEQ ID NO: 9410

SEQ ID NO: 9487 - DNA, 201 bp, Homo sapiens
acggccttagacaatacaaacagcccatcctgatctatatccgccctatgcgggagctccggggaggctcctgggtggtcatagatgccaccatcaaccckctgtgcatagaaatgtatgcagacaaagagagcaggggtggtgttctggaaccagaggggacagtggagattaagttccgaaaggaagatctgataaagt

SEQ ID NO: 9488 - DNA, 201 bp, Homo sapiens; identical to SEQ ID NO: 9452

SEQ ID NO: 9489 - DNA, 201 bp, Homo sapiens
gtactcattcaaaagtcaaggcaggtgcatttttggcagccacttcattgattccatgaaggaaagtattgtatactgaaaataacgaatacctcaaggcrtgacacataatttaataatcattacttcagtgttgagtcttatcagtgattctttttcaagactctgaaggcgaatctacattttaaaaattattacata

SEQ ID NO: 9490 - DNA, 201 bp, Homo sapiens
aagggagagtgtctgtgcccacacatcccgaggctgtgggcgatgcctccctcaccgtggtcaagctgctggcaagtgatgcgggtctttaccgctgtgaygtcatgtacgggattgaagacacacaagacacggtgtcactgactgtggatggtaaggcttttattatctgcaagaaggtagtataacatgacacctggt

SEQ ID NO: 9491 - DNA, 201 bp, Homo sapiens
ctgtgggcgatgcctccctcaccgtggtcaagctgctggcaagtgatgcgggtctttaccgctgtgacgtcatgtacgggattgaagacacacaagacacrgtgtcactgactgtggatggtaaggcttttattatctgcaagaaggtagtataacatgacacctggttcagaagcattgagaaatagcactcagaagtaa

SEQ ID NO: 9492 - DNA, 201 bp, Homo sapiens
tccttgtggcccaaaatggaaatatcaagattggtcaggactacaaagggagagtgtctgtgcccacacatcccgaggctgtgggcgatgcctccctcacygtggtcaagctgctggcaagtgatgcgggtctttaccgctgtgacgtcatgtacgggattgaagacacacaagacacggtgtcactgactgtggatggta

SEQ ID NO: 9493 - DNA, 201 bp, Homo sapiens
tccaattacagaaggctctggagaagcagaagaagatgaagatacaatgttcaccatggtaactgatttatcacagagaaatactactgatacactcattrctttagacactagcaggataatcacagaaagcttttttgaggttcctgcaaccaccatttatccagtttctgaacaaccttctgcaaaagtggtgcctac

SEQ ID NO: 9494 - DNA, 201 bp, Homo sapiens
gatgggaaaggcaggagtcaggacttatggattccgttctccccaggaaacttacgatgtgtattgttatgtggatcatctggatggtgatgtgttccacytcactgtccccagtaaattcaccttcgaggaggctgcaaaagagtgtgaaaaccaggatgccaggctggcaacagtgggggaactccaggcggcatggag

SEQ ID NO: 9495 - DNA, 201 bp, Homo sapiens
atgtggatcatctggatggtgatgtgttccacctcactgtccccagtaaattcaccttcgaggaggctgcaaaagagtgtgaaaaccaggatgccaggctkgcaacagtgggggaactccaggcggcatggaggaacggctttgaccagtgcgattacgggtggctgtcggatgccagcgtgcgccaccctgtgactgtgg

SEQ ID NO: 9496 - DNA, 201 bp, Homo sapiens
ctgttttctccccattatttgaataaagtgactgctgaagatgactttgaatccttatccacttaatttaatgtttaaagaaaaacctgtaatggaaagtragactccttccctaatttcagtttagagcaacttgaagaagagtagacaaaaaataaaatgcacatagaaaaagagaaaaagggcacaaagggattggcc

SEQ ID NO: 9497 - DNA, 201 bp, Homo sapiens
cgtagtcctgcctctgtctttatggagcagggctctggagaagctgctgccgacccagaaaccaccactgtttcttcattttcattaaacgtagagtatgmaattcaagccgaaaaggaagtagctggcactttgtctccgcatgtggaaactacattctccactgagccaacaggactggttttgagtacagtaatggac

SEQ ID NO: 9498 - DNA, 201 bp, Homo sapiens
tcccacgtagtcctgcctctgtctttatggagcagggctctggagaagctgctgccgacccagaaaccaccactgtttcttcattttcattaaacgtagaktatgcaattcaagccgaaaaggaagtagctggcactttgtctccgcatgtggaaactacattctccactgagccaacaggactggttttgagtacagtaa

SEQ ID NO: 9499 - DNA, 201 bp, Homo sapiens
ctccccattatttgaataaagtgactgctgaagatgactttgaatccttatccacttaatttaatgtttaaagaaaaacctgtaatggaaagtaagactcyttccctaatttcagtttagagcaacttgaagaagagtagacaaaaaataaaatgcacatagaaaaagagaaaaagggcacaaagggattggcccaatatt

SEQ ID NO: 9500 - DNA, 201 bp, Homo sapiens
cttctgcaaaagtggtgcctaccaagtttgtaagtgaaacagacacttctgagtggatttccagtaccactgttgaggaaaagaaaaggaaggaggaggarggaactacaggtacggcttctacatttgaggtatattcatctacacagagatcggatcaattaattttaccctttgaattagaaagtccaaatgtagcta

SEQ ID NO: 9501 - DNA, 201 bp, Homo sapiens
cagaacatttttcaggtggtgagcctgatgttttccccacagtcccattccatgaggaatttgaaagtggaacagccaaaaaaggggcagaatcagtcacrgagagagatactgaagttggtcatcaggcacatgaacatactgaacctgtatctctgtttcctgaagagtcttcaggagagattgccattgaccaagaat

SEQ ID NO: 9502 - DNA, 201 bp, Homo sapiens
aaagagaaaaagggcacaaagggattggcccaatattgattcttttttataaaacctcctttggcttagaaggaatgactctagctacaataatacacagwatgtttaagcaggttcccttggttgttgcattaaatgtaatccacctttaggtattttagagcacagaacaacactgtgttgatctagtaggtttctatt

SEQ ID NO: 9503 - DNA, 201 bp, Homo sapiens
actctagctacaataatacacagtatgtttaagcaggttcccttggttgttgcattaaatgtaatccacctttaggtattttagagcacagaacaacactktgttgatctagtaggtttctatttttcctttctctttacaatgcacataatactttcctgtatttatatctgtaaaatgtgaatgactttttttgtgaat

SEQ ID NO: 9504 - DNA, 201 bp, Homo sapiens
tttcataacactaactcataaggttaccgatcaatgcatttcatacggatatagacctagggctctggagggtgggggattgttaaaacacatgcaaaaamaaaaaaaaaaaaaaaagaaattttgtatatataaccattttaatcttttataaagttttgaatgttcatgtatgaatgctgcagctgtgaagcatacata

SEQ ID NO: 9505 - DNA, 201 bp, Homo sapiens
taatttcagtttagagcaacttgaagaagagtagacaaaaaataaaatgcacatagaaaaagagaaaaagggcacaaagggattggcccaatattgattcttttttataaaacctcctttggcttagaaggaatgactctagctacaataatacacagtatgtttaagcaggttcccttggttgttgcattaaatgtaatc

SEQ ID NO: 9506 - DNA, 201 bp, Homo sapiens
agatgtggacctctctaagccagtatctactgttccccaatttgcacacacttcagaggtggaaggattagcatttgttagttatagtagcacccaagagyctactacttatgtagactcttcccataccattcctctttctgtaattcccaagacagactggggagtgttagtaccttctgttccatcagaagatgaagt

SEQ ID NO: 9507 - DNA, 201 bp, Homo sapiens
gcaaaagagtgtgaaaaccaggatgccaggctggcaacagtgggggaactccaggcggcatggaggaacggctttgaccagtgcgattacgggtggctgtyggatgccagcgtgcgccaccctgtgactgtggccagggcccagtgtggaggtggtctacttggggtgagaaccctgtatcgttttgagaaccagacaggc

SEQ ID NO: 9508 - DNA, 201 bp, Homo sapiens
ctggagaagactgtgttgtaatcatttggcatgagaatggccagtggaatgatgttccctgcaattaccatctcacctatacgtgcaagaaaggaacagtygcttgcggccagccccctgttgtagaaaatgccaagacctttggaaagatgaaacctcgttatgaaatcaactccctgattagataccactgcaaagatg

SEQ ID NO: 9509 - DNA, 201 bp, Homo sapiens
cctgagacttaccctgaaacatcagaacatttttcaggtggtgagcctgatgttttccccacagtcccattccatgaggaatttgaaagtggaacagccaraaaaggggcagaatcagtcacagagagagatactgaagttggtcatcaggcacatgaacatactgaacctgtatctctgtttcctgaagagtcttcagga

SEQ ID NO: 9510 - DNA, 201 bp, Homo sapiens
ctgtgggcgatgcctccctcaccgtggtcaagctgctggcaagtgatgcgggtctttaccgctgtgacgtcatgtacgggattgaagacacacaagacacrgtgtcactgactgtggatggggttgtgtttcactacagggcggcaaccagcaggtacacactgaattttgaggctgctcagaaggcttgtttggacgttg

SEQ ID NO: 9511 - DNA, 201 bp, Homo sapiens
tttacagaaacaaatacattagaaaatttgggggcacagaccactgagcacagcagtatccatcaacctggggttcaggaagggctgaccactctcccacrtagtcctgcctctgtctttatggagcagggctctggagaagctgctgccgacccagaaaccaccactgtttcttcattttcattaaacgtagagtatgca

SEQ ID NO: 9512 - DNA, 201 bp, Homo sapiens
cagagcagctctttgctgcctatgaagatggatttgagcagtgtgacgcaggctggctggctgatcagactgtcagatatcccatccgggctcccagagtrggctgttatggagataagatgggaaaggcaggagtcaggacttatggattccgttctccccaggaaacttacgatgtgtattgttatgtggatcatctgg

SEQ ID NO: 9513 - DNA, 201 bp, Homo sapiens
cagagatcccccagcccagtgctctgccaggaatagacgtcggctcatctgtaatgtccccacaggattcttttaaggaaattcatgtaaatattgaagcractttcaaaccatcaagtgaggaataccttcacataactgagcctccctctttatctcctgacacaaaattagaaccttcagaagatgatggtaaacctg

SEQ ID NO: 9514 - DNA, 201 bp, Homo sapiens
ccagggaaatagtgatttcagagcgattaggagaaccaaattatggggcagaaataaggggcttttccacaggttttcctttggaggaagatttcagtggygactttagagaatactcaacagtgtctcatcccatagcaaaagaagaaacggtaatgatggaaggctctggagatgcagcatttagggacacccagactt

SEQ ID NO: 9515 - DNA, 201 bp, Homo sapiens
gatcacatgggctttcacttcacaactgggatccctgctcctagcacagaaacagaattagacgttttacttcccacggcaacatccctgccaattcctcrtaagtctgccacagttattccagagattgaaggaataaaagctgaagcaaaagccctggatgacatgtttgaatcaagcactttgtctgatggtcaagct

SEQ ID NO: 9516 - DNA, 201 bp, Homo sapiens
ctactgcattagtaactgaatctataccagctgaacatgtagtcacagattcaccaatcaaaaaggaagaaagtacaaaacattttccgaaaggcatgagrccaacaattcaagagtcagatactgagctcttattctctggactgggatcaggagaagaagttttacctactctaccaacagagtcagtgaattttactg

SEQ ID NO: 9517 - DNA, 201 bp, Homo sapiens
acagagtcagtgaattttactgaagtggaacaaatcaataacacattatatccccacacttctcaagtggaaagtacctcaagtgacaaaattgaagactwtaacagaatggaaaatgtggcaaaagaagttggaccactcgtatctcaaacagacatctttgaaggtagtgggtcagtaaccagcacaacattaatagaa

SEQ ID NO: 9518 - DNA, 201 bp, Homo sapiens
tgatggtaaacctgagttattagaagaaatggaagcttctcccacagaacttattgctgtggaaggaactgagattctccaagatttccaaaacaaaacckatggtcaagtttctggagaagcaatcaagatgtttcccaccattaaaacacctgaggctggaactgttattacaactgccgatgaaattgaattagaagg

SEQ ID NO: 9519 - DNA, 201 bp, Homo sapiens
ggctctgctgatgttctggctagctacactcaggcaacacatgatgaatcaatgacttatgaagatagaagccaactagatcacatgggctttcacttcamaactgggatccctgctcctagcacagaaacagaattagacgttttacttcccacggcaacatccctgccaattcctcgtaagtctgccacagttattcca

SEQ ID NO: 9520 - DNA, 201 bp, Homo sapiens
atacattagaaaatttgggggcacagaccactgagcacagcagtatccatcaacctggggttcaggaagggctgaccactctcccacgtagtcctgcctckgtctttatggagcagggctctggagaagctgctgccgacccagaaaccaccactgtttcttcattttcattaaacgtagagtatgcaattcaagccgaaa

SEQ ID NO: 9521 - DNA, 201 bp, Homo sapiens
cacattatatccccacacttctcaagtggaaagtacctcaagtgacaaaattgaagactttaacagaatggaaaatgtggcaaaagaagttggaccactcstatctcaaacagacatctttgaaggtagtgggtcagtaaccagcacaacattaatagaaattttaagtgacactggagcagaaggacccacggtggcacc

SEQ ID NO: 9522 - DNA, 201 bp, Homo sapiens
tcggatgccagcgtgcgccaccctgtgactgtggccagggcccagtgtggaggtggtctacttggggtgagaaccctgtatcgttttgagaaccagacagkcttccctccccctgatagcagatttgatgcctactgctttaaacctaaagaggctacaaccatcgatttgagtatcctcgcagaaactgcatcacccagt

SEQ ID NO: 9523 - DNA, 201 bp, Homo sapiens
tccagatccagatgcaaatggcttggaatcttacacaactctccctgaagctactgaaaagtcacattttttcttagctactgcattagtaactgaatctmtaccagctgaacatgtagtcacagattcaccaatcaaaaaggaagaaagtacaaaacattttccgaaaggcatgagaccaacaattcaagagtcagatac

SEQ ID NO: 9524 - DNA, 201 bp, Homo sapiens
tgatggaactaaggactccaatgtcgaactcttctttgctgcattcctttttcttcacttacaagaaaggcctgaatggaggacttttctgtaaccaggarcattttttaggggtcaaagtgctaataattaactcaaccaggtctactttttaatggctttcataacactaactcataaggttaccgatcaatgcatttc

SEQ ID NO: 9525 - DNA, 201 bp, Homo sapiens
taataattaactcaaccaggtctactttttaatggctttcataacactaactcataaggttaccgatcaatgcatttcatacggatatagacctagggctytggagggtgggggattgttaaaacacatgcaaaaaaaaaaaaaaaaaaaaaagaaattttgtatatataaccattttaatcttttataaagttttgaatg

SEQ ID NO: 9526 - DNA, 201 bp, Homo sapiens
tgcagtacataaatgggaagcatctcgttaccactgtgcccaaggacccagaagctgcagaagctaggcgtggccagtttgaaagtgttgcaccttctcaraatttctcggacagctctgaaagtgatactcatccatttgtaatagccaaaacggaattgtctactgctgtgcaacctaatgaatctacagaaacaactg

SEQ ID NO: 9527 - DNA, 201 bp, Homo sapiens
atacgtgcaagaaaggaacagttgcttgcggccagccccctgttgtagaaaatgccaagacctttggaaagatgaaacctcgttatgaaatcaactccctkattagataccactgcaaagatggtttcattcaacgtcaccttccaactatccggtgcttaggaaatggaagatgggctatacctaaaattacctgcatga

SEQ ID NO: 9528 - DNA, 201 bp, Homo sapiens
agttggaccactcgtatctcaaacagacatctttgaaggtagtgggtcagtaaccagcacaacattaatagaaattttaagtgacactggagcagaaggayccacggtggcacctctccctttctccacggacatcggacatcctcaaaatcagactgtcaggtgggcagaagaaatccagactagtagaccacaaaccat

SEQ ID NO: 9529 - DNA, 201 bp, Homo sapiens
agaagagtagacaaaaaataaaatgcacatagaaaaagagaaaaagggcacaaagggattggcccaatattgattcttttttataaaacctcctttggctwagaaggaatgactctagctacaataatacacagtatgtttaagcaggttcccttggttgttgcattaaatgtaatccacctttaggtattttagagcaca

SEQ ID NO: 9530 - DNA, 201 bp, Homo sapiens
cctgaagagtcttcaggagagattgccattgaccaagaatctcagaaaatagcctttgcaagggctacagaagtaacatttggtgaagaggtagaaaaaartacttctgtcacatacactcccactatagttccaagttctgcatcagcatatgtttcagaggaagaagcagttaccctaataggaaatccttggccagat

SEQ ID NO: 9531 - DNA, 201 bp, Homo sapiens
agagaaaaagggcacaaagggattggcccaatattgattcttttttataaaacctcctttggcttagaaggaatgactctagctacaataatacacagtaygtttaagcaggttcccttggttgttgcattaaatgtaatccacctttaggtattttagagcacagaacaacactgtgttgatctagtaggtttctatttt

SEQ ID NO: 9532 - DNA, 201 bp, Homo sapiens
aaaatttctcggacagctctgaaagtgatactcatccatttgtaatagccaaaacggaattgtctactgctgtgcaacctaatgaatctacagaaacaacygagtctcttgaagttacatggaagcctgagacttaccctgaaacatcagaacatttttcaggtggtgagcctgatgttttccccacagtcccattccatg

SEQ ID NO: 9533 - DNA, 201 bp, Homo sapiens
aagggagagtgtctgtgcccacacatcccgaggctgtgggcgatgcctccctcaccgtggtcaagctgctggcaagtgatgcgggtctttaccgctgtgaygtcatgtacgggattgaagacacacaagacacggtgtcactgactgtggatggggttgtgtttcactacagggcggcaaccagcaggtacacactgaatt

SEQ ID NO: 9534 - DNA, 201 bp, Homo sapiens
ttccctcccgtgggaaatattgtcagttttgaacagaaagccacagtccaacctcaggctatcacagatagtttagccaccaaattacccacacctactgrcagtaccaagaagccctgggatatggatgactactcaccttctgcttcaggacctcttggaaagctagacatatcagaaattaaggaagaagtgctccag

SEQ ID NO: 9535 - DNA, 201 bp, Homo sapiens
tccttgtggcccaaaatggaaatatcaagattggtcaggactacaaagggagagtgtctgtgcccacacatcccgaggctgtgggcgatgcctccctcacygtggtcaagctgctggcaagtgatgcgggtctttaccgctgtgacgtcatgtacgggattgaagacacacaagacacggtgtcactgactgtggatgggg

SEQ ID NO: 9536 - DNA, 201 bp, Homo sapiens; identical to SEQ ID NO: 9493

SEQ ID NO: 9537 - DNA, 201 bp, Homo sapiens; identical to SEQ ID NO: 9494

SEQ ID NO: 9538 - DNA, 201 bp, Homo sapiens; identical to SEQ ID NO: 9495

SEQ ID NO: 9539 - DNA, 201 bp, Homo sapiens; identical to SEQ ID NO: 9496

SEQ ID NO: 9540 - DNA, 201 bp, Homo sapiens; identical to SEQ ID NO: 9497

SEQ ID NO: 9541 - DNA, 201 bp, Homo sapiens; identical to SEQ ID NO: 9498

SEQ ID NO: 9542 - DNA, 201 bp, Homo sapiens; identical to SEQ ID NO: 9499

SEQ ID NO: 9543 - DNA, 201 bp, Homo sapiens; identical to SEQ ID NO: 9500

SEQ ID NO: 9544 - DNA, 201 bp, Homo sapiens; identical to SEQ ID NO: 9501

SEQ ID NO: 9545 - DNA, 201 bp, Homo sapiens; identical to SEQ ID NO: 9502

SEQ ID NO: 9546 - DNA, 201 bp, Homo sapiens
actctagctacaataatacacagtatgtttaagcaggttcccttggttgttgcattaaatgtaatccacctttaggtattttagagcacagaacaacactktgttgatctagtaggtttctatttttcctttctctttacaatgcacataatactttcctgtatttatatcataacgtgtatagtgtaaaatgtgaatgac

SEQ ID NO: 9547 - DNA, 201 bp, Homo sapiens; identical to SEQ ID NO: 9504

SEQ ID NO: 9548 - DNA, 201 bp, Homo sapiens; identical to SEQ ID NO: 9505

SEQ ID NO: 9549 - DNA, 201 bp, Homo sapiens; identical to SEQ ID NO: 9506

SEQ ID NO: 9550 - DNA, 201 bp, Homo sapiens; identical to SEQ ID NO: 9507

SEQ ID NO: 9551 - DNA, 201 bp, Homo sapiens; identical to SEQ ID NO: 9508

SEQ ID NO: 9552 - DNA, 201 bp, Homo sapiens; identical to SEQ ID NO: 9509

SEQ ID NO: 9553 - DNA, 201 bp, Homo sapiens; identical to SEQ ID NO: 9510

SEQ ID NO: 9554 - DNA, 201 bp, Homo sapiens; identical to SEQ ID NO: 9511

SEQ ID NO: 9555 - DNA, 201 bp, Homo sapiens; identical to SEQ ID NO: 9512

SEQ ID NO: 9556 - DNA, 201 bp, Homo sapiens; identical to SEQ ID NO: 9513

SEQ ID NO: 9557 - DNA, 201 bp, Homo sapiens; identical to SEQ ID NO: 9514

SEQ ID NO: 9558 - DNA, 201 bp, Homo sapiens; identical to SEQ ID NO: 9515

SEQ ID NO: 9559 - DNA, 201 bp, Homo sapiens; identical to SEQ ID NO: 9516

SEQ ID NO: 9560 - DNA, 201 bp, Homo sapiens; identical to SEQ ID NO: 9517

SEQ ID NO: 9561 - DNA, 201 bp, Homo sapiens; identical to SEQ ID NO: 9518

SEQ ID NO: 9562 - DNA, 201 bp, Homo sapiens; identical to SEQ ID NO: 9519

SEQ ID NO: 9563 - DNA, 201 bp, Homo sapiens; identical to SEQ ID NO: 9520

SEQ ID NO: 9564 - DNA, 201 bp, Homo sapiens; identical to SEQ ID NO: 9521

SEQ ID NO: 9565 - DNA, 201 bp, Homo sapiens; identical to SEQ ID NO: 9522

SEQ ID NO: 9566 - DNA, 201 bp, Homo sapiens; identical to SEQ ID NO: 9523

SEQ ID NO: 9567 - DNA, 201 bp, Homo sapiens; identical to SEQ ID NO: 9524

SEQ ID NO: 9568 - DNA, 201 bp, Homo sapiens; identical to SEQ ID NO: 9525

SEQ ID NO: 9569 - DNA, 201 bp, Homo sapiens; identical to SEQ ID NO: 9526

SEQ ID NO: 9570 - DNA, 201 bp, Homo sapiens; identical to SEQ ID NO: 9527

SEQ ID NO: 9571 - DNA, 201 bp, Homo sapiens; identical to SEQ ID NO: 9528

SEQ ID NO: 9572 - DNA, 201 bp, Homo sapiens; identical to SEQ ID NO: 9529

SEQ ID NO: 9573 - DNA, 201 bp, Homo sapiens; identical to SEQ ID NO: 9530

SEQ ID NO: 9574 - DNA, 201 bp, Homo sapiens; identical to SEQ ID NO: 9531

SEQ ID NO: 9575 - DNA, 201 bp, Homo sapiens; identical to SEQ ID NO: 9532

SEQ ID NO: 9576 - DNA, 201 bp, Homo sapiens; identical to SEQ ID NO: 9533

SEQ ID NO: 9577 - DNA, 201 bp, Homo sapiens; identical to SEQ ID NO: 9534

SEQ ID NO: 9578 - DNA, 201 bp, Homo sapiens; identical to SEQ ID NO: 9535

SEQ ID NO: 9579 - DNA, 201 bp, Homo sapiens; identical to SEQ ID NO: 9494

SEQ ID NO: 9580 - DNA, 201 bp, Homo sapiens; identical to SEQ ID NO: 9495

SEQ ID NO: 9581 - DNA, 201 bp, Homo sapiens
tcggatgccagcgtgcgccaccctgtgactgtggccagggcccagtgtggaggtggtctacttggggtgagaaccctgtatcgttttgagaaccagacagkcttccctccccctgatagcagatttgatgcctactgctttaaacgacctgatcgctgcaaaatgaacccgtgccttaacggaggcacctgttatcctact

SEQ ID NO: 9582 - DNA, 201 bp, Homo sapiens; identical to SEQ ID NO: 9496

SEQ ID NO: 9583 - DNA, 201 bp, Homo sapiens; identical to SEQ ID NO: 9499

SEQ ID NO: 9584 - DNA, 201 bp, Homo sapiens; identical to SEQ ID NO: 9524

SEQ ID NO: 9585 - DNA, 201 bp, Homo sapiens; identical to SEQ ID NO: 9525

SEQ ID NO: 9586 - DNA, 201 bp, Homo sapiens; identical to SEQ ID NO: 9502

SEQ ID NO: 9587 - DNA, 201 bp, Homo sapiens; identical to SEQ ID NO: 9527

SEQ ID NO: 9588 - DNA, 201 bp, Homo sapiens; identical to SEQ ID NO: 9503

SEQ ID NO: 9589 - DNA, 201 bp, Homo sapiens; identical to SEQ ID NO: 9504

SEQ ID NO: 9590 - DNA, 201 bp, Homo sapiens; identical to SEQ ID NO: 9505

SEQ ID NO: 9591 - DNA, 201 bp, Homo sapiens; identical to SEQ ID NO: 9529

SEQ ID NO: 9592 - DNA, 201 bp, Homo sapiens; identical to SEQ ID NO: 9531

SEQ ID NO: 9593 - DNA, 201 bp, Homo sapiens; identical to SEQ ID NO: 9507

SEQ ID NO: 9594 - DNA, 201 bp, Homo sapiens; identical to SEQ ID NO: 9508

SEQ ID NO: 9595 - DNA, 201 bp, Homo sapiens; identical to SEQ ID NO: 9510

SEQ ID NO: 9596 - DNA, 201 bp, Homo sapiens; identical to SEQ ID NO: 9533

SEQ ID NO: 9597 - DNA, 201 bp, Homo sapiens; identical to SEQ ID NO: 9512

SEQ ID NO: 9598 - DNA, 201 bp, Homo sapiens; identical to SEQ ID NO: 9535

SEQ ID NO: 9599 - DNA, 201 bp, Homo sapiens; identical to SEQ ID NO: 9493

SEQ ID NO: 9600 - DNA, 201 bp, Homo sapiens; identical to SEQ ID NO: 9494

SEQ ID NO: 9601 - DNA, 201 bp, Homo sapiens; identical to SEQ ID NO: 9495

SEQ ID NO: 9602 - DNA, 201 bp, Homo sapiens; identical to SEQ ID NO: 9496

SEQ ID NO: 9603 - DNA, 201 bp, Homo sapiens; identical to SEQ ID NO: 9497

SEQ ID NO: 9604 - DNA, 201 bp, Homo sapiens; identical to SEQ ID NO: 9498

SEQ ID NO: 9605 - DNA, 201 bp, Homo sapiens; identical to SEQ ID NO: 9499

SEQ ID NO: 9606 - DNA, 201 bp, Homo sapiens; identical to SEQ ID NO: 9500

SEQ ID NO: 9607 - DNA, 201 bp, Homo sapiens; identical to SEQ ID NO: 9501

SEQ ID NO: 9608 - DNA, 201 bp, Homo sapiens; identical to SEQ ID NO: 9502

SEQ ID NO: 9609 - DNA, 201 bp, Homo sapiens; identical to SEQ ID NO: 9546

SEQ ID NO: 9610 - DNA, 201 bp, Homo sapiens; identical to SEQ ID NO: 9504

SEQ ID NO: 9611 - DNA, 201 bp, Homo sapiens; identical to SEQ ID NO: 9505

SEQ ID NO: 9612 - DNA, 201 bp, Homo sapiens; identical to SEQ ID NO: 9507

SEQ ID NO: 9613 - DNA, 201 bp, Homo sapiens; identical to SEQ ID NO: 9508

SEQ ID NO: 9614 - DNA, 201 bp, Homo sapiens; identical to SEQ ID NO: 9509

SEQ ID NO: 9615 - DNA, 201 bp, Homo sapiens; identical to SEQ ID NO: 9510

SEQ ID NO: 9616 - DNA, 201 bp, Homo sapiens; identical to SEQ ID NO: 9511

SEQ ID NO: 9617 - DNA, 201 bp, Homo sapiens; identical to SEQ ID NO: 9512

SEQ ID NO: 9618 - DNA, 201 bp, Homo sapiens; identical to SEQ ID NO: 9513

SEQ ID NO: 9619 - DNA, 201 bp, Homo sapiens; identical to SEQ ID NO: 9514

SEQ ID NO: 9620 - DNA, 201 bp, Homo sapiens; identical to SEQ ID NO: 9515

SEQ ID NO: 9621 - DNA, 201 bp, Homo sapiens; identical to SEQ ID NO: 9516

SEQ ID NO: 9622 - DNA, 201 bp, Homo sapiens; identical to SEQ ID NO: 9517

SEQ ID NO: 9623 - DNA, 201 bp, Homo sapiens; identical to SEQ ID NO: 9518

SEQ ID NO: 9624 - DNA, 201 bp, Homo sapiens; identical to SEQ ID NO: 9519

SEQ ID NO: 9625 - DNA, 201 bp, Homo sapiens; identical to SEQ ID NO: 9520

SEQ ID NO: 9626 - DNA, 201 bp, Homo sapiens; identical to SEQ ID NO: 9521

SEQ ID NO: 9627 - DNA, 201 bp, Homo sapiens
tcggatgccagcgtgcgccaccctgtgactgtggccagggcccagtgtggaggtggtctacttggggtgagaaccctgtatcgttttgagaaccagacagkcttccctccccctgatagcagatttgatgcctactgctttaaacgtcgaatgagtgatttgagtgtaattggtcatccaatagattcagaatctaaagaa

SEQ ID NO: 9628 - DNA, 201 bp, Homo sapiens; identical to SEQ ID NO: 9523

SEQ ID NO: 9629 - DNA, 201 bp, Homo sapiens; identical to SEQ ID NO: 9524

SEQ ID NO: 9630 - DNA, 201 bp, Homo sapiens; identical to SEQ ID NO: 9525

SEQ ID NO: 9631 - DNA, 201 bp, Homo sapiens; identical to SEQ ID NO: 9526

SEQ ID NO: 9632 - DNA, 201 bp, Homo sapiens; identical to SEQ ID NO: 9527

SEQ ID NO: 9633 - DNA, 201 bp, Homo sapiens; identical to SEQ ID NO: 9528

SEQ ID NO: 9634 - DNA, 201 bp, Homo sapiens; identical to SEQ ID NO: 9529

SEQ ID NO: 9635 - DNA, 201 bp, Homo sapiens; identical to SEQ ID NO: 9530

SEQ ID NO: 9636 - DNA, 201 bp, Homo sapiens; identical to SEQ ID NO: 9531

SEQ ID NO: 9637 - DNA, 201 bp, Homo sapiens; identical to SEQ ID NO: 9532

SEQ ID NO: 9638 - DNA, 201 bp, Homo sapiens; identical to SEQ ID NO: 9533

SEQ ID NO: 9639 - DNA, 201 bp, Homo sapiens; identical to SEQ ID NO: 9535

SEQ ID NO: 9640 - DNA, 201 bp, Homo sapiens; identical to SEQ ID NO: 9494

SEQ ID NO: 9641 - DNA, 201 bp, Homo sapiens; identical to SEQ ID NO: 9495

SEQ ID NO: 9642 - DNA, 201 bp, Homo sapiens; identical to SEQ ID NO: 9522

SEQ ID NO: 9643 - DNA, 201 bp, Homo sapiens; identical to SEQ ID NO: 9496

SEQ ID NO: 9644 - DNA, 201 bp, Homo sapiens; identical to SEQ ID NO: 9499

SEQ ID NO: 9645 - DNA, 201 bp, Homo sapiens; identical to SEQ ID NO: 9524

SEQ ID NO: 9646 - DNA, 201 bp, Homo sapiens; identical to SEQ ID NO: 9525

SEQ ID NO: 9647 - DNA, 201 bp, Homo sapiens; identical to SEQ ID NO: 9502

SEQ ID NO: 9648 - DNA, 201 bp, Homo sapiens; identical to SEQ ID NO: 9527

SEQ ID NO: 9649 - DNA, 201 bp, Homo sapiens; identical to SEQ ID NO: 9503

SEQ ID NO: 9650 - DNA, 201 bp, Homo sapiens; identical to SEQ ID NO: 9504

SEQ ID NO: 9651 - DNA, 201 bp, Homo sapiens; identical to SEQ ID NO: 9505

SEQ ID NO: 9652 - DNA, 201 bp, Homo sapiens; identical to SEQ ID NO: 9529

SEQ ID NO: 9653 - DNA, 201 bp, Homo sapiens; identical to SEQ ID NO: 9531

SEQ ID NO: 9654 - DNA, 201 bp, Homo sapiens; identical to SEQ ID NO: 9507

SEQ ID NO: 9655 - DNA, 201 bp, Homo sapiens; identical to SEQ ID NO: 9506

SEQ ID NO: 9656 - DNA, 201 bp, Homo sapiens; identical to SEQ ID NO: 9508

SEQ ID NO: 9657 - DNA, 201 bp, Homo sapiens; identical to SEQ ID NO: 9534

SEQ ID NO: 9658 - DNA, 201 bp, Homo sapiens; identical to SEQ ID NO: 9510

SEQ ID NO: 9659 - DNA, 201 bp, Homo sapiens; identical to SEQ ID NO: 9533

SEQ ID NO: 9660 - DNA, 201 bp, Homo sapiens; identical to SEQ ID NO: 9512

SEQ ID NO: 9661 - DNA, 201 bp, Homo sapiens; identical to SEQ ID NO: 9535

SEQ ID NO: 9662 - DNA, 201 bp, Homo sapiens; identical to SEQ ID NO: 9493

SEQ ID NO: 9663 - DNA, 201 bp, Homo sapiens; identical to SEQ ID NO: 9494

SEQ ID NO: 9664 - DNA, 201 bp, Homo sapiens; identical to SEQ ID NO: 9495

SEQ ID NO: 9665 - DNA, 201 bp, Homo sapiens; identical to SEQ ID NO: 9496

SEQ ID NO: 9666 - DNA, 201 bp, Homo sapiens; identical to SEQ ID NO: 9497

SEQ ID NO: 9667 - DNA, 201 bp, Homo sapiens; identical to SEQ ID NO: 9498

SEQ ID NO: 9668 - DNA, 201 bp, Homo sapiens; identical to SEQ ID NO: 9499

SEQ ID NO: 9669 - DNA, 201 bp, Homo sapiens; identical to SEQ ID NO: 9500

SEQ ID NO: 9670 - DNA, 201 bp, Homo sapiens; identical to SEQ ID NO: 9501

SEQ ID NO: 9671 - DNA, 201 bp, Homo sapiens; identical to SEQ ID NO: 9502

SEQ ID NO: 9672 - DNA, 201 bp, Homo sapiens; identical to SEQ ID NO: 9503

SEQ ID NO: 9673 - DNA, 201 bp, Homo sapiens; identical to SEQ ID NO: 9504

SEQ ID NO: 9674 - DNA, 201 bp, Homo sapiens; identical to SEQ ID NO: 9505

SEQ ID NO: 9675 - DNA, 201 bp, Homo sapiens; identical to SEQ ID NO: 9507

SEQ ID NO: 9676 - DNA, 201 bp, Homo sapiens; identical to SEQ ID NO: 9508

SEQ ID NO: 9677 - DNA, 201 bp, Homo sapiens; identical to SEQ ID NO: 9509

SEQ ID NO: 9678 - DNA, 201 bp, Homo sapiens; identical to SEQ ID NO: 9510

SEQ ID NO: 9679 - DNA, 201 bp, Homo sapiens; identical to SEQ ID NO: 9511

SEQ ID NO: 9680 - DNA, 201 bp, Homo sapiens; identical to SEQ ID NO: 9512

SEQ ID NO: 9681 - DNA, 201 bp, Homo sapiens; identical to SEQ ID NO: 9513

SEQ ID NO: 9682 - DNA, 201 bp, Homo sapiens; identical to SEQ ID NO: 9514

SEQ ID NO: 9683 - DNA, 201 bp, Homo sapiens; identical to SEQ ID NO: 9515

SEQ ID NO: 9684 - DNA, 201 bp, Homo sapiens; identical to SEQ ID NO: 9516

SEQ ID NO: 9685 - DNA, 201 bp, Homo sapiens; identical to SEQ ID NO: 9517

SEQ ID NO: 9686 - DNA, 201 bp, Homo sapiens; identical to SEQ ID NO: 9518

SEQ ID NO: 9687 - DNA, 201 bp, Homo sapiens; identical to SEQ ID NO: 9519

SEQ ID NO: 9688 - DNA, 201 bp, Homo sapiens; identical to SEQ ID NO: 9520

SEQ ID NO: 9689 - DNA, 201 bp, Homo sapiens; identical to SEQ ID NO: 9521

SEQ ID NO: 9690 - DNA, 201 bp, Homo sapiens; identical to SEQ ID NO: 9627

SEQ ID NO: 9691 - DNA, 201 bp, Homo sapiens; identical to SEQ ID NO: 9523

SEQ ID NO: 9692 - DNA, 201 bp, Homo sapiens; identical to SEQ ID NO: 9524

SEQ ID NO: 9693 - DNA, 201 bp, Homo sapiens; identical to SEQ ID NO: 9525

SEQ ID NO: 9694 - DNA, 201 bp, Homo sapiens; identical to SEQ ID NO: 9526

SEQ ID NO: 9695 - DNA, 201 bp, Homo sapiens; identical to SEQ ID NO: 9527

SEQ ID NO: 9696 - DNA, 201 bp, Homo sapiens; identical to SEQ ID NO: 9528

SEQ ID NO: 9697 - DNA, 201 bp, Homo sapiens; identical to SEQ ID NO: 9529

SEQ ID NO: 9698 - DNA, 201 bp, Homo sapiens; identical to SEQ ID NO: 9530

SEQ ID NO: 9699 - DNA, 201 bp, Homo sapiens; identical to SEQ ID NO: 9531

SEQ ID NO: 9700 - DNA, 201 bp, Homo sapiens; identical to SEQ ID NO: 9532

SEQ ID NO: 9701 - DNA, 201 bp, Homo sapiens; identical to SEQ ID NO: 9533

SEQ ID NO: 9702 - DNA, 201 bp, Homo sapiens; identical to SEQ ID NO: 9535

SEQ ID NO: 9703 - DNA, 201 bp, Homo sapiens; identical to SEQ ID NO: 9494

SEQ ID NO: 9704 - DNA, 201 bp, Homo sapiens; identical to SEQ ID NO: 9495

SEQ ID NO: 9705 - DNA, 201 bp, Homo sapiens; identical to SEQ ID NO: 9522

SEQ ID NO: 9706 - DNA, 201 bp, Homo sapiens; identical to SEQ ID NO: 9496

SEQ ID NO: 9707 - DNA, 201 bp, Homo sapiens; identical to SEQ ID NO: 9499

SEQ ID NO: 9708 - DNA, 201 bp, Homo sapiens; identical to SEQ ID NO: 9524

SEQ ID NO: 9709 - DNA, 201 bp, Homo sapiens; identical to SEQ ID NO: 9525

SEQ ID NO: 9710 - DNA, 201 bp, Homo sapiens; identical to SEQ ID NO: 9502

SEQ ID NO: 9711 - DNA, 201 bp, Homo sapiens; identical to SEQ ID NO: 9527

SEQ ID NO: 9712 - DNA, 201 bp, Homo sapiens; identical to SEQ ID NO: 9546

SEQ ID NO: 9713 - DNA, 201 bp, Homo sapiens; identical to SEQ ID NO: 9504

SEQ ID NO: 9714 - DNA, 201 bp, Homo sapiens; identical to SEQ ID NO: 9505

SEQ ID NO: 9715 - DNA, 201 bp, Homo sapiens; identical to SEQ ID NO: 9529

SEQ ID NO: 9716 - DNA, 201 bp, Homo sapiens; identical to SEQ ID NO: 9531

SEQ ID NO: 9717 - DNA, 201 bp, Homo sapiens; identical to SEQ ID NO: 9507

SEQ ID NO: 9718 - DNA, 201 bp, Homo sapiens; identical to SEQ ID NO: 9506

SEQ ID NO: 9719 - DNA, 201 bp, Homo sapiens; identical to SEQ ID NO: 9508

SEQ ID NO: 9720 - DNA, 201 bp, Homo sapiens; identical to SEQ ID NO: 9534

SEQ ID NO: 9721 - DNA, 201 bp, Homo sapiens; identical to SEQ ID NO: 9510

SEQ ID NO: 9722 - DNA, 201 bp, Homo sapiens; identical to SEQ ID NO: 9533

SEQ ID NO: 9723 - DNA, 201 bp, Homo sapiens; identical to SEQ ID NO: 9512

SEQ ID NO: 9724 - DNA, 201 bp, Homo sapiens; identical to SEQ ID NO: 9535

SEQ ID NO: 9725 - DNA, 201 bp, Homo sapiens
ccagttggctcttgattcttggtgaaaccatccctcagctcctagagggagattgttagatcatgaaactaattaccatccttttcctctgctccaggctrctactaagtttaacccaggaatcacagtccgaggaaattgactgcaatgacaaggatttatttaaagctgtggatgctgctctgaagaaatataacagtc

SEQ ID NO: 9726 - DNA, 201 bp, Homo sapiens
tgtgtgcatcctatatcaacgcagagcccagacctggagcccattctgagacacggcattcagtactttaacaacaacactcaacattcctccctcttcaygcttaatgaagtaaaacgggcccaaagacaggtggtggctggattgaactttcgaattacctactcaattgtgcaaacgaattgttccaaagagaatttt

SEQ ID NO: 9727 - DNA, 201 bp, Homo sapiens
ttcagtactttaacaacaacactcaacattcctccctcttcacgcttaatgaagtaaaacgggcccaaagacaggtggtggctggattgaactttcgaatkacctactcaattgtgcaaacgaattgttccaaagagaattttctgttcttaactccagactgcaagtccctttggaatggtgataccggtgaatgtacag

SEQ ID NO: 9728 - DNA, 201 bp, Homo sapiens
agtacgaaatcaaggagggggattgtcctgttcaaagtggcaaaacctggcaggactgtgagtacaaggatgctgcaaaagcagccactggagaatgcacrgcaaccgtggggaagaggagcagtacgaaattctccgtggctacccagacctgccagattactccagccgagggccctgtggtgacagcccagtacgact

SEQ ID NO: 9729 - DNA, 201 bp, Homo sapiens
cggcattcagtactttaacaacaacactcaacattcctccctcttcacgcttaatgaagtaaaacgggcccaaagacaggtggtggctggattgaactttygaattacctactcaattgtgcaaacgaattgttccaaagagaattttctgttcttaactccagactgcaagtccctttggaatggtgataccggtgaatg

SEQ ID NO: 9730 - DNA, 201 bp, Homo sapiens; identical to SEQ ID NO: 9725

SEQ ID NO: 9731 - DNA, 201 bp, Homo sapiens; identical to SEQ ID NO: 9726

SEQ ID NO: 9732 - DNA, 143 bp, Homo sapiens
tatttttaaaatcatctctgttaatagaatgtctaccaacttctcactatcagaaaatactcaacctccaaacaatttgaaattatctttctgatccaggyaaagaagcaaattgaaaatcaataaagtaaaaagtgacggag

SEQ ID NO: 9733 - DNA, 201 bp, Homo sapiens; identical to SEQ ID NO: 9729

SEQ ID NO: 9734 - DNA, 201 bp, Homo sapiens
tagtctcactttatagtctttttgctatgactttgaagaccattgatttttgagaagcagaataataggattgcctttcattgccctatagtgcaaagaargtatatgctttataaccaatgttgtacttttgcctagaaaaacaagatatggctttaaatagctacaatcatctttggatgtatatgtcactgctgcttc

SEQ ID NO: 9735 - DNA, 201 bp, Homo sapiens
cttttaaataaacaaccacagatgtcaggaaaaagtcttaccttgtcaactggttgctccactttttaaaaatgattgaatgataacatcatattaactgmgttttactatacttacagagtcacctaaggtcctgcgagtacaagggtcgacccccaaaggcaggggcagagccagcatctgagagggaggtctcttgac

SEQ ID NO: 9736 - DNA, 201 bp, Homo sapiens
agtttgttccgaaattttatgaggaaattactctctagtctcactttatagtctttttgctatgactttgaagaccattgatttttgagaagcagaataayaggattgcctttcattgccctatagtgcaaagaaggtatatgctttataaccaatgttgtacttttgcctagaaaaacaagatatggctttaaatagcta

SEQ ID NO: 9737 - DNA, 201 bp, Homo sapiens; identical to SEQ ID NO: 9727

SEQ ID NO: 9738 - DNA, 201 bp, Homo sapiens
gatgaaaagcagagggagcaatatagaagcaggcttgctaataaaactttttaaataattgacaagggaatattatggaatgtgatgcaaagtttgttccraaattttatgaggaaattactctctagtctcactttatagtctttttgctatgactttgaagaccattgatttttgagaagcagaataataggattgcct

SEQ ID NO: 9739 - DNA, 201 bp, Homo sapiens
taattgactttctattcccaaaatgggctagttatatcaaataaatactcccactgccctttctgagtgagagtgtttctcataagtcaaaaatttctgtytactcattaactactctttgcaacaggctttcatatagaagtattctgtttatttttgctgagcctagattgagtaattcttagtttacagaagctccga

SEQ ID NO: 9740 - DNA, 201 bp, Homo sapiens
ggctatgggtatttctttcatactttattaaagtatcaatatccctctctccattgtccagatgaaaatatcctgatataatgcaccaaaaaccatgcagyttcggaacagtctaaagagaagtggtgagactcccagtggagacaccatcagtctccacggactgcataaaattgtgtgccacaattctaactcttttct

SEQ ID NO: 9741 - DNA, 201 bp, Homo sapiens
atcccttccctagccaagccaggtgtaacagttaccttttctgactttcaggactctgatctcattgcaactatgatgcctcctatatcaccagctcccayacagagtgatgacgattggatccctgatatccagatagacccaaatggcctttcatttaacccaatatcagattttccagacacgacctccccaaaatgt

SEQ ID NO: 9742 - DNA, 201 bp, Homo sapiens; identical to SEQ ID NO: 9728

SEQ ID NO: 9743 - DNA, 201 bp, Homo sapiens; identical to SEQ ID NO: 9725

SEQ ID NO: 9744 - DNA, 201 bp, Homo sapiens; identical to SEQ ID NO: 9726

SEQ ID NO: 9745 - DNA, 143 bp, Homo sapiens; identical to SEQ ID NO: 9732

SEQ ID NO: 9746 - DNA, 201 bp, Homo sapiens; identical to SEQ ID NO: 9727

SEQ ID NO: 9747 - DNA, 201 bp, Homo sapiens; identical to SEQ ID NO: 9728

SEQ ID NO: 9748 - DNA, 201 bp, Homo sapiens; identical to SEQ ID NO: 9729

SEQ ID NO: 9749 - DNA, 201 bp, Homo sapiens
catgccttgcccccaacctttaaatatattcttagacctggtaaatgcactcagacttgcgtctttaggaatttttaactttctttcactacattggcactaaattttttctttataaagctttttgaaggtcataaacaaagaccataattgatgatagacctaatacatttcctctgtgtgtgtgtgtaacattccaaa

SEQ ID NO: 9750 - DNA, 201 bp, Homo sapiens
aagcattaaggacattatgcttcttcgattctgaagacaggtccctgctcatggatgactctggcttccttaggaaaatatttttcttccaaaatcagtakgaaatctaaacttatcccctctttgcagatgtctagcagcttcagacatttggttaagaacccatgggaaaaaaaaaaaatatcagctctgaacgtgtgg

SEQ ID NO: 9751 - DNA, 201 bp, Homo sapiens
aagcttttttctatcacttttgtgttcagaatataacctttgtgtgcgtgtatgttgtgtgtgtgcatgtgtggcgtatatgtgtgttacaggttaatgcyttcttggaattgtgttaatgttctcttggtttattatgccatcagaatggtaaatgagaacactacaactgtagtcagctcacaatttttaaataaagga

SEQ ID NO: 9752 - DNA, 201 bp, Homo sapiens
accctatttctctaagaccattcgcgatttagaagttgtggagggaagtgctgctagatttgactgcaagattgaaggatacccagaccccgaggttgtcyggttcaaagatgaccagtcaatcagggagtcccgccacttccagatagactacgatgaggacgggaactgctctttaattattagtgatgtttgcgggga

SEQ ID NO: 9753 - DNA, 164 bp, Homo sapiens
tgtgcatgtgtggcgtatatgtgtgttacaggttaatgccttcttggaattgtgttaatgttctcttggtttattatgccatcagaatggtaaatgagaamactacaactgtagtcagctcacaatttttaaataaaggataccacagtgcatgctgtttgttc

SEQ ID NO: 9754 - DNA, 201 bp, Homo sapiens
cagatgttcaaactctccatttctctttccccttccacctgccagttttgctgactctcaacttgtcatgagtgtaagcattaaggacattatgcttcttmgattctgaagacaggtccctgctcatggatgactctggcttccttaggaaaatatttttcttccaaaatcagtaggaaatctaaacttatcccctctttg

SEQ ID NO: 9755 - DNA, 201 bp, Homo sapiens
aactgctctttaattattagtgatgtttgcggggatgacgatgccaagtacacctgcaaggctgtcaacagtcttggagaagccacctgcacagcagagcwcattgtggaaacgatggaggaaggtgaaggggaaggggaagaggaagaagagtgaaacaaagccagagaaaagcagtttctaagtcatattaaaaggact

SEQ ID NO: 9756 - DNA, 201 bp, Homo sapiens
actttctttcactacattggcactaaattttttctttataaagctttttgaaggtcataaacaaagaccataattgatgatagacctaatacatttcctckgtgtgtgtgtgtaacattccaaatactttttttttcttttccactgtttgtaaggtgcaacaatttaatatttttaagggactttttaagagttccttaa

SEQ ID NO: 9757 - DNA, 201 bp, Homo sapiens
ctcatgaaaaataaggcctctctctccccaccccctgactctagagaactgggttttctcccagtactccagcaattcatttctgaaagcagttgagccaytttattccaaagtacactgcagatgttcaaactctccatttctctttccccttccacctgccagttttgctgactctcaacttgtcatgagtgtaagcat

SEQ ID NO: 9758 - DNA, 201 bp, Homo sapiens
tgtgtgtgtgtgtaacattccaaatactttttttttcttttccactgtttgtaaggtgcaacaatttaatatttttaagggactttttaagagttccttawgaaccaatttaaaattacttcagtgcaatcctacacagtatcaacattagaattttgatattagtcttatgttatcttccattctatttttatctgcttt

SEQ ID NO: 9759 - DNA, 201 bp, Homo sapiens
cctgcaaggctgtcaacagtcttggagaagccacctgcacagcagagctcattgtggaaacgatggaggaaggtgaaggggaaggggaagaggaagaagaatgaaacaaagccagagaaaagcagtttctaagtcatattaaaaggactatttctctaaaactcaaaaaaaaaaaaaaaactcaagatagtaaaagcacct

SEQ ID NO: 9760 - DNA, 201 bp, Homo sapiens
aagatgtgtcccaagctttccttgaggctgttgctgaggaaaagcctcatgtaaaaccctatttctctaagaccattcgcgatttagaagttgtggagggragtgctgctagatttgactgcaagattgaaggatacccagaccccgaggttgtctggttcaaagatgaccagtcaatcagggagtcccgccacttccaga

SEQ ID NO: 9761 - DNA, 201 bp, Homo sapiens
ttaggaatttttaactttctttcactacattggcactaaattttttctttataaagctttttgaaggtcataaacaaagaccataattgatgatagacctratacatttcctctgtgtgtgtgtgtaacattccaaatactttttttttcttttccactgtttgtaaggtgcaacaatttaatatttttaagggacttttt

SEQ ID NO: 9762 - DNA, 201 bp, Homo sapiens
tgcgaggacctctgtggtggaggagttggtgctgatggtggtggtagtgaccgctatgggtccctgaggcctggctggccagcaagagggcagggttggcyagaggaggaagacggcgaggacgtgcgaggggtgctgaagaggcgcgtggagacgaggcagcacactgaggaggcgatccgccagcaggaggtggagcag

SEQ ID NO: 9763 - DNA, 201 bp, Homo sapiens
aggagatcccagccgagcagatggatttccgtgccaacctgcagcggcaagtgaagccaaagactgtgtctgaggaagagaggaaggtgcacagcccccarcaggtcgattttcgctctgtcctggccaagaaggggacttccaagacccccgtgcctgagaaggtgccaccgccaaaacctgccaccccggattttcgct

SEQ ID NO: 9764 - DNA, 201 bp, Homo sapiens
tgaccgctatgggtccctgaggcctggctggccagcaagagggcagggttggctagaggaggaagacggcgaggacgtgcgaggggtgctgaagaggcgcrtggagacgaggcagcacactgaggaggcgatccgccagcaggaggtggagcagctggacttccgagacctcctggggaagaaggtgagtacaaagaccct

SEQ ID NO: 9765 - DNA, 201 bp, Homo sapiens
cctcctggggaagaaggtgagtacaaagaccctatcggaagacgacctgaaggagatcccagccgagcagatggatttccgtgccaacctgcagcggcaartgaagccaaagactgtgtctgaggaagagaggaaggtgcacagcccccagcaggtcgattttcgctctgtcctggccaagaaggggacttccaagacccc

SEQ ID NO: 9766 - DNA, 201 bp, Homo sapiens
agcagctggacttccgagacctcctggggaagaaggtgagtacaaagaccctatcggaagacgacctgaaggagatcccagccgagcagatggatttccgygccaacctgcagcggcaagtgaagccaaagactgtgtctgaggaagagaggaaggtgcacagcccccagcaggtcgattttcgctctgtcctggccaaga

SEQ ID NO: 9767 - DNA, 201 bp, Homo sapiens
acgtggaaggaactagccacatgccgcagcacctctttcaacgtccaggacctgctgcctgaccacgaatataagttccgtgtacgtgcaatcaacgtgtrtggaaccagtgagccaagccaggagtctgaactcacaacggtaggagagaaacctgaagagccgaaggatgaagtggaggtgtcagatgatgatgagaag

SEQ ID NO: 9768 - DNA, 201 bp, Homo sapiens; identical to SEQ ID NO: 9749

SEQ ID NO: 9769 - DNA, 201 bp, Homo sapiens
aagcattaaggacattatgcttcttcgattctgaagacaggtccctgctcatggatgactctggcttccttaggaaaatatttttcttccaaaatcagtakgaaatctaaacttatcccctctttgcagatgtctagcagcttcagacatttggttaagaacccatgggaaaaaaaaaaatccttgctaatgtggtttcct

SEQ ID NO: 9770 - DNA, 201 bp, Homo sapiens
acagaacagctctgccagagcccttccacgggggagggagcctgccagctgcgaggacctctgtggtggaggagttggtgctgatggtggtggtagtgacygctatgggtccctgaggcctggctggccagcaagagggcagggttggctagaggaggaagacggcgaggacgtgcgaggggtgctgaagaggcgcgtgga

SEQ ID NO: 9771 - DNA, 201 bp, Homo sapiens
cgatccgccagcaggaggtggagcagctggacttccgagacctcctggggaagaaggtgagtacaaagaccctatcggaagacgacctgaaggagatcccrgccgagcagatggatttccgtgccaacctgcagcggcaagtgaagccaaagactgtgtctgaggaagagaggaaggtgcacagcccccagcaggtcgatt

SEQ ID NO: 9772 - DNA, 201 bp, Homo sapiens; identical to SEQ ID NO: 9751

SEQ ID NO: 9773 - DNA, 201 bp, Homo sapiens; identical to SEQ ID NO: 9752

SEQ ID NO: 9774 - DNA, 201 bp, Homo sapiens
tgcgaggggtgctgaagaggcgcgtggagacgaggcagcacactgaggaggcgatccgccagcaggaggtggagcagctggacttccgagacctcctgggsaagaaggtgagtacaaagaccctatcggaagacgacctgaaggagatcccagccgagcagatggatttccgtgccaacctgcagcggcaagtgaagccaa

SEQ ID NO: 9775 - DNA, 171 bp, Homo sapiens
tgtgcatgtgtggcgtatatgtgtgttacaggttaatgccttcttggaattgtgttaatgttctcttggtttattatgccatcagaatggtaaatgagaamactacaactgtagtcagctcacaatttttaaataaaggataccacagtgcatgctgtttgttcaatcttt

SEQ ID NO: 9776 - DNA, 201 bp, Homo sapiens; identical to SEQ ID NO: 9755

SEQ ID NO: 9777 - DNA, 201 bp, Homo sapiens
acggcgaggacgtgcgaggggtgctgaagaggcgcgtggagacgaggcagcacactgaggaggcgatccgccagcaggaggtggagcagctggacttccgmgacctcctggggaagaaggtgagtacaaagaccctatcggaagacgacctgaaggagatcccagccgagcagatggatttccgtgccaacctgcagcggc

SEQ ID NO: 9778 - DNA, 201 bp, Homo sapiens; identical to SEQ ID NO: 9754

SEQ ID NO: 9779 - DNA, 201 bp, Homo sapiens
tcctggggatgggaggcctctctctccccaccccctgactctagagaactgggttttctcccagtactccagcaattcatttctgaaagcagttgagccaytttattccaaagtacactgcagatgttcaaactctccatttctctttccccttccacctgccagttttgctgactctcaacttgtcatgagtgtaagcat

SEQ ID NO: 9780 - DNA, 201 bp, Homo sapiens
ccatcctggccgcgcgccaggagcactgcggctgctacacactgctggtggagaacaagctgggcagcaggcaggcccaggtcaacctcactgtcgtggakaagccagaccccccagctggcacaccttgtgcctctgacattcggagctcctcactgaccctgtcctggtatggctcctcatatgatgggggcagtgctg

SEQ ID NO: 9781 - DNA, 201 bp, Homo sapiens
cctacagcatcgagatctgggactcagccaacaagacgtggaaggaactagccacatgccgcagcacctctttcaacgtccaggacctgctgcctgaccaygaatataagttccgtgtacgtgcaatcaacgtgtatggaaccagtgagccaagccaggagtctgaactcacaacggtaggagagaaacctgaagagccga

SEQ ID NO: 9782 - DNA, 201 bp, Homo sapiens
caatcaacgtgtatggaaccagtgagccaagccaggagtctgaactcacaacggtaggagagaaacctgaagagccgaaggatgaagtggaggtgtcagaygatgatgagaaggagcccgaggttgattaccggacagtgacaatcaatactgaacaaaaagtatctgacttctacgacattgaggagagattaggatctg

SEQ ID NO: 9783 - DNA, 201 bp, Homo sapiens
tcgtgcacctggacctcaagccggagaacatcatgtgtgtcaacaagacgggcaccaggatcaagctcatcgactttggtctggccaggaggctggagaaygcggggtctctgaaggtcctctttggcaccccagaatttgtggctcctgaagtgatcaactatgagcccatcggctacgccacagacatgtggagcatcg

SEQ ID NO: 9784 - DNA, 201 bp, Homo sapiens
agcagaagctgcaagatgttcatgtggcagagggcaagaagctgctgctccagtgccaggtgtcttctgaccccccagccaccatcatctggacgctgaayggaaagaccctcaagaccaccaagttcatcatcctctcccaggaaggctcactctgctccgtctccatcgagaaggcactgcctgaggacagaggcttat

SEQ ID NO: 9785 - DNA, 201 bp, Homo sapiens; identical to SEQ ID NO: 9756

SEQ ID NO: 9786 - DNA, 201 bp, Homo sapiens
gctccgtctccatcgagaaggcactgcctgaggacagaggcttatacaagtgtgtagccaagaatgacgctggccaggcggagtgctcctgccaagtcacygtggatgatgctccagccagtgagaacaccaaggccccagagatgaaatcccggaggcccaagagctctcttcctcccgtgctaggaactgagagtgatg

SEQ ID NO: 9787 - DNA, 201 bp, Homo sapiens; identical to SEQ ID NO: 9758

SEQ ID NO: 9788 - DNA, 201 bp, Homo sapiens
atttttcttccaaaatcagtaggaaatctaaacttatcccctctttgcagatgtctagcagcttcagacatttggttaagaacccatgggaaaaaaaaaaatccttgctaatgtggtttcctttgtaaaccaggattcttatttgtgctgttatagaatatcagctctgaacgtgtggtaaagatttttgtgtttgaatat

SEQ ID NO: 9789 - DNA, 201 bp, Homo sapiens
agcacactgaggaggcgatccgccagcaggaggtggagcagctggacttccgagacctcctggggaagaaggtgagtacaaagaccctatcggaagacgamctgaaggagatcccagccgagcagatggatttccgtgccaacctgcagcggcaagtgaagccaaagactgtgtctgaggaagagaggaaggtgcacagcc

SEQ ID NO: 9790 - DNA, 106 bp, Homo sapiens
ttggtttattatgccatcagaatggtaaatgagaacactacaactgtagtcagctcacaatttttaaataaaggataccacagtgcatgctgtttgttcartcttt

SEQ ID NO: 9791 - DNA, 201 bp, Homo sapiens; identical to SEQ ID NO: 9760

SEQ ID NO: 9792 - DNA, 201 bp, Homo sapiens
agatggatttccgtgccaacctgcagcggcaagtgaagccaaagactgtgtctgaggaagagaggaaggtgcacagcccccagcaggtcgattttcgctcygtcctggccaagaaggggacttccaagacccccgtgcctgagaaggtgccaccgccaaaacctgccaccccggattttcgctcagtgctgggtggcaaga

SEQ ID NO: 9793 - DNA, 201 bp, Homo sapiens; identical to SEQ ID NO: 9761

SEQ ID NO: 9794 - DNA, 201 bp, Homo sapiens
atttccgtgccaacctgcagcggcaagtgaagccaaagactgtgtctgaggaagagaggaaggtgcacagcccccagcaggtcgattttcgctctgtcctrgccaagaaggggacttccaagacccccgtgcctgagaaggtgccaccgccaaaacctgccaccccggattttcgctcagtgctgggtggcaagaagaaat

SEQ ID NO: 9795 - DNA, 201 bp, Homo sapiens
catcaccctgcaggccgcaagagttcagccggaaccaagagcaccaggcctgggggtcctatcaccttctggagaagagaggaagaggccagctcctcccsgtccagccaccttccccaccaggcagcctggcctggggagccaagatgttgtgagcaaggctgctaacaggagaatccccatggagggccagagggattc

SEQ ID NO: 9796 - DNA, 201 bp, Homo sapiens
gaggtggctccccaccctgggctgcaaacagccagcctcagcccccaagggagtccaagctggagtcatgcaaggactcgcccagaacggccccgcagacyccggtccttcagaagacttccagctccatcaccctgcaggccgcaagagttcagccggaaccaagagcaccaggcctgggggtcctatcaccttctggag

SEQ ID NO: 9797 - DNA, 201 bp, Homo sapiens; identical to SEQ ID NO: 9763

SEQ ID NO: 9798 - DNA, 201 bp, Homo sapiens; identical to SEQ ID NO: 9764

SEQ ID NO: 9799 - DNA, 201 bp, Homo sapiens; identical to SEQ ID NO: 9765

SEQ ID NO: 9800 - DNA, 201 bp, Homo sapiens; identical to SEQ ID NO: 9766

SEQ ID NO: 9801 - DNA, 201 bp, Homo sapiens; identical to SEQ ID NO: 9749

SEQ ID NO: 9802 - DNA, 201 bp, Homo sapiens; identical to SEQ ID NO: 9750

SEQ ID NO: 9803 - DNA, 201 bp, Homo sapiens; identical to SEQ ID NO: 9767

SEQ ID NO: 9804 - DNA, 201 bp, Homo sapiens; identical to SEQ ID NO: 9771

SEQ ID NO: 9805 - DNA, 201 bp, Homo sapiens; identical to SEQ ID NO: 9751

SEQ ID NO: 9806 - DNA, 201 bp, Homo sapiens; identical to SEQ ID NO: 9774

SEQ ID NO: 9807 - DNA, 164 bp, Homo sapiens; identical to SEQ ID NO: 9753

SEQ ID NO: 9808 - DNA, 201 bp, Homo sapiens; identical to SEQ ID NO: 9777

SEQ ID NO: 9809 - DNA, 201 bp, Homo sapiens; identical to SEQ ID NO: 9754

SEQ ID NO: 9810 - DNA, 201 bp, Homo sapiens
ggattcagcattccccaaatttgagagcaagccccaaagccaggaggtcaaggaaaatcaaactgtcaagttcagatgtgaagtttccgggattccaaagyctgaagtggcctggttcctggaaggcacccccgtgaggagacaggaaggcagcattgaggtttatgaagatgctggctcccattacctctgcctgctgaa

SEQ ID NO: 9811 - DNA, 201 bp, Homo sapiens
caatcaacgtgtatggaaccagtgagccaagccaggagtctgaactcacaacggtaggagagaaacctgaagagccgaaggatgaagtggaggtgtcagaygatgatgagaaggagcccgaggttgattaccggacagtgacaatcaatactgaacaaaaagtatctgacttctacgacattgaggagagattaggatcct

SEQ ID NO: 9812 - DNA, 201 bp, Homo sapiens; identical to SEQ ID NO: 9783

SEQ ID NO: 9813 - DNA, 201 bp, Homo sapiens
agcagaagctgcaagatgttcatgtggcagagggcaagaagctgctgctccagtgccaggtgtcttctgaccccccagccaccatcatctggacgctgaayggaaagaccctcaagaccaccaagttcatcatcctctcccaggaagtcttcctccccaggctcactctgctccgtctccatcgagaaggcactgcctgag

SEQ ID NO: 9814 - DNA, 201 bp, Homo sapiens; identical to SEQ ID NO: 9758

SEQ ID NO: 9815 - DNA, 201 bp, Homo sapiens; identical to SEQ ID NO: 9789

SEQ ID NO: 9816 - DNA, 201 bp, Homo sapiens
tgctcgccaggtgacagtggagttgacagtagaaggaagttttgcgaagcagcttggtcagcctgttgtttccaaaaccttaggggatagattttcagctycagcagtggagacccgtcctagcatctggggggagtgcccaccaaagtttgctaccaagctgggccgagttgtggtcaaagaaggacagatgggacgatt

SEQ ID NO: 9817 - DNA, 201 bp, Homo sapiens; identical to SEQ ID NO: 9792

SEQ ID NO: 9818 - DNA, 201 bp, Homo sapiens; identical to SEQ ID NO: 9794

SEQ ID NO: 9819 - DNA, 201 bp, Homo sapiens; identical to SEQ ID NO: 9762

SEQ ID NO: 9820 - DNA, 155 bp, Homo sapiens
gtggctcccggctgcctctgctgcagttcagagcaacttcaggagcttcccagcygagagcttcaggacgcctttcctgtcccactggcccagttgccacaacaaacaacagagaagacggtgaccatgggggatgtgaagctggttgcctcgtc

SEQ ID NO: 9821 - DNA, 201 bp, Homo sapiens; identical to SEQ ID NO: 9770

SEQ ID NO: 9822 - DNA, 201 bp, Homo sapiens
gcccagttgccacaacaaacaacagagaagacggtgaccatgggggatgtgaagctggttgcctcgtcacacatttccaaaacctccctcagtgtggatcmctcaagagttgactccatgcccctgacagaggcccctgctttcattttgccccctcggaacctctgcatcaaagaaggagccaccgccaagttcgaaggg

SEQ ID NO: 9823 - DNA, 201 bp, Homo sapiens; identical to SEQ ID NO: 9752

SEQ ID NO: 9824 - DNA, 201 bp, Homo sapiens; identical to SEQ ID NO: 9755

SEQ ID NO: 9825 - DNA, 201 bp, Homo sapiens; identical to SEQ ID NO: 9757

SEQ ID NO: 9826 - DNA, 201 bp, Homo sapiens; identical to SEQ ID NO: 9780

SEQ ID NO: 9827 - DNA, 201 bp, Homo sapiens; identical to SEQ ID NO: 9781

SEQ ID NO: 9828 - DNA, 201 bp, Homo sapiens
gtgggagtgtacacgtgcctggtggtgaacgggtcggggaaggcctcgatgtcagctgaactttccatccaaggtttggacagtgccaataggtcatttgygagagaaacaaaagccaccaattcagatgtcaggaaagaggtgaccaatgtaatctcaaaggagtcgaagctggacagtctggaggctgcagccaaaagc

SEQ ID NO: 9829 - DNA, 201 bp, Homo sapiens; identical to SEQ ID NO: 9756

SEQ ID NO: 9830 - DNA, 201 bp, Homo sapiens; identical to SEQ ID NO: 9786

SEQ ID NO: 9831 - DNA, 201 bp, Homo sapiens
tgaatggaaagaccctcaagaccaccaagttcatcatcctctcccaggaagtcttcctccccaggctcactctgctccgtctccatcgagaaggcactgcatgaggacagaggcttatacaagtgtgtagccaagaatgacgctggccaggcggagtgctcctgccaagtcactgtggatgatgctccagccagtgagaac

SEQ ID NO: 9832 - DNA, 201 bp, Homo sapiens; identical to SEQ ID NO: 9760

SEQ ID NO: 9833 - DNA, 201 bp, Homo sapiens; identical to SEQ ID NO: 9761

SEQ ID NO: 9834 - DNA, 201 bp, Homo sapiens; identical to SEQ ID NO: 9795

SEQ ID NO: 9835 - DNA, 201 bp, Homo sapiens; identical to SEQ ID NO: 9796

SEQ ID NO: 9836 - DNA, 201 bp, Homo sapiens; identical to SEQ ID NO: 9763

SEQ ID NO: 9837 - DNA, 201 bp, Homo sapiens; identical to SEQ ID NO: 9764

SEQ ID NO: 9838 - DNA, 201 bp, Homo sapiens; identical to SEQ ID NO: 9765

SEQ ID NO: 9839 - DNA, 201 bp, Homo sapiens; identical to SEQ ID NO: 9766

SEQ ID NO: 9840 - DNA, 201 bp, Homo sapiens; identical to SEQ ID NO: 9767

SEQ ID NO: 9841 - DNA, 201 bp, Homo sapiens; identical to SEQ ID NO: 9749

SEQ ID NO: 9842 - DNA, 201 bp, Homo sapiens; identical to SEQ ID NO: 9750

SEQ ID NO: 9843 - DNA, 201 bp, Homo sapiens; identical to SEQ ID NO: 9771

SEQ ID NO: 9844 - DNA, 201 bp, Homo sapiens; identical to SEQ ID NO: 9751

SEQ ID NO: 9845 - DNA, 201 bp, Homo sapiens; identical to SEQ ID NO: 9774

SEQ ID NO: 9846 - DNA, 164 bp, Homo sapiens; identical to SEQ ID NO: 9753

SEQ ID NO: 9847 - DNA, 201 bp, Homo sapiens; identical to SEQ ID NO: 9777

SEQ ID NO: 9848 - DNA, 201 bp, Homo sapiens; identical to SEQ ID NO: 9754

SEQ ID NO: 9849 - DNA, 201 bp, Homo sapiens; identical to SEQ ID NO: 9810

SEQ ID NO: 9850 - DNA, 201 bp, Homo sapiens; identical to SEQ ID NO: 9782

SEQ ID NO: 9851 - DNA, 201 bp, Homo sapiens; identical to SEQ ID NO: 9783

SEQ ID NO: 9852 - DNA, 201 bp, Homo sapiens; identical to SEQ ID NO: 9784

SEQ ID NO: 9853 - DNA, 201 bp, Homo sapiens; identical to SEQ ID NO: 9758

SEQ ID NO: 9854 - DNA, 201 bp, Homo sapiens; identical to SEQ ID NO: 9789

SEQ ID NO: 9855 - DNA, 201 bp, Homo sapiens; identical to SEQ ID NO: 9816

SEQ ID NO: 9856 - DNA, 201 bp, Homo sapiens; identical to SEQ ID NO: 9792

SEQ ID NO: 9857 - DNA, 201 bp, Homo sapiens; identical to SEQ ID NO: 9794

SEQ ID NO: 9858 - DNA, 201 bp, Homo sapiens; identical to SEQ ID NO: 9762

SEQ ID NO: 9859 - DNA, 155 bp, Homo sapiens; identical to SEQ ID NO: 9820

SEQ ID NO: 9860 - DNA, 201 bp, Homo sapiens; identical to SEQ ID NO: 9770

SEQ ID NO: 9861 - DNA, 201 bp, Homo sapiens; identical to SEQ ID NO: 9822

SEQ ID NO: 9862 - DNA, 201 bp, Homo sapiens; identical to SEQ ID NO: 9752

SEQ ID NO: 9863 - DNA, 201 bp, Homo sapiens; identical to SEQ ID NO: 9755

SEQ ID NO: 9864 - DNA, 201 bp, Homo sapiens; identical to SEQ ID NO: 9757

SEQ ID NO: 9865 - DNA, 201 bp, Homo sapiens; identical to SEQ ID NO: 9780

SEQ ID NO: 9866 - DNA, 201 bp, Homo sapiens; identical to SEQ ID NO: 9781

SEQ ID NO: 9867 - DNA, 201 bp, Homo sapiens; identical to SEQ ID NO: 9828

SEQ ID NO: 9868 - DNA, 201 bp, Homo sapiens; identical to SEQ ID NO: 9756

SEQ ID NO: 9869 - DNA, 201 bp, Homo sapiens; identical to SEQ ID NO: 9786

SEQ ID NO: 9870 - DNA, 201 bp, Homo sapiens; identical to SEQ ID NO: 9759

SEQ ID NO: 9871 - DNA, 201 bp, Homo sapiens; identical to SEQ ID NO: 9760

SEQ ID NO: 9872 - DNA, 201 bp, Homo sapiens; identical to SEQ ID NO: 9761

SEQ ID NO: 9873 - DNA, 201 bp, Homo sapiens; identical to SEQ ID NO: 9749

SEQ ID NO: 9874 - DNA, 201 bp, Homo sapiens; identical to SEQ ID NO: 9769

SEQ ID NO: 9875 - DNA, 201 bp, Homo sapiens; identical to SEQ ID NO: 9751

SEQ ID NO: 9876 - DNA, 201 bp, Homo sapiens; identical to SEQ ID NO: 9752

SEQ ID NO: 9877 - DNA, 171 bp, Homo sapiens; identical to SEQ ID NO: 9775

SEQ ID NO: 9878 - DNA, 201 bp, Homo sapiens; identical to SEQ ID NO: 9754

SEQ ID NO: 9879 - DNA, 201 bp, Homo sapiens; identical to SEQ ID NO: 9755

SEQ ID NO: 9880 - DNA, 201 bp, Homo sapiens; identical to SEQ ID NO: 9756

SEQ ID NO: 9881 - DNA, 201 bp, Homo sapiens; identical to SEQ ID NO: 9779

SEQ ID NO: 9882 - DNA, 201 bp, Homo sapiens; identical to SEQ ID NO: 9758

SEQ ID NO: 9883 - DNA, 201 bp, Homo sapiens; identical to SEQ ID NO: 9788

SEQ ID NO: 9884 - DNA, 106 bp, Homo sapiens; identical to SEQ ID NO: 9790

SEQ ID NO: 9885 - DNA, 201 bp, Homo sapiens; identical to SEQ ID NO: 9760

SEQ ID NO: 9886 - DNA, 201 bp, Homo sapiens
accttgtttagtcacattaacgcacacatcagttccaggccccattccattctctgaacatcttctgacacactgacagtgctgagcagagcaaggttggkttcgctcctctggcagaacctcggctctcaggaggtccttgttccagggaacagctgcttctctggggctgggctctactccctgcagcccctcgcacta

SEQ ID NO: 9887 - DNA, 201 bp, Homo sapiens; identical to SEQ ID NO: 9761

SEQ ID NO: 9888 - DNA, 201 bp, Homo sapiens; identical to SEQ ID NO: 9795

SEQ ID NO: 9889 - DNA, 201 bp, Homo sapiens; identical to SEQ ID NO: 9796

SEQ ID NO: 9890 - DNA, 201 bp, Homo sapiens; identical to SEQ ID NO: 9762

SEQ ID NO: 9891 - DNA, 201 bp, Homo sapiens; identical to SEQ ID NO: 9763

SEQ ID NO: 9892 - DNA, 201 bp, Homo sapiens; identical to SEQ ID NO: 9764

SEQ ID NO: 9893 - DNA, 155 bp, Homo sapiens; identical to SEQ ID NO: 9820

SEQ ID NO: 9894 - DNA, 201 bp, Homo sapiens; identical to SEQ ID NO: 9765

SEQ ID NO: 9895 - DNA, 201 bp, Homo sapiens; identical to SEQ ID NO: 9766

SEQ ID NO: 9896 - DNA, 201 bp, Homo sapiens; identical to SEQ ID NO: 9767

SEQ ID NO: 9897 - DNA, 201 bp, Homo sapiens; identical to SEQ ID NO: 9771

SEQ ID NO: 9898 - DNA, 201 bp, Homo sapiens; identical to SEQ ID NO: 9770

SEQ ID NO: 9899 - DNA, 201 bp, Homo sapiens; identical to SEQ ID NO: 9822

SEQ ID NO: 9900 - DNA, 201 bp, Homo sapiens; identical to SEQ ID NO: 9774

SEQ ID NO: 9901 - DNA, 201 bp, Homo sapiens; identical to SEQ ID NO: 9777

SEQ ID NO: 9902 - DNA, 201 bp, Homo sapiens; identical to SEQ ID NO: 9810

SEQ ID NO: 9903 - DNA, 201 bp, Homo sapiens; identical to SEQ ID NO: 9780

SEQ ID NO: 9904 - DNA, 201 bp, Homo sapiens; identical to SEQ ID NO: 9781

SEQ ID NO: 9905 - DNA, 201 bp, Homo sapiens; identical to SEQ ID NO: 9811

SEQ ID NO: 9906 - DNA, 201 bp, Homo sapiens; identical to SEQ ID NO: 9828

SEQ ID NO: 9907 - DNA, 201 bp, Homo sapiens; identical to SEQ ID NO: 9783

SEQ ID NO: 9908 - DNA, 201 bp, Homo sapiens; identical to SEQ ID NO: 9784

SEQ ID NO: 9909 - DNA, 201 bp, Homo sapiens; identical to SEQ ID NO: 9786

SEQ ID NO: 9910 - DNA, 201 bp, Homo sapiens; identical to SEQ ID NO: 9789

SEQ ID NO: 9911 - DNA, 201 bp, Homo sapiens; identical to SEQ ID NO: 9816

SEQ ID NO: 9912 - DNA, 201 bp, Homo sapiens; identical to SEQ ID NO: 9792

SEQ ID NO: 9913 - DNA, 201 bp, Homo sapiens; identical to SEQ ID NO: 9794

SEQ ID NO: 9914 - DNA, 162 bp, Homo sapiens
atgggggatgtgaagctggttgcctcgtcacacatttccaaaacctccctcagtgtggatcmctcaagagttgactccatgcccctgacagaggcccctgctttcattttgccccctcggaacctctgcatcaaagaaggagccaccgccaagttcgaaggg

SEQ ID NO: 9915 - DNA, 201 bp, Homo sapiens; identical to SEQ ID NO: 9795

SEQ ID NO: 9916 - DNA, 201 bp, Homo sapiens; identical to SEQ ID NO: 9796

SEQ ID NO: 9917 - DNA, 201 bp, Homo sapiens; identical to SEQ ID NO: 9763

SEQ ID NO: 9918 - DNA, 201 bp, Homo sapiens; identical to SEQ ID NO: 9764

SEQ ID NO: 9919 - DNA, 201 bp, Homo sapiens; identical to SEQ ID NO: 9765

SEQ ID NO: 9920 - DNA, 201 bp, Homo sapiens; identical to SEQ ID NO: 9767

SEQ ID NO: 9921 - DNA, 201 bp, Homo sapiens; identical to SEQ ID NO: 9766

SEQ ID NO: 9922 - DNA, 201 bp, Homo sapiens; identical to SEQ ID NO: 9749

SEQ ID NO: 9923 - DNA, 201 bp, Homo sapiens; identical to SEQ ID NO: 9769

SEQ ID NO: 9924 - DNA, 201 bp, Homo sapiens; identical to SEQ ID NO: 9771

SEQ ID NO: 9925 - DNA, 201 bp, Homo sapiens; identical to SEQ ID NO: 9751

SEQ ID NO: 9926 - DNA, 201 bp, Homo sapiens; identical to SEQ ID NO: 9774

SEQ ID NO: 9927 - DNA, 171 bp, Homo sapiens; identical to SEQ ID NO: 9775

SEQ ID NO: 9928 - DNA, 201 bp, Homo sapiens; identical to SEQ ID NO: 9777

SEQ ID NO: 9929 - DNA, 201 bp, Homo sapiens; identical to SEQ ID NO: 9754

SEQ ID NO: 9930 - DNA, 201 bp, Homo sapiens; identical to SEQ ID NO: 9810

SEQ ID NO: 9931 - DNA, 201 bp, Homo sapiens; identical to SEQ ID NO: 9782

SEQ ID NO: 9932 - DNA, 201 bp, Homo sapiens; identical to SEQ ID NO: 9783

SEQ ID NO: 9933 - DNA, 201 bp, Homo sapiens; identical to SEQ ID NO: 9813

SEQ ID NO: 9934 - DNA, 201 bp, Homo sapiens; identical to SEQ ID NO: 9758

SEQ ID NO: 9935 - DNA, 201 bp, Homo sapiens; identical to SEQ ID NO: 9789

SEQ ID NO: 9936 - DNA, 201 bp, Homo sapiens; identical to SEQ ID NO: 9816

SEQ ID NO: 9937 - DNA, 201 bp, Homo sapiens; identical to SEQ ID NO: 9792

SEQ ID NO: 9938 - DNA, 201 bp, Homo sapiens; identical to SEQ ID NO: 9794

SEQ ID NO: 9939 - DNA, 201 bp, Homo sapiens; identical to SEQ ID NO: 9762

SEQ ID NO: 9940 - DNA, 155 bp, Homo sapiens; identical to SEQ ID NO: 9820

SEQ ID NO: 9941 - DNA, 201 bp, Homo sapiens; identical to SEQ ID NO: 9770

SEQ ID NO: 9942 - DNA, 201 bp, Homo sapiens; identical to SEQ ID NO: 9822

SEQ ID NO: 9943 - DNA, 201 bp, Homo sapiens; identical to SEQ ID NO: 9752

SEQ ID NO: 9944 - DNA, 201 bp, Homo sapiens; identical to SEQ ID NO: 9755

SEQ ID NO: 9945 - DNA, 201 bp, Homo sapiens; identical to SEQ ID NO: 9779

SEQ ID NO: 9946 - DNA, 201 bp, Homo sapiens; identical to SEQ ID NO: 9780

SEQ ID NO: 9947 - DNA, 201 bp, Homo sapiens; identical to SEQ ID NO: 9781

SEQ ID NO: 9948 - DNA, 201 bp, Homo sapiens
tgggagtgtacacgtgcctggtggtgaacgggtcggggaaggcctcgatgtcagctgaactttccatccaaggtatcgaccacaccacacaggtcatttgygagagaaacaaaagccaccaattcagatgtcaggaaagaggtgaccaatgtaatctcaaaggagtcgaagctggacagtctggaggctgcagccaaaagc

SEQ ID NO: 9949 - DNA, 201 bp, Homo sapiens; identical to SEQ ID NO: 9756

SEQ ID NO: 9950 - DNA, 201 bp, Homo sapiens; identical to SEQ ID NO: 9786

SEQ ID NO: 9951 - DNA, 201 bp, Homo sapiens; identical to SEQ ID NO: 9788

SEQ ID NO: 9952 - DNA, 106 bp, Homo sapiens; identical to SEQ ID NO: 9790

SEQ ID NO: 9953 - DNA, 201 bp, Homo sapiens; identical to SEQ ID NO: 9760

SEQ ID NO: 9954 - DNA, 201 bp, Homo sapiens; identical to SEQ ID NO: 9761

SEQ ID NO: 9955 - DNA, 201 bp, Homo sapiens; identical to SEQ ID NO: 9795

SEQ ID NO: 9956 - DNA, 201 bp, Homo sapiens; identical to SEQ ID NO: 9796

SEQ ID NO: 9957 - DNA, 201 bp, Homo sapiens; identical to SEQ ID NO: 9763

SEQ ID NO: 9958 - DNA, 201 bp, Homo sapiens; identical to SEQ ID NO: 9764

SEQ ID NO: 9959 - DNA, 201 bp, Homo sapiens; identical to SEQ ID NO: 9765

SEQ ID NO: 9960 - DNA, 201 bp, Homo sapiens; identical to SEQ ID NO: 9766

SEQ ID NO: 9961 - DNA, 201 bp, Homo sapiens; identical to SEQ ID NO: 9767

SEQ ID NO: 9962 - DNA, 201 bp, Homo sapiens; identical to SEQ ID NO: 9749

SEQ ID NO: 9963 - DNA, 201 bp, Homo sapiens; identical to SEQ ID NO: 9750

SEQ ID NO: 9964 - DNA, 201 bp, Homo sapiens; identical to SEQ ID NO: 9771

SEQ ID NO: 9965 - DNA, 201 bp, Homo sapiens; identical to SEQ ID NO: 9751

SEQ ID NO: 9966 - DNA, 201 bp, Homo sapiens; identical to SEQ ID NO: 9774

SEQ ID NO: 9967 - DNA, 164 bp, Homo sapiens; identical to SEQ ID NO: 9753

SEQ ID NO: 9968 - DNA, 201 bp, Homo sapiens; identical to SEQ ID NO: 9777

SEQ ID NO: 9969 - DNA, 201 bp, Homo sapiens; identical to SEQ ID NO: 9754

SEQ ID NO: 9970 - DNA, 201 bp, Homo sapiens; identical to SEQ ID NO: 9810

SEQ ID NO: 9971 - DNA, 201 bp, Homo sapiens; identical to SEQ ID NO: 9811

SEQ ID NO: 9972 - DNA, 201 bp, Homo sapiens; identical to SEQ ID NO: 9783

SEQ ID NO: 9973 - DNA, 201 bp, Homo sapiens; identical to SEQ ID NO: 9784

SEQ ID NO: 9974 - DNA, 201 bp, Homo sapiens; identical to SEQ ID NO: 9758

SEQ ID NO: 9975 - DNA, 201 bp, Homo sapiens; identical to SEQ ID NO: 9789

SEQ ID NO: 9976 - DNA, 201 bp, Homo sapiens; identical to SEQ ID NO: 9816

SEQ ID NO: 9977 - DNA, 201 bp, Homo sapiens; identical to SEQ ID NO: 9792

SEQ ID NO: 9978 - DNA, 201 bp, Homo sapiens; identical to SEQ ID NO: 9794

SEQ ID NO: 9979 - DNA, 201 bp, Homo sapiens; identical to SEQ ID NO: 9762

SEQ ID NO: 9980 - DNA, 155 bp, Homo sapiens; identical to SEQ ID NO: 9820

SEQ ID NO: 9981 - DNA, 201 bp, Homo sapiens; identical to SEQ ID NO: 9770

SEQ ID NO: 9982 - DNA, 201 bp, Homo sapiens; identical to SEQ ID NO: 9822

SEQ ID NO: 9983 - DNA, 201 bp, Homo sapiens; identical to SEQ ID NO: 9752

SEQ ID NO: 9984 - DNA, 201 bp, Homo sapiens; identical to SEQ ID NO: 9755

SEQ ID NO: 9985 - DNA, 201 bp, Homo sapiens; identical to SEQ ID NO: 9757

SEQ ID NO: 9986 - DNA, 201 bp, Homo sapiens; identical to SEQ ID NO: 9780

SEQ ID NO: 9987 - DNA, 201 bp, Homo sapiens; identical to SEQ ID NO: 9781

SEQ ID NO: 9988 - DNA, 201 bp, Homo sapiens; identical to SEQ ID NO: 9948

SEQ ID NO: 9989 - DNA, 201 bp, Homo sapiens; identical to SEQ ID NO: 9756

SEQ ID NO: 9990 - DNA, 201 bp, Homo sapiens; identical to SEQ ID NO: 9786

SEQ ID NO: 9991 - DNA, 201 bp, Homo sapiens
ggacagtgacaatcaatactgaacaaaaagtatctgacttctacgacattgaggagagattaggatcctgtttgagcgcatcattgacgaggactttgagatgacggagcgtgagtgcatcaagtacatgcggcagatctcggagggagtggagtacatccacaagcagggcatcgtgcacctggacctcaagccggagaa

SEQ ID NO: 9992 - DNA, 201 bp, Homo sapiens; identical to SEQ ID NO: 9760

SEQ ID NO: 9993 - DNA, 201 bp, Homo sapiens; identical to SEQ ID NO: 9761

SEQ ID NO: 9994 - DNA, 201 bp, Homo sapiens; identical to SEQ ID NO: 9763

SEQ ID NO: 9995 - DNA, 201 bp, Homo sapiens; identical to SEQ ID NO: 9764

SEQ ID NO: 9996 - DNA, 201 bp, Homo sapiens; identical to SEQ ID NO: 9765

SEQ ID NO: 9997 - DNA, 201 bp, Homo sapiens; identical to SEQ ID NO: 9766

SEQ ID NO: 9998 - DNA, 201 bp, Homo sapiens; identical to SEQ ID NO: 9767

SEQ ID NO: 9999 - DNA, 201 bp, Homo sapiens; identical to SEQ ID NO: 9749

SEQ ID NO: 10000 - DNA, 201 bp, Homo sapiens; identical to SEQ ID NO: 9769

SEQ ID NO: 10001 - DNA, 201 bp, Homo sapiens; identical to SEQ ID NO: 9771

SEQ ID NO: 10002 - DNA, 201 bp, Homo sapiens; identical to SEQ ID NO: 9751

SEQ ID NO: 10003 - DNA, 201 bp, Homo sapiens; identical to SEQ ID NO: 9774

SEQ ID NO: 10004 - DNA, 171 bp, Homo sapiens; identical to SEQ ID NO: 9775

SEQ ID NO: 10005 - DNA, 201 bp, Homo sapiens; identical to SEQ ID NO: 9777

SEQ ID NO: 10006 - DNA, 201 bp, Homo sapiens; identical to SEQ ID NO: 9754

SEQ ID NO: 10007 - DNA, 201 bp, Homo sapiens; identical to SEQ ID NO: 9782

SEQ ID NO: 10008 - DNA, 201 bp, Homo sapiens; identical to SEQ ID NO: 9783

SEQ ID NO: 10009 - DNA, 201 bp, Homo sapiens; identical to SEQ ID NO: 9784

SEQ ID NO: 10010 - DNA, 201 bp, Homo sapiens; identical to SEQ ID NO: 9758

SEQ ID NO: 10011 - DNA, 201 bp, Homo sapiens; identical to SEQ ID NO: 9789

SEQ ID NO: 10012 - DNA, 201 bp, Homo sapiens; identical to SEQ ID NO: 9792

SEQ ID NO: 10013 - DNA, 201 bp, Homo sapiens; identical to SEQ ID NO: 9794

SEQ ID NO: 10014 - DNA, 201 bp, Homo sapiens; identical to SEQ ID NO: 9762

SEQ ID NO: 10015 - DNA, 155 bp, Homo sapiens; identical to SEQ ID NO: 9820

SEQ ID NO: 10016 - DNA, 201 bp, Homo sapiens; identical to SEQ ID NO: 9770

SEQ ID NO: 10017 - DNA, 201 bp, Homo sapiens; identical to SEQ ID NO: 9822

SEQ ID NO: 10018 - DNA, 201 bp, Homo sapiens; identical to SEQ ID NO: 9752

SEQ ID NO: 10019 - DNA, 201 bp, Homo sapiens; identical to SEQ ID NO: 9755

SEQ ID NO: 10020 - DNA, 201 bp, Homo sapiens; identical to SEQ ID NO: 9779

SEQ ID NO: 10021 - DNA, 201 bp, Homo sapiens; identical to SEQ ID NO: 9780

SEQ ID NO: 10022 - DNA, 201 bp, Homo sapiens; identical to SEQ ID NO: 9781

SEQ ID NO: 10023 - DNA, 201 bp, Homo sapiens; identical to SEQ ID NO: 9786

SEQ ID NO: 10024 - DNA, 201 bp, Homo sapiens; identical to SEQ ID NO: 9756

SEQ ID NO: 10025 - DNA, 201 bp, Homo sapiens; identical to SEQ ID NO: 9788

SEQ ID NO: 10026 - DNA, 106 bp, Homo sapiens; identical to SEQ ID NO: 9790

SEQ ID NO: 10027 - DNA, 201 bp, Homo sapiens; identical to SEQ ID NO: 9760

SEQ ID NO: 10028 - DNA, 201 bp, Homo sapiens; identical to SEQ ID NO: 9761

SEQ ID NO: 10029 - DNA, 201 bp, Homo sapiens; identical to SEQ ID NO: 9795

SEQ ID NO: 10030 - DNA, 201 bp, Homo sapiens; identical to SEQ ID NO: 9796

SEQ ID NO: 10031 - DNA, 201 bp, Homo sapiens; identical to SEQ ID NO: 9762

SEQ ID NO: 10032 - DNA, 201 bp, Homo sapiens; identical to SEQ ID NO: 9763

SEQ ID NO: 10033 - DNA, 201 bp, Homo sapiens; identical to SEQ ID NO: 9764

SEQ ID NO: 10034 - DNA, 155 bp, Homo sapiens; identical to SEQ ID NO: 9820

SEQ ID NO: 10035 - DNA, 201 bp, Homo sapiens; identical to SEQ ID NO: 9765

SEQ ID NO: 10036 - DNA, 201 bp, Homo sapiens; identical to SEQ ID NO: 9766

SEQ ID NO: 10037 - DNA, 201 bp, Homo sapiens; identical to SEQ ID NO: 9767

SEQ ID NO: 10038 - DNA, 201 bp, Homo sapiens; identical to SEQ ID NO: 9771

SEQ ID NO: 10039 - DNA, 201 bp, Homo sapiens; identical to SEQ ID NO: 9770

SEQ ID NO: 10040 - DNA, 201 bp, Homo sapiens; identical to SEQ ID NO: 9822

SEQ ID NO: 10041 - DNA, 201 bp, Homo sapiens; identical to SEQ ID NO: 9774

SEQ ID NO: 10042 - DNA, 201 bp, Homo sapiens; identical to SEQ ID NO: 9777

SEQ ID NO: 10043 - DNA, 201 bp, Homo sapiens; identical to SEQ ID NO: 9810

SEQ ID NO: 10044 - DNA, 201 bp, Homo sapiens; identical to SEQ ID NO: 9780

SEQ ID NO: 10045 - DNA, 201 bp, Homo sapiens; identical to SEQ ID NO: 9781

SEQ ID NO: 10046 - DNA, 201 bp, Homo sapiens; identical to SEQ ID NO: 9782

SEQ ID NO: 10047 - DNA, 201 bp, Homo sapiens; identical to SEQ ID NO: 9828

SEQ ID NO: 10048 - DNA, 201 bp, Homo sapiens; identical to SEQ ID NO: 9783

SEQ ID NO: 10049 - DNA, 201 bp, Homo sapiens; identical to SEQ ID NO: 9784

SEQ ID NO: 10050 - DNA, 201 bp, Homo sapiens; identical to SEQ ID NO: 9786

SEQ ID NO: 10051 - DNA, 201 bp, Homo sapiens; identical to SEQ ID NO: 9789

SEQ ID NO: 10052 - DNA, 201 bp, Homo sapiens; identical to SEQ ID NO: 9816

SEQ ID NO: 10053 - DNA, 201 bp, Homo sapiens; identical to SEQ ID NO: 9792

SEQ ID NO: 10054 - DNA, 201 bp, Homo sapiens; identical to SEQ ID NO: 9794

SEQ ID NO: 10055 - DNA, 201 bp, Homo sapiens; identical to SEQ ID NO: 9795

SEQ ID NO: 10056 - DNA, 201 bp, Homo sapiens; identical to SEQ ID NO: 9796

SEQ ID NO: 10057 - DNA, 201 bp, Homo sapiens; identical to SEQ ID NO: 9763

SEQ ID NO: 10058 - DNA, 201 bp, Homo sapiens; identical to SEQ ID NO: 9764

SEQ ID NO: 10059 - DNA, 201 bp, Homo sapiens; identical to SEQ ID NO: 9765

SEQ ID NO: 10060 - DNA, 201 bp, Homo sapiens; identical to SEQ ID NO: 9766

SEQ ID NO: 10061 - DNA, 201 bp, Homo sapiens; identical to SEQ ID NO: 9767

SEQ ID NO: 10062 - DNA, 201 bp, Homo sapiens; identical to SEQ ID NO: 9749

SEQ ID NO: 10063 - DNA, 201 bp, Homo sapiens; identical to SEQ ID NO: 9750

SEQ ID NO: 10064 - DNA, 201 bp, Homo sapiens; identical to SEQ ID NO: 9771

SEQ ID NO: 10065 - DNA, 201 bp, Homo sapiens; identical to SEQ ID NO: 9751

SEQ ID NO: 10066 - DNA, 201 bp, Homo sapiens; identical to SEQ ID NO: 9774

SEQ ID NO: 10067 - DNA, 164 bp, Homo sapiens; identical to SEQ ID NO: 9753

SEQ ID NO: 10068 - DNA, 201 bp, Homo sapiens; identical to SEQ ID NO: 9777

SEQ ID NO: 10069 - DNA, 201 bp, Homo sapiens; identical to SEQ ID NO: 9754

SEQ ID NO: 10070 - DNA, 201 bp, Homo sapiens; identical to SEQ ID NO: 9782

SEQ ID NO: 10071 - DNA, 201 bp, Homo sapiens; identical to SEQ ID NO: 9783

SEQ ID NO: 10072 - DNA, 201 bp, Homo sapiens; identical to SEQ ID NO: 9784

SEQ ID NO: 10073 - DNA, 201 bp, Homo sapiens; identical to SEQ ID NO: 9758

SEQ ID NO: 10074 - DNA, 201 bp, Homo sapiens; identical to SEQ ID NO: 9789

SEQ ID NO: 10075 - DNA, 201 bp, Homo sapiens; identical to SEQ ID NO: 9816

SEQ ID NO: 10076 - DNA, 201 bp, Homo sapiens; identical to SEQ ID NO: 9792

SEQ ID NO: 10077 - DNA, 201 bp, Homo sapiens; identical to SEQ ID NO: 9794

SEQ ID NO: 10078 - DNA, 201 bp, Homo sapiens; identical to SEQ ID NO: 9762

SEQ ID NO: 10079 - DNA, 155 bp, Homo sapiens; identical to SEQ ID NO: 9820

SEQ ID NO: 10080 - DNA, 201 bp, Homo sapiens; identical to SEQ ID NO: 9770

SEQ ID NO: 10081 - DNA, 201 bp, Homo sapiens; identical to SEQ ID NO: 9822

SEQ ID NO: 10082 - DNA, 201 bp, Homo sapiens; identical to SEQ ID NO: 9752

SEQ ID NO: 10083 - DNA, 201 bp, Homo sapiens; identical to SEQ ID NO: 9755

SEQ ID NO: 10084 - DNA, 201 bp, Homo sapiens; identical to SEQ ID NO: 9757

SEQ ID NO: 10085 - DNA, 201 bp, Homo sapiens; identical to SEQ ID NO: 9780

SEQ ID NO: 10086 - DNA, 201 bp, Homo sapiens; identical to SEQ ID NO: 9781

SEQ ID NO: 10087 - DNA, 201 bp, Homo sapiens; identical to SEQ ID NO: 9828

SEQ ID NO: 10088 - DNA, 201 bp, Homo sapiens; identical to SEQ ID NO: 9756

SEQ ID NO: 10089 - DNA, 201 bp, Homo sapiens; identical to SEQ ID NO: 9786

SEQ ID NO: 10090 - DNA, 201 bp, Homo sapiens; identical to SEQ ID NO: 9759

SEQ ID NO: 10091 - DNA, 201 bp, Homo sapiens; identical to SEQ ID NO: 9760

SEQ ID NO: 10092 - DNA, 201 bp, Homo sapiens; identical to SEQ ID NO: 9761

SEQ ID NO: 10093 - DNA, 201 bp, Homo sapiens; identical to SEQ ID NO: 9795

SEQ ID NO: 10094 - DNA, 201 bp, Homo sapiens; identical to SEQ ID NO: 9796

SEQ ID NO: 10095 - DNA, 201 bp, Homo sapiens; identical to SEQ ID NO: 9763

SEQ ID NO: 10096 - DNA, 201 bp, Homo sapiens; identical to SEQ ID NO: 9764

SEQ ID NO: 10097 - DNA, 201 bp, Homo sapiens; identical to SEQ ID NO: 9765

SEQ ID NO: 10098 - DNA, 201 bp, Homo sapiens; identical to SEQ ID NO: 9766

SEQ ID NO: 10099 - DNA, 201 bp, Homo sapiens; identical to SEQ ID NO: 9767

SEQ ID NO: 10100 - DNA, 201 bp, Homo sapiens; identical to SEQ ID NO: 9749

SEQ ID NO: 10101 - DNA, 201 bp, Homo sapiens; identical to SEQ ID NO: 9750

SEQ ID NO: 10102 - DNA, 201 bp, Homo sapiens; identical to SEQ ID NO: 9771

SEQ ID NO: 10103 - DNA, 201 bp, Homo sapiens; identical to SEQ ID NO: 9751

SEQ ID NO: 10104 - DNA, 201 bp, Homo sapiens; identical to SEQ ID NO: 9774

SEQ ID NO: 10105 - DNA, 164 bp, Homo sapiens; identical to SEQ ID NO: 9753

SEQ ID NO: 10106 - DNA, 201 bp, Homo sapiens; identical to SEQ ID NO: 9777

SEQ ID NO: 10107 - DNA, 201 bp, Homo sapiens; identical to SEQ ID NO: 9754

SEQ ID NO: 10108 - DNA, 201 bp, Homo sapiens; identical to SEQ ID NO: 9810

SEQ ID NO: 10109 - DNA, 201 bp, Homo sapiens
caatcaacgtgtatggaaccagtgagccaagccaggagtctgaactcacaacggtaggagagaaacctgaagagccgaaggatgaagtggaggtgtcagaygatgatgagaaggagcccgaggttgattaccggacagtgacaatcaatactgaacaaaaagtatctgacttctacgacattgaggagagattaggatccg

SEQ ID NO: 10110 - DNA, 201 bp, Homo sapiens; identical to SEQ ID NO: 9783

SEQ ID NO: 10111 - DNA, 201 bp, Homo sapiens; identical to SEQ ID NO: 9784

SEQ ID NO: 10112 - DNA, 201 bp, Homo sapiens; identical to SEQ ID NO: 9758

SEQ ID NO: 10113 - DNA, 201 bp, Homo sapiens; identical to SEQ ID NO: 9789

SEQ ID NO: 10114 - DNA, 201 bp, Homo sapiens; identical to SEQ ID NO: 9816

SEQ ID NO: 10115 - DNA, 201 bp, Homo sapiens; identical to SEQ ID NO: 9792

SEQ ID NO: 10116 - DNA, 201 bp, Homo sapiens; identical to SEQ ID NO: 9794

SEQ ID NO: 10117 - DNA, 201 bp, Homo sapiens; identical to SEQ ID NO: 9762

SEQ ID NO: 10118 - DNA, 155 bp, Homo sapiens; identical to SEQ ID NO: 9820

SEQ ID NO: 10119 - DNA, 201 bp, Homo sapiens; identical to SEQ ID NO: 9770

SEQ ID NO: 10120 - DNA, 201 bp, Homo sapiens; identical to SEQ ID NO: 9822

SEQ ID NO: 10121 - DNA, 201 bp, Homo sapiens; identical to SEQ ID NO: 9752

SEQ ID NO: 10122 - DNA, 201 bp, Homo sapiens; identical to SEQ ID NO: 9755

SEQ ID NO: 10123 - DNA, 201 bp, Homo sapiens; identical to SEQ ID NO: 9757

SEQ ID NO: 10124 - DNA, 201 bp, Homo sapiens; identical to SEQ ID NO: 9780

SEQ ID NO: 10125 - DNA, 201 bp, Homo sapiens; identical to SEQ ID NO: 9781

SEQ ID NO: 10126 - DNA, 201 bp, Homo sapiens; identical to SEQ ID NO: 9828

SEQ ID NO: 10127 - DNA, 201 bp, Homo sapiens; identical to SEQ ID NO: 9756

SEQ ID NO: 10128 - DNA, 201 bp, Homo sapiens; identical to SEQ ID NO: 9786

SEQ ID NO: 10129 - DNA, 201 bp, Homo sapiens; identical to SEQ ID NO: 9759

SEQ ID NO: 10130 - DNA, 201 bp, Homo sapiens; identical to SEQ ID NO: 9760

SEQ ID NO: 10131 - DNA, 201 bp, Homo sapiens; identical to SEQ ID NO: 9761

SEQ ID NO: 10132 - DNA, 201 bp, Homo sapiens; identical to SEQ ID NO: 9749

SEQ ID NO: 10133 - DNA, 201 bp, Homo sapiens; identical to SEQ ID NO: 9769

SEQ ID NO: 10134 - DNA, 201 bp, Homo sapiens; identical to SEQ ID NO: 9751

SEQ ID NO: 10135 - DNA, 201 bp, Homo sapiens; identical to SEQ ID NO: 9752

SEQ ID NO: 10136 - DNA, 171 bp, Homo sapiens; identical to SEQ ID NO: 9775

SEQ ID NO: 10137 - DNA, 201 bp, Homo sapiens; identical to SEQ ID NO: 9754

SEQ ID NO: 10138 - DNA, 201 bp, Homo sapiens; identical to SEQ ID NO: 9755

SEQ ID NO: 10139 - DNA, 201 bp, Homo sapiens; identical to SEQ ID NO: 9756

SEQ ID NO: 10140 - DNA, 201 bp, Homo sapiens; identical to SEQ ID NO: 9779

SEQ ID NO: 10141 - DNA, 201 bp, Homo sapiens; identical to SEQ ID NO: 9758

SEQ ID NO: 10142 - DNA, 201 bp, Homo sapiens; identical to SEQ ID NO: 9788

SEQ ID NO: 10143 - DNA, 106 bp, Homo sapiens; identical to SEQ ID NO: 9790

SEQ ID NO: 10144 - DNA, 201 bp, Homo sapiens; identical to SEQ ID NO: 9760

SEQ ID NO: 10145 - DNA, 201 bp, Homo sapiens; identical to SEQ ID NO: 9886

SEQ ID NO: 10146 - DNA, 201 bp, Homo sapiens; identical to SEQ ID NO: 9761

SEQ ID NO: 10147 - DNA, 201 bp, Homo sapiens; identical to SEQ ID NO: 9795

SEQ ID NO: 10148 - DNA, 201 bp, Homo sapiens; identical to SEQ ID NO: 9796

SEQ ID NO: 10149 - DNA, 201 bp, Homo sapiens; identical to SEQ ID NO: 9763

SEQ ID NO: 10150 - DNA, 201 bp, Homo sapiens; identical to SEQ ID NO: 9764

SEQ ID NO: 10151 - DNA, 201 bp, Homo sapiens; identical to SEQ ID NO: 9765

SEQ ID NO: 10152 - DNA, 201 bp, Homo sapiens; identical to SEQ ID NO: 9766

SEQ ID NO: 10153 - DNA, 201 bp, Homo sapiens; identical to SEQ ID NO: 9767

SEQ ID NO: 10154 - DNA, 201 bp, Homo sapiens; identical to SEQ ID NO: 9749

SEQ ID NO: 10155 - DNA, 201 bp, Homo sapiens; identical to SEQ ID NO: 9769

SEQ ID NO: 10156 - DNA, 201 bp, Homo sapiens; identical to SEQ ID NO: 9771

SEQ ID NO: 10157 - DNA, 201 bp, Homo sapiens; identical to SEQ ID NO: 9751

SEQ ID NO: 10158 - DNA, 201 bp, Homo sapiens; identical to SEQ ID NO: 9774

SEQ ID NO: 10159 - DNA, 171 bp, Homo sapiens; identical to SEQ ID NO: 9775

SEQ ID NO: 10160 - DNA, 201 bp, Homo sapiens; identical to SEQ ID NO: 9777

SEQ ID NO: 10161 - DNA, 201 bp, Homo sapiens; identical to SEQ ID NO: 9754

SEQ ID NO: 10162 - DNA, 201 bp, Homo sapiens; identical to SEQ ID NO: 9782

SEQ ID NO: 10163 - DNA, 201 bp, Homo sapiens; identical to SEQ ID NO: 9783

SEQ ID NO: 10164 - DNA, 201 bp, Homo sapiens; identical to SEQ ID NO: 9784

SEQ ID NO: 10165 - DNA, 201 bp, Homo sapiens; identical to SEQ ID NO: 9758

SEQ ID NO: 10166 - DNA, 201 bp, Homo sapiens; identical to SEQ ID NO: 9789

SEQ ID NO: 10167 - DNA, 201 bp, Homo sapiens; identical to SEQ ID NO: 9816

SEQ ID NO: 10168 - DNA, 201 bp, Homo sapiens; identical to SEQ ID NO: 9792

SEQ ID NO: 10169 - DNA, 201 bp, Homo sapiens; identical to SEQ ID NO: 9794

SEQ ID NO: 10170 - DNA, 201 bp, Homo sapiens; identical to SEQ ID NO: 9762

SEQ ID NO: 10171 - DNA, 155 bp, Homo sapiens; identical to SEQ ID NO: 9820

SEQ ID NO: 10172 - DNA, 201 bp, Homo sapiens; identical to SEQ ID NO: 9770

SEQ ID NO: 10173 - DNA, 201 bp, Homo sapiens; identical to SEQ ID NO: 9822

SEQ ID NO: 10174 - DNA, 201 bp, Homo sapiens; identical to SEQ ID NO: 9752

SEQ ID NO: 10175 - DNA, 201 bp, Homo sapiens; identical to SEQ ID NO: 9755

SEQ ID NO: 10176 - DNA, 201 bp, Homo sapiens; identical to SEQ ID NO: 9779

SEQ ID NO: 10177 - DNA, 201 bp, Homo sapiens; identical to SEQ ID NO: 9780

SEQ ID NO: 10178 - DNA, 201 bp, Homo sapiens; identical to SEQ ID NO: 9781

SEQ ID NO: 10179 - DNA, 201 bp, Homo sapiens; identical to SEQ ID NO: 9828

SEQ ID NO: 10180 - DNA, 201 bp, Homo sapiens; identical to SEQ ID NO: 9756

SEQ ID NO: 10181 - DNA, 201 bp, Homo sapiens; identical to SEQ ID NO: 9786

SEQ ID NO: 10182 - DNA, 201 bp, Homo sapiens; identical to SEQ ID NO: 9788

SEQ ID NO: 10183 - DNA, 106 bp, Homo sapiens; identical to SEQ ID NO: 9790

SEQ ID NO: 10184 - DNA, 201 bp, Homo sapiens; identical to SEQ ID NO: 9760

SEQ ID NO: 10185 - DNA, 201 bp, Homo sapiens; identical to SEQ ID NO: 9761

SEQ ID NO: 10186 - DNA, 201 bp, Homo sapiens
gcaattaaccaagtcccaggtagaagagcagacggcaggaactggcccccttggattccatattcctcctccttcttggtgggccactgacggagtccacrccgcaggagacacttgagtaattcggaaaggtgtaagcggttcttttcgctggtatcttcttttattttccttgtattggaatgataataataatggcag

SEQ ID NO: 10187 - DNA, 201 bp, Homo sapiens
gacctatagcatcaacacatttttaaggctaaatgccagaatcaagcttgtaatactgatgattaattccgaaagactgtctaaggctctatctactgatrtatcttgtctttgcaataaccacatcaagtagaacatgaacaaatgaagaaaggttgccatcctccactgaggtctgtcctataatccactgatttattc

SEQ ID NO: 10188 - DNA, 201 bp, Homo sapiens
catgccaaactttgcgccagatgaaccaggaaaaatcttcttgatggatctgaatgaacaaaacccaagggcacaagcactagaaatcagtggtggatttracaaagaattatttaatccacatgggatcagtattttcatcgacaaagacaatactgtgtatctttatgttgtgaatcatccccacatgaagtccactgt

SEQ ID NO: 10189 - DNA, 188 bp, Homo sapiens
agtcgccgctgggcaccccgagaccatggggaagctcgtggcgctggtcctgctgggggtcggcctgtccttagtcggggagatgttyctggcgtttagagaaagggtgaatgcctctcgagaagtggagccagtagaacctgaaaactgccaccttattgaggaacttgaaagtggctctgaagata

SEQ ID NO: 10190 - DNA, 201 bp, Homo sapiens
atgagggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaagacaatactgtgtatctttatgttgtgaatc

SEQ ID NO: 10191 - DNA, 201 bp, Homo sapiens
aaaacccaagggcacaagcactagaaatcagtggtggatttgacaaagaattatttaatccacatgggatcagtattttcatcgacaaagacaatactgtrtatctttatgttgtgaatcatccccacatgaagtccactgtggagatatttaaatttgaggaacaacaacgttctctggtatacctgaaaactataaaac

SEQ ID NO: 10192 - DNA, 201 bp, Homo sapiens
gaggaacaacaacgttctctggtatacctgaaaactataaaacatgaacttctcaaaagtgtgaatgacattgtggttcttggaccagaacagttctatgmcaccagagaccactattttaccaactccctcctgtcattttttgagatgatcttggatcttcgctggacttatgttcttttctacagcccaagggaggtt

SEQ ID NO: 10193 - DNA, 201 bp, Homo sapiens
aggagcaaaatgggacttttggctgaaagtgctgagctcctgcggtgggggctgaccgcaagccacgccttctgtgcacctggtcggcccagctagctgcsgacccggcggggaggggcggggcgggccaatcggcgctgccccagcagggctgcggctgcaggcaggcagagcctcctagcccgtcggtgtctgcgccca

SEQ ID NO: 10194 - DNA, 201 bp, Homo sapiens
ctactccatgcacatagtaagtctgactatggcagtcagacttacttactcccattttcccttcgatatatgactttttctcagtaaatattaacctgaaytattccaactccccttgtactcttgctttttcaattctcctgttgcaatgacacataggaaaatcttaaaattcttgggagtgttgtcacacctgaaaat

SEQ ID NO: 10195 - DNA, 201 bp, Homo sapiens
aggtaaacaaacaaataaatagaaaagatcaacaacccctttggctatctactgagacatgactaggaagaaaacatgactttatcattttgttatagaarctgatatataaaggttacacattttcatttatttgtttttctgatttgaaggtataaccttcatgatgaattacttcttcagggtgttaaggcagtgact

SEQ ID NO: 10196 - DNA, 201 bp, Homo sapiens
gtcttcttaccaaacacgacttaatgctctccgagaggtacaacccgtagaacttcctaactgtaatttagttaaaggaatcgaaactggctctgaagacwtggagatactgcctaatggactggctttcattagctctggattaaagtatcctggaataaagagcttcaaccccaacagtcctggaaaaatacttctgat

SEQ ID NO: 10197 - DNA, 201 bp, Homo sapiens
atcagacataaacttctgcctaatttgaatgatattgttgctgtgggacctgagcacttttatggcacaaatgatcactattttcttgacccctacttacratcctgggagatgtatttgggtttagcgtggtcgtatgttgtctactatagtccaagtgaagttcgagtggtggcagaaggatttgattttgctaatgga

SEQ ID NO: 10198 - DNA, 201 bp, Homo sapiens
tccttctcactaaaatggataaatcagttatgtcaattgtcagatattaaataacagtgtgtgaccccaaaagtacttaccctaaaacatgtgttgcctgraagcacatgtgtgtatcgctgccttgccatgtcttgttcagaagacacaggggagcagggttagctcacgtgtctttagaactccagtactcacccaggg

SEQ ID NO: 10199 - DNA, 201 bp, Homo sapiens
ttggctgaaagtgctgagctcctgcggtgggggctgaccgcaagccacgccttctgtgcacctggtcggcccagctagctgcggacccggcggggaggggyggggcgggccaatcggcgctgccccagcagggctgcggctgcaggcaggcagagcctcctagcccgtcggtgtctgcgcccatcgatccctttgtctatc

SEQ ID NO: 10200 - DNA, 201 bp, Homo sapiens
gagcttcaaccccaacagtcctggaaaaatacttctgatggacctgaatgaagaagatccaacagtgttggaattggggatcactggaagtaaatttgatrtatcttcatttaaccctcatgggattagcacattcacagatgaagataatgccatgtacctcctggtggtgaaccatccagatgccaagtccacagtgga

SEQ ID NO: 10201 - DNA, 170 bp, Homo sapiens
ttggaaggagcaaaatgggacttttggctgaaagtgctgagctcctgcggtgggggctgaccgcaagccrcgccttctgtgcacctggtcggcccagctagctgcggacccggcggggaggggcggggcgggccaatcggcgctgccccagcagggctgcggctgcaggc

SEQ ID NO: 10202 - DNA, 201 bp, Homo sapiens
tgttgtcacacctgaaaattatgagtctctatgatcttggcacaaattgtacatttgagtgtctttgacttggttaaaggaagtttgttcacttcgatgaytggatacagaatgaatcccataattgacatgggcgaagctaaaagtgtccccaaagactacactgttgttgaggtggtggtagtgctggtgggtttttgt

SEQ ID NO: 10203 - DNA, 201 bp, Homo sapiens
catgccaaactttgcgccagatgaaccaggaaaaatcttcttgatggatctgaatgaacaaaacccaagggcacaagcactagaaatcagtggtggatttracaaagaattatttaatccacatgggatcagtattttcatcgacaaagaacacgacttaatgctctccgagaggtacaacccgtagaacttcctaactgt

SEQ ID NO: 10204 - DNA, 201 bp, Homo sapiens; identical to SEQ ID NO: 10194

SEQ ID NO: 10205 - DNA, 201 bp, Homo sapiens; identical to SEQ ID NO: 10195

SEQ ID NO: 10206 - DNA, 201 bp, Homo sapiens
tcatcgacaaagaacacgacttaatgctctccgagaggtacaacccgtagaacttcctaactgtaatttagttaaaggaatcgaaactggctctgaagacwtggagatactgcctaatggactggctttcattagctctggattaaagtatcctggaataaagagcttcaaccccaacagtcctggaaaaatacttctgat

SEQ ID NO: 10207 - DNA, 201 bp, Homo sapiens
atgagggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaagaacacgacttaatgctctccgagaggtaca

SEQ ID NO: 10208 - DNA, 201 bp, Homo sapiens; identical to SEQ ID NO: 10197

SEQ ID NO: 10209 - DNA, 201 bp, Homo sapiens; identical to SEQ ID NO: 10198

SEQ ID NO: 10210 - DNA, 201 bp, Homo sapiens; identical to SEQ ID NO: 10200

SEQ ID NO: 10211 - DNA, 201 bp, Homo sapiens; identical to SEQ ID NO: 10202

SEQ ID NO: 10212 - DNA, 201 bp, Homo sapiens; identical to SEQ ID NO: 10188

SEQ ID NO: 10213 - DNA, 188 bp, Homo sapiens; identical to SEQ ID NO: 10189

SEQ ID NO: 10214 - DNA, 201 bp, Homo sapiens
ccagtggattaaaatatccaggcatgccaaactttgcgccagatgaaccaggaaaaatcttcttgatggatctgaatgaacaaaacccaagggcacaagcrctagaaatcagtggtggatttgacaaagaattatttaatccacatgggatcagtattttcatcgacaaagacaatactgtgtatctttatgttgtgaatc

SEQ ID NO: 10215 - DNA, 201 bp, Homo sapiens; identical to SEQ ID NO: 10191

SEQ ID NO: 10216 - DNA, 201 bp, Homo sapiens; identical to SEQ ID NO: 10192

SEQ ID NO: 10217 - DNA, 201 bp, Homo sapiens; identical to SEQ ID NO: 10193

SEQ ID NO: 10218 - DNA, 201 bp, Homo sapiens; identical to SEQ ID NO: 10194

SEQ ID NO: 10219 - DNA, 201 bp, Homo sapiens; identical to SEQ ID NO: 10195

SEQ ID NO: 10220 - DNA, 201 bp, Homo sapiens; identical to SEQ ID NO: 10196

SEQ ID NO: 10221 - DNA, 201 bp, Homo sapiens; identical to SEQ ID NO: 10197

SEQ ID NO: 10222 - DNA, 201 bp, Homo sapiens; identical to SEQ ID NO: 10198

SEQ ID NO: 10223 - DNA, 201 bp, Homo sapiens; identical to SEQ ID NO: 10199

SEQ ID NO: 10224 - DNA, 201 bp, Homo sapiens; identical to SEQ ID NO: 10200

SEQ ID NO: 10225 - DNA, 201 bp, Homo sapiens
ttcatcccagaggggcatccgcctgtatgagttggaaggagcaaaatgggacttttggctgaaagtgctgagctcctgcggtgggggctgaccgcaagccrcgccttctgtgcacctggtcggcccagctagctgcggacccggcggggaggggcggggcgggccaatcggcgctgccccagcagggctgcggctgcaggc

SEQ ID NO: 10226 - DNA, 201 bp, Homo sapiens; identical to SEQ ID NO: 10202

SEQ ID NO: 10227 - DNA, 201 bp, Homo sapiens
  misc_feature (1)...(201): n = A,T,C or G, or insertion/deletion polymorphism (see Tables 1-2)
accaccttccccggtagcagaattctcagaagccaccgctgaactgaccgtctcattcacaaacgaagtcttcacaactgagacttctaggagtatcaccnccagtccaaaggagtcagactctccagctggtcctgcccgccagtactacaccaagggcaacctggtccggatatgcctcggggctgtgatcctaataat

SEQ ID NO: 10228 - DNA, 201 bp, Homo sapiens
cttctaggagtatcaccaccagtccaaaggagtcagactctccagctggtcctgcccgccagtactacaccaagggcaacctggtccggatatgcctcggrgctgtgatcctaataatcctggcggggtttctggcagaggactggcacagccggaggaagcgcctgcggcacaggggcagggctgtgcagaggccgcttc

SEQ ID NO: 10229 - DNA, 201 bp, Homo sapiens
aggaacctctgtgacccccagccggttaccaacagaaccaccttccccggtagcagaattctcagaagccaccgctgaactgaccgtctcattcacaaacraagtcttcacaactgagacttctaggagtatcaccaccagtccaaaggagtcagactctccagctggtcctgcccgccagtactacaccaagggcaacct

SEQ ID NO: 10230 - DNA, 201 bp, Homo sapiens
aaaaatacagggatgaatatgtcaattaccctgatttgatcatagcacgttgtatacatgtactgcaatattgctgtccaccccataaatatgtacaattmtgtatacatttttaaaatcataaaaataagataatgcaccgtctccacccctctcatatttactttctgaaggaaatgttaggtcttctcaaggtaaagt

SEQ ID NO: 10231 - DNA, 201 bp, Homo sapiens
cggggggctgaggtgggagaatggcttgagcctgggaggcagaggttgcagtgagctgagatcacaccactgcactctagctcgggtgacgaagcctgacyttgtctcaaaaaatacagggatgaatatgtcaattaccctgatttgatcatagcacgttgtatacatgtactgcaatattgctgtccaccccataaatat

SEQ ID NO: 10232 - DNA, 201 bp, Homo sapiens
ggacgtaaccctacagtgtcagactcggtatggctttgaccaatttgctctgtacaaggaaggggaccctgcgccctacaagaatcccgagagatggtacmgggctagtttccccatcatcacggtgaccgccgcccacagcggaacctaccgatgctacagcttctccagcagggacccatacctgtggtcggcccccag

SEQ ID NO: 10233 - DNA, 201 bp, Homo sapiens
cagcctgtgcaacatggtgaaacctcatctctaccaacaaaacaaaaaaacacaaaaattagccaggtgtggtggtgcatccctatactcccagcaactcrgggggctgaggtgggagaatggcttgagcctgggaggcagaggttgcagtgagctgagatcacaccactgcactctagctcgggtgacgaagcctgacct

SEQ ID NO: 10234 - DNA, 201 bp, Homo sapiens
gatggtaccgggctagtttccccatcatcacggtgaccgccgcccacagcggaacctaccgatgctacagcttctccagcagggacccatacctgtggtcrgcccccagcgaccccctggagcttgtggtcacaggaacctctgtgacccccagccggttaccaacagaaccaccttccccggtagcagaattctcagaag

SEQ ID NO: 10235 - DNA, 201 bp, Homo sapiens
  misc_feature (1)...(201): n = A,T,C or G, or insertion/deletion polymorphism (see Tables 1-2)
tacagtgtcagactcggtatggctttgaccaatttgctctgtacaaggaaggggaccctgcgccctacaagaatcccgagagatggtaccgggctagtttncccatcatcacggtgaccgccgcccacagcggaacctaccgatgctacagcttctccagcagggacccatacctgtggtcggcccccagcgaccccctgg

SEQ ID NO: 10236 - DNA, 201 bp, Homo sapiens
ggcctctttcttcaacctctctaatatgggctccagacggatctctaaggttcccagctctcagggttgactctgttccatcctctgtgcaaaatcctccygtgcttccctttggccctctgtgctcttgtctggttttccccagaaactctcaccctcactccatctcccactgcggtctaacaaatctcctttcgtctc

SEQ ID NO: 10237 - DNA, 201 bp, Homo sapiens
tcccagcaactcggggggctgaggtgggagaatggcttgagcctgggaggcagaggttgcagtgagctgagatcacaccactgcactctagctcgggtgaygaagcctgaccttgtctcaaaaaatacagggatgaatatgtcaattaccctgatttgatcatagcacgttgtatacatgtactgcaatattgctgtccac

SEQ ID NO: 10238 - DNA, 201 bp, Homo sapiens
agaggactggcacagccggaggaagcgcctgcggcacaggggcagggctgtgcagaggccgcttccgcccctcccgcccctcccgcagacccggaaatcahacgggggtcaggatggaggccgacaggatgttcacagccgcgggttatgttcatgaccgctgaaccccaggcacggtcgtatccaagggagggatcatgg

SEQ ID NO: 10239 - DNA, 201 bp, Homo sapiens
gcggggtttctggcagaggactggcacagccggaggaagcgcctgcggcacaggggcagggctgtgcagaggccgcttccgcccctcccgcccctcccgcwgacccggaaatcacacgggggtcaggatggaggccgacaggatgttcacagccgcgggttatgttcatgaccgctgaaccccaggcacggtcgtatccaa

SEQ ID NO: 10240 - DNA, 201 bp, Homo sapiens
cagggacccatacctgtggtcggcccccagcgaccccctggagcttgtggtcacaggaacctctgtgacccccagccggttaccaacagaaccaccttccycggtagcagaattctcagaagccaccgctgaactgaccgtctcattcacaaacgaagtcttcacaactgagacttctaggagtatcaccaccagtccaaa

SEQ ID NO: 10241 - DNA, 201 bp, Homo sapiens
tcctaataatcctggcggggtttctggcagaggactggcacagccggaggaagcgcctgcggcacaggggcagggctgtgcagaggccgcttccgcccctsccgcccctcccgcagacccggaaatcacacgggggtcaggatggaggccgacaggatgttcacagccgcgggttatgttcatgaccgctgaaccccaggc

SEQ ID NO: 10242 - DNA, 201 bp, Homo sapiens
ctcggtatggctttgaccaatttgctctgtacaaggaaggggaccctgcgccctacaagaatcccgagagatggtaccgggctagtttccccatcatcacrgtgaccgccgcccacagcggaacctaccgatgctacagcttctccagcagggacccatacctgtggtcggcccccagcgaccccctggagcttgtggtca

SEQ ID NO: 10243 - DNA, 201 bp, Homo sapiens
  misc_feature (1)...(201): n = A,T,C or G, or insertion/deletion polymorphism (see Tables 1-2)
cctggagcttgtggtcacagaattctcagaagccaccgctgaactgaccgtctcattcacaaacgaagtcttcacaactgagacttctaggagtatcaccnccagtccaaaggagtcagactctccagctggtcctgcccgccagtactacaccaagggcaacctggtccggatatgcctcggggctgtgatcctaataat

SEQ ID NO: 10244 - DNA, 201 bp, Homo sapiens; identical to SEQ ID NO: 10228

SEQ ID NO: 10245 - DNA, 201 bp, Homo sapiens
cagggacccatacctgtggtcggcccccagcgaccccctggagcttgtggtcacagaattctcagaagccaccgctgaactgaccgtctcattcacaaacraagtcttcacaactgagacttctaggagtatcaccaccagtccaaaggagtcagactctccagctggtcctgcccgccagtactacaccaagggcaacct

SEQ ID NO: 10246 - DNA, 201 bp, Homo sapiens; identical to SEQ ID NO: 10230

SEQ ID NO: 10247 - DNA, 201 bp, Homo sapiens; identical to SEQ ID NO: 10232

SEQ ID NO: 10248 - DNA, 201 bp, Homo sapiens; identical to SEQ ID NO: 10231

SEQ ID NO: 10249 - DNA, 201 bp, Homo sapiens
gatggtaccgggctagtttccccatcatcacggtgaccgccgcccacagcggaacctaccgatgctacagcttctccagcagggacccatacctgtggtcrgcccccagcgaccccctggagcttgtggtcacagaattctcagaagccaccgctgaactgaccgtctcattcacaaacgaagtcttcacaactgagactt

SEQ ID NO: 10250 - DNA, 201 bp, Homo sapiens; identical to SEQ ID NO: 10235
  misc_feature (1)...(201): n = A,T,C or G, or insertion/deletion polymorphism (see Tables 1-2)

SEQ ID NO: 10251 - DNA, 201 bp, Homo sapiens; identical to SEQ ID NO: 10233

SEQ ID NO: 10252 - DNA, 201 bp, Homo sapiens; identical to SEQ ID NO: 10236

SEQ ID NO: 10253 - DNA, 201 bp, Homo sapiens; identical to SEQ ID NO: 10237

SEQ ID NO: 10254 - DNA, 201 bp, Homo sapiens; identical to SEQ ID NO: 10238

SEQ ID NO: 10255 - DNA, 201 bp, Homo sapiens; identical to SEQ ID NO: 10239

SEQ ID NO: 10256 - DNA, 201 bp, Homo sapiens; identical to SEQ ID NO: 10242

SEQ ID NO: 10257 - DNA, 201 bp, Homo sapiens; identical to SEQ ID NO: 10241

SEQ ID NO: 10258 - DNA, 201 bp, Homo sapiens
  misc_feature (1)...(201): n = A,T,C or G, or insertion/deletion polymorphism (see Tables 1-2)
accaccttccccggtagcagaattctcagaagccaccgctgaactgaccgtctcattcacaaacgaagtcttcacaactgagacttctaggagtatcaccnccagtccaaaggagtcagactctccagctggtgagtcctgcccgccagtactacaccaagggcaacctggtccggatatgcctcggggctgtgatcctaa

SEQ ID NO: 10259 - DNA, 201 bp, Homo sapiens
taggagtatcaccaccagtccaaaggagtcagactctccagctggtgagtcctgcccgccagtactacaccaagggcaacctggtccggatatgcctcggrgctgtgatcctaataatcctggcggggtttctggcagaggactggcacagccggaggaagcgcctgcggcacaggggcagggctgtgcagaggccgcttc

SEQ ID NO: 10260 - DNA, 201 bp, Homo sapiens
aggaacctctgtgacccccagccggttaccaacagaaccaccttccccggtagcagaattctcagaagccaccgctgaactgaccgtctcattcacaaacraagtcttcacaactgagacttctaggagtatcaccaccagtccaaaggagtcagactctccagctggtgagtcctgcccgccagtactacaccaagggca

SEQ ID NO: 10261 - DNA, 201 bp, Homo sapiens; identical to SEQ ID NO: 10230

SEQ ID NO: 10262 - DNA, 201 bp, Homo sapiens; identical to SEQ ID NO: 10232

SEQ ID NO: 10263 - DNA, 201 bp, Homo sapiens; identical to SEQ ID NO: 10231

SEQ ID NO: 10264 - DNA, 201 bp, Homo sapiens; identical to SEQ ID NO: 10234

SEQ ID NO: 10265 - DNA, 201 bp, Homo sapiens; identical to SEQ ID NO: 10235
  misc_feature (1)...(201): n = A,T,C or G, or insertion/deletion polymorphism (see Tables 1-2)

SEQ ID NO: 10266 - DNA, 201 bp, Homo sapiens; identical to SEQ ID NO: 10233

SEQ ID NO: 10267 - DNA, 201 bp, Homo sapiens; identical to SEQ ID NO: 10236

SEQ ID NO: 10268 - DNA, 201 bp, Homo sapiens; identical to SEQ ID NO: 10237

SEQ ID NO: 10269 - DNA, 201 bp, Homo sapiens; identical to SEQ ID NO: 10238

SEQ ID NO: 10270 - DNA, 201 bp, Homo sapiens; identical to SEQ ID NO: 10239

SEQ ID NO: 10271 - DNA, 201 bp, Homo sapiens; identical to SEQ ID NO: 10240

SEQ ID NO: 10272 - DNA, 201 bp, Homo sapiens; identical to SEQ ID NO: 10242

SEQ ID NO: 10273 - DNA, 201 bp, Homo sapiens; identical to SEQ ID NO: 10241

SEQ ID NO: 10274 - DNA, 201 bp, Homo sapiens
gcttcggcctcctgagtagctgggactacagggactatgtcaccggtggggcttgccccagcaaggccaccatccctgggaagacggtcatcgtgacgggygccaacacaggcatcgggaagcagaccgccttggaactggccaggagaggaggcaacatcatcctggcctgccgagacatggagaagtgtgaggcggcag

SEQ ID NO: 10275 - DNA, 201 bp, Homo sapiens
tctcgtccctggcccatgttgctgggcacatagactttgacgacttgaactggcagacgaggaagtataacaccaaagccgcctactgccagagcaagctygccatcgtcctcttcaccaaggagctgagccggcggctgcaaggctctggtgtgactgtcaacgccctgcaccccggcgtggccaggacagagctgggca

SEQ ID NO: 10276 - DNA, 201 bp, Homo sapiens
tgaagagcatgggcaagttgtctgacacttggtggattcttgggtccctgtgggaccttgtgcatgcatggtcctctctgagccttggtttcttcagcagygagatgctcagaataactgctgtctcccatgatggtgtggtacagcgagctgttgtctggctatggcatggctgtgccgggggtgtttgctgagggcttc

SEQ ID NO: 10277 - DNA, 201 bp, Homo sapiens
tctggctggttccgtctgctctgctgccagcaggggagaggggccatctgatgcttcccctgggaatctaaactgggaatggccgaggaggaaggggctcygtgcacttgcaggccacgtcaggagagccagcggtgcctgtcggggagggttccaaggtgctccgtgaagagcatgggcaagttgtctgacacttggtgg

SEQ ID NO: 10278 - DNA, 201 bp, Homo sapiens
caggagaggaggcaacatcatcctggcctgccgagacatggagaagtgtgaggcggcagcaaaggacatccgcggggagaccctcaatcaccatgtcaacrcccggcacctggacttggcttccctcaagtctatccgagagtttgcagcaaagatcattgaagaggaggagcgagtggacattctaatcaacaacgcggg

SEQ ID NO: 10279 - DNA, 201 bp, Homo sapiens
ccaggagaggaggcaacatcatcctggcctgccgagacatggagaagtgtgaggcggcagcaaaggacatccgcggggagaccctcaatcaccatgtcaamgcccggcacctggacttggcttccctcaagtctatccgagagtttgcagcaaagatcattgaagaggaggagcgagtggacattctaatcaacaacgcgg

SEQ ID NO: 10280 - DNA, 201 bp, Homo sapiens
gcacatagactttgacgacttgaactggcagacgaggaagtataacaccaaagccgcctactgccagagcaagctcgccatcgtcctcttcaccaaggagytgagccggcggctgcaaggctctggtgtgactgtcaacgccctgcaccccggcgtggccaggacagagctgggcagacacacgggcatccatggctccac

SEQ ID NO: 10281 - DNA, 201 bp, Homo sapiens
ggggttcggaatttcactctgtcgccaggctggaatgcagtagggcaatctcggctcactgcaacctccacctcccgagttcaagtgatgctcctgcttcrgcctcctgagtagctgggactacagggactatgtcaccggtggggcttgccccagcaaggccaccatccctgggaagacggtcatcgtgacgggcgccaa

SEQ ID NO: 10282 - DNA, 201 bp, Homo sapiens
ccccggcccccgaggctgaggatgaggaggtggcccggaggctttgggctgaaagtgcccgcctggtgggcttagaggctccctctgtgagggagcagccmctccccagataacctctggagcagatttgaaagccaggatggcgcctccagaccgaggacagctgtccgccatgcccgcagcttcctggcactacctgag

SEQ ID NO: 10283 - DNA, 201 bp, Homo sapiens
cctgagccgggagacccaggactggcggccgccatgcccgcagtaggttctagggggcggtgctggccgcagtggactggcctgcaggtgagcactgcccygggctctggctggttccgtctgctctgctgccagcaggggagaggggccatctgatgcttcccctgggaatctaaactgggaatggccgaggaggaaggg

SEQ ID NO: 10284 - DNA, 201 bp, Homo sapiens
cagcgagctgttgtctggctatggcatggctgtgccgggggtgtttgctgagggcttcctgtgccagagcccagccagagagcaggtgcaggtgtcatccygagttcaggctctgcacggcatggagtgggaaccccaccagctgctgctacaggacctgggattgcctgggactcccaccttcctatcaattctcatggt

SEQ ID NO: 10285 - DNA, 201 bp, Homo sapiens
gcacggtagcaggcgccgccgtgctgctcaaggactatgtcaccggtggggcttgccccagcaaggccaccatccctgggaagacggtcatcgtgacgggygccaacacaggcatcgggaagcagaccgccttggaactggccaggagaggaggcaacatcatcctggcctgccgagacatggagaagtgtgaggcggcag

SEQ ID NO: 10286 - DNA, 201 bp, Homo sapiens
cccgcgccccgcccctcgcagcccagttccggacgcgggcccagccgcgcctgcgcttccgctcgcctgtggctgcgtcgcgcgctcttcctcggagctayccaggcggctggtgtgcagcaagctccgcgccgaccccggacgcctgacgcctgacgcctgctacccggcccggcatgagccgctacctgctgccgctgt

SEQ ID NO: 10287 - DNA, 201 bp, Homo sapiens; identical to SEQ ID NO: 10275

SEQ ID NO: 10288 - DNA, 201 bp, Homo sapiens
gcctgtggctgcgtcgcgcgctcttcctcggagctacccaggcggctggtgtgcagcaagctccgcgccgaccccggacgcctgacgcctgacgcctgctmcccggcccggcatgagccgctacctgctgccgctgtcggcgctgggcacggtagcaggcgccgccgtgctgctcaaggactatgtcaccggtggggcttg

SEQ ID NO: 10289 - DNA, 201 bp, Homo sapiens; identical to SEQ ID NO: 10280

SEQ ID NO: 10290 - DNA, 201 bp, Homo sapiens; identical to SEQ ID NO: 10282

SEQ ID NO: 10291 - DNA, 201 bp, Homo sapiens; identical to SEQ ID NO: 10283

SEQ ID NO: 10292 - DNA, 201 bp, Homo sapiens; identical to SEQ ID NO: 10284

SEQ ID NO: 10293 - DNA, 201 bp, Homo sapiens
accgatgctcataggtcccgtccctaggatccccgccccctccgcccgcgccccgcccctcgcagcccagttccggacgcgggcccagccgcgcctgcgcytccgctcgcctgtggctgcgtcgcgcgctcttcctcggagctacccaggcggctggtgtgcagcaagctccgcgccgaccccggacgcctgacgcctgac

SEQ ID NO: 10294 - DNA, 201 bp, Homo sapiens; identical to SEQ ID NO: 10277

SEQ ID NO: 10295 - DNA, 201 bp, Homo sapiens; identical to SEQ ID NO: 10276

SEQ ID NO: 10296 - DNA, 201 bp, Homo sapiens; identical to SEQ ID NO: 10278

SEQ ID NO: 10297 - DNA, 201 bp, Homo sapiens; identical to SEQ ID NO: 10279

SEQ ID NO: 10298 - DNA, 201 bp, Homo sapiens
tcatcggcgaatttcactctgtcgccaggctggaatgcagtagggcaatctcggctcactgcaacctccacctcccgagttcaagtgatgctcctgcttcrgcctcctgagtagctgggactacagaactgcgtagcgccttatacgctgcggcaagtgtgacgtcattcgaacaaaccataggccccgcccccggactag

SEQ ID NO: 10299 - DNA, 201 bp, Homo sapiens
cccagccgcgcctgcgcttccgctcgcctgtggctgcgtcgcgcgctcttcctcggagctacccaggcggctggtgtgcagcaagctccgcgccgacccckgacgcctgacgcctgacgcctgctacccggcccggcatgagccgctacctgctgccgctgtcggcgctgggcacggtagcaggcgccgccgtgctgctca

SEQ ID NO: 10300 - DNA, 201 bp, Homo sapiens
tgcgtcgcgcgctcttcctcggagctacccaggcggctggtgtgcagcaagctccgcgccgaccccggacgcctgacgcctgacgcctgctacccggcccsgcatgagccgctacctgctgccgctgtcggcgctgggcacggtagcaggcgccgccgtgctgctcaaggactatgtcaccggtggggcttgccccagcaa

SEQ ID NO: 10301 - DNA, 201 bp, Homo sapiens; identical to SEQ ID NO: 10285

SEQ ID NO: 10302 - DNA, 201 bp, Homo sapiens; identical to SEQ ID NO: 10286

SEQ ID NO: 10303 - DNA, 201 bp, Homo sapiens; identical to SEQ ID NO: 10275

SEQ ID NO: 10304 - DNA, 201 bp, Homo sapiens; identical to SEQ ID NO: 10288

SEQ ID NO: 10305 - DNA, 201 bp, Homo sapiens; identical to SEQ ID NO: 10280

SEQ ID NO: 10306 - DNA, 201 bp, Homo sapiens; identical to SEQ ID NO: 10282

SEQ ID NO: 10307 - DNA, 201 bp, Homo sapiens; identical to SEQ ID NO: 10283

SEQ ID NO: 10308 - DNA, 201 bp, Homo sapiens; identical to SEQ ID NO: 10284

SEQ ID NO: 10309 - DNA, 201 bp, Homo sapiens; identical to SEQ ID NO: 10293

SEQ ID NO: 10310 - DNA, 201 bp, Homo sapiens; identical to SEQ ID NO: 10277

SEQ ID NO: 10311 - DNA, 201 bp, Homo sapiens; identical to SEQ ID NO: 10276

SEQ ID NO: 10312 - DNA, 201 bp, Homo sapiens; identical to SEQ ID NO: 10278

SEQ ID NO: 10313 - DNA, 201 bp, Homo sapiens; identical to SEQ ID NO: 10279

SEQ ID NO: 10314 - DNA, 201 bp, Homo sapiens
ggggttcggaatttcactctgtcgccaggctggaatgcagtagggcaatctcggctcactgcaacctccacctcccgagttcaagtgatgctcctgcttcrgcctcctgagtagctgggactacagaactgcgtagcgccttatacgctgcggcaagtgtgacgtcattcgaacaaaccataggccccgcccccggactag

SEQ ID NO: 10315 - DNA, 201 bp, Homo sapiens; identical to SEQ ID NO: 10299

SEQ ID NO: 10316 - DNA, 201 bp, Homo sapiens; identical to SEQ ID NO: 10300

SEQ ID NO: 10317 - DNA, 201 bp, Homo sapiens; identical to SEQ ID NO: 10274

SEQ ID NO: 10318 - DNA, 201 bp, Homo sapiens; identical to SEQ ID NO: 10275

SEQ ID NO: 10319 - DNA, 201 bp, Homo sapiens; identical to SEQ ID NO: 10276

SEQ ID NO: 10320 - DNA, 201 bp, Homo sapiens; identical to SEQ ID NO: 10277

SEQ ID NO: 10321 - DNA, 201 bp, Homo sapiens; identical to SEQ ID NO: 10278

SEQ ID NO: 10322 - DNA, 201 bp, Homo sapiens; identical to SEQ ID NO: 10279

SEQ ID NO: 10323 - DNA, 201 bp, Homo sapiens; identical to SEQ ID NO: 10280

SEQ ID NO: 10324 - DNA, 201 bp, Homo sapiens; identical to SEQ ID NO: 10281

SEQ ID NO: 10325 - DNA, 201 bp, Homo sapiens; identical to SEQ ID NO: 10282

SEQ ID NO: 10326 - DNA, 201 bp, Homo sapiens; identical to SEQ ID NO: 10283

SEQ ID NO: 10327 - DNA, 201 bp, Homo sapiens; identical to SEQ ID NO: 10284

SEQ ID NO: 10328 - DNA, 201 bp, Homo sapiens; identical to SEQ ID NO: 10285

SEQ ID NO: 10329 - DNA, 201 bp, Homo sapiens; identical to SEQ ID NO: 10286

SEQ ID NO: 10330 - DNA, 201 bp, Homo sapiens; identical to SEQ ID NO: 10275

SEQ ID NO: 10331 - DNA, 201 bp, Homo sapiens; identical to SEQ ID NO: 10288

SEQ ID NO: 10332 - DNA, 201 bp, Homo sapiens; identical to SEQ ID NO: 10280

SEQ ID NO: 10333 - DNA, 201 bp, Homo sapiens; identical to SEQ ID NO: 10282

SEQ ID NO: 10334 - DNA, 201 bp, Homo sapiens; identical to SEQ ID NO: 10283

SEQ ID NO: 10335 - DNA, 201 bp, Homo sapiens; identical to SEQ ID NO: 10284

SEQ ID NO: 10336 - DNA, 201 bp, Homo sapiens; identical to SEQ ID NO: 10293

SEQ ID NO: 10337 - DNA, 201 bp, Homo sapiens; identical to SEQ ID NO: 10277

SEQ ID NO: 10338 - DNA, 201 bp, Homo sapiens; identical to SEQ ID NO: 10276

SEQ ID NO: 10339 - DNA, 201 bp, Homo sapiens; identical to SEQ ID NO: 10278

SEQ ID NO: 10340 - DNA, 201 bp, Homo sapiens; identical to SEQ ID NO: 10279

SEQ ID NO: 10341 - DNA, 201 bp, Homo sapiens; identical to SEQ ID NO: 10298

SEQ ID NO: 10342 - DNA, 201 bp, Homo sapiens; identical to SEQ ID NO: 10299

SEQ ID NO: 10343 - DNA, 201 bp, Homo sapiens; identical to SEQ ID NO: 10300

SEQ ID NO: 10344 - DNA, 201 bp, Homo sapiens
tatgatgattgcttccacccacacgactgcaacatacaggtgccttggggaaatgtggagaacattcaatcttgccgtcactattcatcaatgaagattarcactgagatccagagaggctggatgacttgctcaagttcaccagcatggtagtggcaaagagaggtccagagtcctggcccttgatgcccagctcagtgc

SEQ ID NO: 10345 - DNA, 201 bp, Homo sapiens
agagaggctggatgacttgctcaagttcaccagcatggtagtggcaaagagaggtccagagtcctggcccttgatgcccagctcagtgccacaaagctcartaggagggatgttccagtggatgagggccaccaggaagcacaggtccaaggctggtcccacacttatcagcagcaacaactgtcagttcatcctgcatgg

SEQ ID NO: 10346 - DNA, 201 bp, Homo sapiens
tctggacctcagtttccctctgtatacaaggatcagattcttgctgtgacccaagaactcctgaaatcatatagaaaggctggggtgggccctgtcattcrtggttgatttcaatacactcaagtgccattcatcctttaagaaaaacatctggatatcaaggtggaaatggcccatttaatgattgattatatcattttg

SEQ ID NO: 10347 - DNA, 171 bp, Homo sapiens
gcccatttaatgattgattatatcattttgtggatatagttataatctgatgggcctggctgggagtggaagaagggaagccttttgcaaatagtagagtrtcagttgcaggtgccaatgactaactttttgaattctatgttggcattaacaataaagcattttgcaaac

SEQ ID NO: 10348 - DNA, 201 bp, Homo sapiens
acatcctcttccttggcaaagtgaaccgcccctgaggtggggcttctcctgaaatctacaggcctcagggtgggagatgaagggggctaagctatggcccwtctgtatgctggtagctagtgatttacacaggtttagttgactaatgaggcattacaaataatattactctatgatgattgcttccacccacacgactgc

SEQ ID NO: 10349 - DNA, 201 bp, Homo sapiens
ggggctgggtccagcacaaagatgcagatcctggagggcctgggcctcaacctccagaaaagctcagagaaggagctgcacagaggctttcagcagctccytcaggaactcaaccagcccagagatggcttccagctgagcctcggcaatgcccttttcaccgacctggtggtagacctgcaggacaccttcgtaagtgcc

SEQ ID NO: 10350 - DNA, 201 bp, Homo sapiens
ggcccatctgtatgctggtagctagtgatttacacaggtttagttgactaatgaggcattacaaataatattactctatgatgattgcttccacccacacractgcaacatacaggtgccttggggaaatgtggagaacattcaatcttgccgtcactattcatcaatgaagattaacactgagatccagagaggctggat

SEQ ID NO: 10351 - DNA, 201 bp, Homo sapiens
tcagtgccacaaagctcaataggagggatgttccagtggatgagggccaccaggaagcacaggtccaaggctggtcccacacttatcagcagcaacaactstcagttcatcctgcatgggaaaaatgttggaatgggagtctgaaatggggctactgtttcagtcctaatgtgctgtgtgacattgggacaacactttccc

SEQ ID NO: 10352 - DNA, 201 bp, Homo sapiens
aaatctacaggcctcagggtgggagatgaagggggctaagctatggcccatctgtatgctggtagctagtgatttacacaggtttagttgactaatgaggyattacaaataatattactctatgatgattgcttccacccacacgactgcaacatacaggtgccttggggaaatgtggagaacattcaatcttgccgtcac

SEQ ID NO: 10353 - DNA, 201 bp, Homo sapiens
gctggtcccacacttatcagcagcaacaactgtcagttcatcctgcatgggaaaaatgttggaatgggagtctgaaatggggctactgtttcagtcctaaygtgctgtgtgacattgggacaacactttccctctctggacctcagtttccctctgtatacaaggatcagattcttgctgtgacccaagaactcctgaaat

SEQ ID NO: 10354 - DNA, 201 bp, Homo sapiens
cccagccagagcatcttcttctcccctgtgagcatctccatgagcctggccatgctctccctgggggctgggtccagcacaaagatgcagatcctggaggkcctgggcctcaacctccagaaaagctcagagaaggagctgcacagaggctttcagcagctccttcaggaactcaaccagcccagagatggcttccagctg

SEQ ID NO: 10355 - DNA, 201 bp, Homo sapiens
gcttctcagccctcagggggcctcccttcaccgccaccacccccgggagatgaagaagagagtcgaggacctccatgtaggtgccacggtggcccccagcrgcagaagggactttacctttgacctctacagggccttggcttccgctgcccccagccagagcatcttcttctcccctgtgagcatctccatgagcctggc

SEQ ID NO: 10356 - DNA, 201 bp, Homo sapiens
atatccaggtgtctgagatggtgcacaaagctgtggtggaggtggacgagtcgggaaccagagcagcggcagccacggggacaatattcactttcaggtcrgcccgcctgaactctcagaggctagtgttcaacaggccctttctgatgttcattgtggataacaacatcctcttccttggcaaagtgaaccgcccctgag

SEQ ID NO: 10357 - DNA, 201 bp, Homo sapiens
aaagatgcagatcctggagggcctgggcctcaacctccagaaaagctcagagaaggagctgcacagaggctttcagcagctccttcaggaactcaaccagsccagagatggcttccagctgagcctcggcaatgcccttttcaccgacctggtggtagacctgcaggacaccttcgtaagtgccatgaagacgctgtacct

SEQ ID NO: 10358 - DNA, 151 bp, Homo sapiens
tatcattttgtggatatagttataatctgatgggcctggctgggagtggaagaagggaagccttttgcaaatagtagagtatcagttgcaggtgccaatgrctaactttttgaattctatgttggcattaacaataaagcattttgcaaac

SEQ ID NO: 10359 - DNA, 201 bp, Homo sapiens
aatgcggtcgtgatcatggtgaattacatcttctttaaagctaagtgggagacaagcttcaaccacaaaggcacccaagagcaagacttctacgtgacctyggagactgtggtgcgggtacccatgatgagccgcgaggatcagtatcactacctcctggaccggaacctctcctgcagggtggtgggggtcccctaccaa

SEQ ID NO: 10360 - DNA, 201 bp, Homo sapiens
ttaccttcccaaattctccattgagggctcctatcagctggagaaagtcctccccagtctggggatcagtaacgtcttcacctcccatgctgatctgtccsgcatcagcaaccactcaaatatccaggtgtctgagatggtgcacaaagctgtggtggaggtggacgagtcgggaaccagagcagcggcagccacggggac

SEQ ID NO: 10361 - DNA, 201 bp, Homo sapiens
gattgtggacttgcttaagaacctcgatagcaatgcggtcgtgatcatggtgaattacatcttctttaaagctaagtgggagacaagcttcaaccacaaasgcacccaagagcaagacttctacgtgacctcggagactgtggtgcgggtacccatgatgagccgcgaggatcagtatcactacctcctggaccggaacct

SEQ ID NO: 10362 - DNA, 201 bp, Homo sapiens
caccacccccgggagatgaagaagagagtcgaggacctccatgtaggtgccacggtggcccccagcagcagaagggactttacctttgacctctacagggycttggcttccgctgcccccagccagagcatcttcttctcccctgtgagcatctccatgagcctggccatgctctccctgggggctgggtccagcacaaag

SEQ ID NO: 10363 - DNA, 201 bp, Homo sapiens
catctccatgagcctggccatgctctccctgggggctgggtccagcacaaagatgcagatcctggagggcctgggcctcaacctccagaaaagctcagagraggagctgcacagaggctttcagcagctccttcaggaactcaaccagcccagagatggcttccagctgagcctcggcaatgcccttttcaccgacctggt

SEQ ID NO: 10364 - DNA, 201 bp, Homo sapiens
tatccaaggcagcagaggtgagtgggtcccccgagctctgtgaccttatgctccacactaactctggcagagcctccgtttcctcatagaacaaagaacakccaccatgcagctcttcctcctcttgtgcctggtgcttctcagccctcagggggcctcccttcaccgccaccacccccgggagatgaagaagagagtcga

SEQ ID NO: 10365 - DNA, 201 bp, Homo sapiens
gtcgaggacctccatgtaggtgccacggtggcccccagcagcagaagggactttacctttgacctctacagggccttggcttccgctgcccccagccagarcatcttcttctcccctgtgagcatctccatgagcctggccatgctctccctgggggctgggtccagcacaaagatgcagatcctggagggcctgggcctc

SEQ ID NO: 10366 - DNA, 201 bp, Homo sapiens
cctcccttcaccgccaccacccccgggagatgaagaagagagtcgaggacctccatgtaggtgccacggtggcccccagcagcagaagggactttaccttygacctctacagggccttggcttccgctgcccccagccagagcatcttcttctcccctgtgagcatctccatgagcctggccatgctctccctgggggctg

SEQ ID NO: 10367 - DNA, 201 bp, Homo sapiens
acgtgacctcggagactgtggtgcgggtacccatgatgagccgcgaggatcagtatcactacctcctggaccggaacctctcctgcagggtggtgggggtsccctaccaaggcaatgccacggctttgttcattctccccagtgagggaaagatgcagcaggtggagaatggactgagtgagaaaacgctgaggaagtggc

SEQ ID NO: 10368 - DNA, 201 bp, Homo sapiens
aatattactctatgatgattgcttccacccacacgactgcaacatacaggtgccttggggaaatgtggagaacattcaatcttgccgtcactattcatcartgaagattaacactgagatccagagaggctggatgacttgctcaagttcaccagcatggtagtggcaaagagaggtccagagtcctggcccttgatgccc

SEQ ID NO: 10369 - DNA, 201 bp, Homo sapiens
tcgaggacctccatgtaggtgccacggtggcccccagcagcagaagggactttacctttgacctctacagggccttggcttccgctgcccccagccagagyatcttcttctcccctgtgagcatctccatgagcctggccatgctctccctgggggctgggtccagcacaaagatgcagatcctggagggcctgggcctca

SEQ ID NO: 10370 - DNA, 201 bp, Homo sapiens
agctgagcctcggcaatgcccttttcaccgacctggtggtagacctgcaggacaccttcgtaagtgccatgaagacgctgtacctggcagacactttcccyaccaactttagggactctgcaggggccatgaagcagatcaatgattatgtggcaaagcaaacgaagggcaagattgtggacttgcttaagaacctcgata

SEQ ID NO: 10371 - DNA, 201 bp, Homo sapiens
tccctaccaactttagggactctgcaggggccatgaagcagatcaatgattatgtggcaaagcaaacgaagggcaagattgtggacttgcttaagaacctmgatagcaatgcggtcgtgatcatggtgaattacatcttctttaaagctaagtgggagacaagcttcaaccacaaaggcacccaagagcaagacttctacg

SEQ ID NO: 10372 - DNA, 201 bp, Homo sapiens
ccctttctgatgttcattgtggataacaacatcctcttccttggcaaagtgaaccgcccctgaggtggggcttctcctgaaatctacaggcctcagggtgrgagatgaagggggctaagctatggcccatctgtatgctggtagctagtgatttacacaggtttagttgactaatgaggcattacaaataatattactcta

SEQ ID NO: 10373 - DNA, 201 bp, Homo sapiens
tcagcaaccactcaaatatccaggtgtctgagatggtgcacaaagctgtggtggaggtggacgagtcgggaaccagagcagcggcagccacggggacaatmttcactttcaggtcggcccgcctgaactctcagaggctagtgttcaacaggccctttctgatgttcattgtggataacaacatcctcttccttggcaaag

SEQ ID NO: 10374 - DNA, 201 bp, Homo sapiens
tgtggataacaacatcctcttccttggcaaagtgaaccgcccctgaggtggggcttctcctgaaatctacaggcctcagggtgggagatgaagggggctawgctatggcccatctgtatgctggtagctagtgatttacacaggtttagttgactaatgaggcattacaaataatattactctatgatgattgcttccacc

SEQ ID NO: 10375 - DNA, 201 bp, Homo sapiens
acattgggacaacactttccctctctggacctcagtttccctctgtatacaaggatcagattcttgctgtgacccaagaactcctgaaatcatatagaaargctggggtgggccctgtcattcgtggttgatttcaatacactcaagtgccattcatcctttaagaaaaacatctggatatcaaggtggaaatggcccatt

SEQ ID NO: 10376 - DNA, 201 bp, Homo sapiens; identical to SEQ ID NO: 10344

SEQ ID NO: 10377 - DNA, 201 bp, Homo sapiens; identical to SEQ ID NO: 10345

SEQ ID NO: 10378 - DNA, 201 bp, Homo sapiens; identical to SEQ ID NO: 10346

SEQ ID NO: 10379 - DNA, 171 bp, Homo sapiens; identical to SEQ ID NO: 10347

SEQ ID NO: 10380 - DNA, 201 bp, Homo sapiens; identical to SEQ ID NO: 10348

SEQ ID NO: 10381 - DNA, 201 bp, Homo sapiens; identical to SEQ ID NO: 10349

SEQ ID NO: 10382 - DNA, 201 bp, Homo sapiens; identical to SEQ ID NO: 10350

SEQ ID NO: 10383 - DNA, 201 bp, Homo sapiens; identical to SEQ ID NO: 10351

SEQ ID NO: 10384 - DNA, 201 bp, Homo sapiens; identical to SEQ ID NO: 10352

SEQ ID NO: 10385 - DNA, 201 bp, Homo sapiens; identical to SEQ ID NO: 10353

SEQ ID NO: 10386 - DNA, 201 bp, Homo sapiens; identical to SEQ ID NO: 10354

SEQ ID NO: 10387 - DNA, 201 bp, Homo sapiens; identical to SEQ ID NO: 10355

SEQ ID NO: 10388 - DNA, 201 bp, Homo sapiens; identical to SEQ ID NO: 10356

SEQ ID NO: 10389 - DNA, 201 bp, Homo sapiens; identical to SEQ ID NO: 10357

SEQ ID NO: 10390 - DNA, 151 bp, Homo sapiens; identical to SEQ ID NO: 10358

SEQ ID NO: 10391 - DNA, 201 bp, Homo sapiens; identical to SEQ ID NO: 10359

SEQ ID NO: 10392 - DNA, 201 bp, Homo sapiens; identical to SEQ ID NO: 10360

SEQ ID NO: 10393 - DNA, 201 bp, Homo sapiens; identical to SEQ ID NO: 10361

SEQ ID NO: 10394 - DNA, 201 bp, Homo sapiens; identical to SEQ ID NO: 10362

SEQ ID NO: 10395 - DNA, 201 bp, Homo sapiens; identical to SEQ ID NO: 10363

SEQ ID NO: 10396 - DNA, 170 bp, Homo sapiens
ctttctgagcccgagggactgccacctccactgtgtgcacactcagctacgggacacaaacaaagaacakccaccatgcagctcttcctcctcttgtgcctggtgcttctcagccctcagggggcctcccttcaccgccaccacccccgggagatgaagaagagagtcga

SEQ ID NO: 10397 - DNA, 201 bp, Homo sapiens; identical to SEQ ID NO: 10365

SEQ ID NO: 10398 - DNA, 201 bp, Homo sapiens; identical to SEQ ID NO: 10366

SEQ ID NO: 10399 - DNA, 201 bp, Homo sapiens; identical to SEQ ID NO: 10367

SEQ ID NO: 10400 - DNA, 201 bp, Homo sapiens; identical to SEQ ID NO: 10368

SEQ ID NO: 10401 - DNA, 201 bp, Homo sapiens; identical to SEQ ID NO: 10369

SEQ ID NO: 10402 - DNA, 201 bp, Homo sapiens; identical to SEQ ID NO: 10370

SEQ ID NO: 10403 - DNA, 201 bp, Homo sapiens; identical to SEQ ID NO: 10371

SEQ ID NO: 10404 - DNA, 201 bp, Homo sapiens; identical to SEQ ID NO: 10372

SEQ ID NO: 10405 - DNA, 201 bp, Homo sapiens; identical to SEQ ID NO: 10373

SEQ ID NO: 10406 - DNA, 201 bp, Homo sapiens; identical to SEQ ID NO: 10374

SEQ ID NO: 10407 - DNA, 201 bp, Homo sapiens; identical to SEQ ID NO: 10375

SEQ ID NO: 10408 - DNA, 201 bp, Homo sapiens; identical to SEQ ID NO: 10344

SEQ ID NO: 10409 - DNA, 201 bp, Homo sapiens; identical to SEQ ID NO: 10345

SEQ ID NO: 10410 - DNA, 201 bp, Homo sapiens; identical to SEQ ID NO: 10346

SEQ ID NO: 10411 - DNA, 171 bp, Homo sapiens; identical to SEQ ID NO: 10347

SEQ ID NO: 10412 - DNA, 201 bp, Homo sapiens; identical to SEQ ID NO: 10348

SEQ ID NO: 10413 - DNA, 201 bp, Homo sapiens; identical to SEQ ID NO: 10349

SEQ ID NO: 10414 - DNA, 201 bp, Homo sapiens; identical to SEQ ID NO: 10350

SEQ ID NO: 10415 - DNA, 201 bp, Homo sapiens; identical to SEQ ID NO: 10351

SEQ ID NO: 10416 - DNA, 201 bp, Homo sapiens; identical to SEQ ID NO: 10352

SEQ ID NO: 10417 - DNA, 201 bp, Homo sapiens; identical to SEQ ID NO: 10353

SEQ ID NO: 10418 - DNA, 201 bp, Homo sapiens; identical to SEQ ID NO: 10354

SEQ ID NO: 10419 - DNA, 201 bp, Homo sapiens; identical to SEQ ID NO: 10355

SEQ ID NO: 10420 - DNA, 201 bp, Homo sapiens; identical to SEQ ID NO: 10356

SEQ ID NO: 10421 - DNA, 201 bp, Homo sapiens; identical to SEQ ID NO: 10357

SEQ ID NO: 10422 - DNA, 151 bp, Homo sapiens; identical to SEQ ID NO: 10358

SEQ ID NO: 10423 - DNA, 201 bp, Homo sapiens; identical to SEQ ID NO: 10359

SEQ ID NO: 10424 - DNA, 201 bp, Homo sapiens; identical to SEQ ID NO: 10360

SEQ ID NO: 10425 - DNA, 201 bp, Homo sapiens; identical to SEQ ID NO: 10361

SEQ ID NO: 10426 - DNA, 201 bp, Homo sapiens; identical to SEQ ID NO: 10362

SEQ ID NO: 10427 - DNA, 201 bp, Homo sapiens; identical to SEQ ID NO: 10363

SEQ ID NO: 10428 - DNA, 194 bp, Homo sapiens
ctttctgagcccgagggactgccacctccactgtgtgcacactcagctacgggacacatttcaggtatccaaggcagcagagaacaaagaacakccaccatgcagctcttcctcctcttgtgcctggtgcttctcagccctcagggggcctcccttcaccgccaccacccccgggagatgaagaagagagtcga

SEQ ID NO: 10429 - DNA, 201 bp, Homo sapiens; identical to SEQ ID NO: 10365

SEQ ID NO: 10430 - DNA, 201 bp, Homo sapiens; identical to SEQ ID NO: 10366

SEQ ID NO: 10431 - DNA, 201 bp, Homo sapiens; identical to SEQ ID NO: 10367

SEQ ID NO: 10432 - DNA, 201 bp, Homo sapiens; identical to SEQ ID NO: 10368

SEQ ID NO: 10433 - DNA, 201 bp, Homo sapiens; identical to SEQ ID NO: 10369

SEQ ID NO: 10434 - DNA, 201 bp, Homo sapiens; identical to SEQ ID NO: 10370

SEQ ID NO: 10435 - DNA, 201 bp, Homo sapiens; identical to SEQ ID NO: 10371

SEQ ID NO: 10436 - DNA, 201 bp, Homo sapiens; identical to SEQ ID NO: 10372

SEQ ID NO: 10437 - DNA, 201 bp, Homo sapiens; identical to SEQ ID NO: 10373

SEQ ID NO: 10438 - DNA, 201 bp, Homo sapiens; identical to SEQ ID NO: 10374

SEQ ID NO: 10439 - DNA, 201 bp, Homo sapiens; identical to SEQ ID NO: 10375

SEQ ID NO: 10440 - DNA, 201 bp, Homo sapiens; identical to SEQ ID NO: 10344

SEQ ID NO: 10441 - DNA, 201 bp, Homo sapiens; identical to SEQ ID NO: 10345

SEQ ID NO: 10442 - DNA, 201 bp, Homo sapiens; identical to SEQ ID NO: 10346

SEQ ID NO: 10443 - DNA, 171 bp, Homo sapiens; identical to SEQ ID NO: 10347

SEQ ID NO: 10444 - DNA, 201 bp, Homo sapiens; identical to SEQ ID NO: 10348

SEQ ID NO: 10445 - DNA, 201 bp, Homo sapiens; identical to SEQ ID NO: 10349

SEQ ID NO: 10446 - DNA, 201 bp, Homo sapiens; identical to SEQ ID NO: 10350

SEQ ID NO: 10447 - DNA, 201 bp, Homo sapiens; identical to SEQ ID NO: 10351

SEQ ID NO: 10448 - DNA, 201 bp, Homo sapiens; identical to SEQ ID NO: 10352

SEQ ID NO: 10449 - DNA, 201 bp, Homo sapiens; identical to SEQ ID NO: 10353

SEQ ID NO: 10450 - DNA, 201 bp, Homo sapiens; identical to SEQ ID NO: 10354

SEQ ID NO: 10451 - DNA, 201 bp, Homo sapiens; identical to SEQ ID NO: 10355

SEQ ID NO: 10452 - DNA, 201 bp, Homo sapiens; identical to SEQ ID NO: 10356

SEQ ID NO: 10453 - DNA, 201 bp, Homo sapiens; identical to SEQ ID NO: 10357

SEQ ID NO: 10454 - DNA, 151 bp, Homo sapiens; identical to SEQ ID NO: 10358

SEQ ID NO: 10455 - DNA, 201 bp, Homo sapiens; identical to SEQ ID NO: 10359

SEQ ID NO: 10456 - DNA, 201 bp, Homo sapiens; identical to SEQ ID NO: 10360

SEQ ID NO: 10457 - DNA, 201 bp, Homo sapiens; identical to SEQ ID NO: 10361

SEQ ID NO: 10458 - DNA, 201 bp, Homo sapiens; identical to SEQ ID NO: 10362

SEQ ID NO: 10459 - DNA, 201 bp, Homo sapiens; identical to SEQ ID NO: 10363

SEQ ID NO: 10460 - DNA, 201 bp, Homo sapiens
aggatggactctagagttttggggtttggggtctgcaaagctctgaaggagtctcatctctgcagtttcaggtatccaaggcagcagagaacaaagaacakccaccatgcagctcttcctcctcttgtgcctggtgcttctcagccctcagggggcctcccttcaccgccaccacccccgggagatgaagaagagagtcga

SEQ ID NO: 10461 - DNA, 201 bp, Homo sapiens; identical to SEQ ID NO: 10365

SEQ ID NO: 10462 - DNA, 201 bp, Homo sapiens; identical to SEQ ID NO: 10366

SEQ ID NO: 10463 - DNA, 201 bp, Homo sapiens; identical to SEQ ID NO: 10367

SEQ ID NO: 10464 - DNA, 201 bp, Homo sapiens; identical to SEQ ID NO: 10368

SEQ ID NO: 10465 - DNA, 201 bp, Homo sapiens; identical to SEQ ID NO: 10369

SEQ ID NO: 10466 - DNA, 201 bp, Homo sapiens; identical to SEQ ID NO: 10370

SEQ ID NO: 10467 - DNA, 201 bp, Homo sapiens; identical to SEQ ID NO: 10371

SEQ ID NO: 10468 - DNA, 201 bp, Homo sapiens; identical to SEQ ID NO: 10372

SEQ ID NO: 10469 - DNA, 201 bp, Homo sapiens; identical to SEQ ID NO: 10373

SEQ ID NO: 10470 - DNA, 201 bp, Homo sapiens; identical to SEQ ID NO: 10374

SEQ ID NO: 10471 - DNA, 201 bp, Homo sapiens; identical to SEQ ID NO: 10375

SEQ ID NO: 10472 - DNA, 201 bp, Homo sapiens; identical to SEQ ID NO: 10344

SEQ ID NO: 10473 - DNA, 201 bp, Homo sapiens; identical to SEQ ID NO: 10345

SEQ ID NO: 10474 - DNA, 201 bp, Homo sapiens; identical to SEQ ID NO: 10346

SEQ ID NO: 10475 - DNA, 171 bp, Homo sapiens; identical to SEQ ID NO: 10347

SEQ ID NO: 10476 - DNA, 201 bp, Homo sapiens; identical to SEQ ID NO: 10348

SEQ ID NO: 10477 - DNA, 201 bp, Homo sapiens; identical to SEQ ID NO: 10349

SEQ ID NO: 10478 - DNA, 201 bp, Homo sapiens; identical to SEQ ID NO: 10350

SEQ ID NO: 10479 - DNA, 201 bp, Homo sapiens; identical to SEQ ID NO: 10351

SEQ ID NO: 10480 - DNA, 201 bp, Homo sapiens; identical to SEQ ID NO: 10352

SEQ ID NO: 10481 - DNA, 201 bp, Homo sapiens; identical to SEQ ID NO: 10353

SEQ ID NO: 10482 - DNA, 201 bp, Homo sapiens; identical to SEQ ID NO: 10354

SEQ ID NO: 10483 - DNA, 201 bp, Homo sapiens; identical to SEQ ID NO: 10355

SEQ ID NO: 10484 - DNA, 201 bp, Homo sapiens; identical to SEQ ID NO: 10356

SEQ ID NO: 10485 - DNA, 201 bp, Homo sapiens; identical to SEQ ID NO: 10357

SEQ ID NO: 10486 - DNA, 151 bp, Homo sapiens; identical to SEQ ID NO: 10358

SEQ ID NO: 10487 - DNA, 201 bp, Homo sapiens; identical to SEQ ID NO: 10359

SEQ ID NO: 10488 - DNA, 201 bp, Homo sapiens; identical to SEQ ID NO: 10360

SEQ ID NO: 10489 - DNA, 201 bp, Homo sapiens; identical to SEQ ID NO: 10361

SEQ ID NO: 10490 - DNA, 201 bp, Homo sapiens; identical to SEQ ID NO: 10362

SEQ ID NO: 10491 - DNA, 201 bp, Homo sapiens; identical to SEQ ID NO: 10363

SEQ ID NO: 10492 - DNA, 148 bp, Homo sapiens
atggggacaaaatgtcggctggataggaggtgctcaaacaaagaacakccaccatgcagctcttcctcctcttgtgcctggtgcttctcagccctcagggggcctcccttcaccgccaccacccccgggagatgaagaagagagtcga

SEQ ID NO: 10493 - DNA, 201 bp, Homo sapiens; identical to SEQ ID NO: 10365

SEQ ID NO: 10494 - DNA, 201 bp, Homo sapiens; identical to SEQ ID NO: 10366

SEQ ID NO: 10495 - DNA, 201 bp, Homo sapiens; identical to SEQ ID NO: 10367

SEQ ID NO: 10496 - DNA, 201 bp, Homo sapiens; identical to SEQ ID NO: 10368

SEQ ID NO: 10497 - DNA, 201 bp, Homo sapiens; identical to SEQ ID NO: 10369

SEQ ID NO: 10498 - DNA, 201 bp, Homo sapiens; identical to SEQ ID NO: 10370

SEQ ID NO: 10499 - DNA, 201 bp, Homo sapiens; identical to SEQ ID NO: 10371

SEQ ID NO: 10500 - DNA, 201 bp, Homo sapiens; identical to SEQ ID NO: 10372

SEQ ID NO: 10501 - DNA, 201 bp, Homo sapiens; identical to SEQ ID NO: 10373

SEQ ID NO: 10502 - DNA, 201 bp, Homo sapiens; identical to SEQ ID NO: 10374

SEQ ID NO: 10503 - DNA, 201 bp, Homo sapiens; identical to SEQ ID NO: 10375

SEQ ID NO: 10504 - DNA, 201 bp, Homo sapiens
gctgtgctgaccatcgacgagaaagggactgaagctgctggggccatgtttttagaggccatacccatgtctatcccccccgaggtcaagttcaacaaacyctttgtcttcttaatgattgaacaaaataccaagtctcccctcttcatgggaaaagtggtgaatcccacccaaaaataactgcctctcgctcctcaaccc

SEQ ID NO: 10505 - DNA, 201 bp, Homo sapiens
ggctgtgctgaccatcgacgagaaagggactgaagctgctggggccatgtttttagaggccatacccatgtctatcccccccgaggtcaagttcaacaaaycctttgtcttcttaatgattgaacaaaataccaagtctcccctcttcatgggaaaagtggtgaatcccacccaaaaataactgcctctcgctcctcaacc

SEQ ID NO: 10506 - DNA, 201 bp, Homo sapiens
atgtctatcccccccgaggtcaagttcaacaaaccctttgtcttcttaatgattgaacaaaataccaagtctcccctcttcatgggaaaagtggtgaatcmcacccaaaaataactgcctctcgctcctcaacccctcccctccatccctggccccctccctggatgacattaaagaagggttgagctggtccctgcctgc

SEQ ID NO: 10507 - DNA, 201 bp, Homo sapiens
ctctgagtcccgactggggccacatgcagcctgacttctttgtgcctgttgctgtccctgcagtcttcagagggccaccgcagctccagtgccacggcagraggctgttcctgaatagcccctgtggtaagggccaggagagtccttccatcctccaaggccctgctaaaggacacagcagccaggaagtcccctgggccc

SEQ ID NO: 10508 - DNA, 201 bp, Homo sapiens
atccactgcttaaatacggacgaggacagggccctgtctcctcagcttcaggcaccaccactgacctgggacagtgaatcgacaatgccgtcttctgtctygtggggcatcctcctgctggcaggcctgtgctgcctggtccctgtctccctggctgaggatccccagggagatgctgcccagaagacagatacatcccac

SEQ ID NO: 10509 - DNA, 201 bp, Homo sapiens
aggtcaagttcaacaaaccctttgtcttcttaatgattgaacaaaataccaagtctcccctcttcatgggaaaagtggtgaatcccacccaaaaataactkcctctcgctcctcaacccctcccctccatccctggccccctccctggatgacattaaagaagggttgagctggtccctgcctgcatgtgactgtaaatcc

SEQ ID NO: 10510 - DNA, 201 bp, Homo sapiens
agatgctgcccagaagacagatacatcccaccatgatcaggatcacccaaccttcaacaagatcacccccaacctggctgagttcgccttcagcctatacygccagctggcacaccagtccaacagcaccaatatcttcttctccccagtgagcatcgctacagcctttgcaatgctctccctggggaccaaggctgacac

SEQ ID NO: 10511 - DNA, 201 bp, Homo sapiens
ctccctttgcctgctgaggctgtatgtgggctccaggtaacagtgctgtcttcgggccccctgaactgtgttcatggagcatctggctgggtaggcacatrctgggcttgaatccaggggggactgaatcctcagcttacggacctgggcccatctgtttctggagggctccagtcttccttgtcctgtcttggagtcccc

SEQ ID NO: 10512 - DNA, 201 bp, Homo sapiens
aggcacatgctgggcttgaatccaggggggactgaatcctcagcttacggacctgggcccatctgtttctggagggctccagtcttccttgtcctgtcttkgagtccccaagaaggaatcacaggggaggaaccagataccagccatgaccccaggctccaccaagcatcttcatgtccccctgctcatcccccactcccc

SEQ ID NO: 10513 - DNA, 201 bp, Homo sapiens
gtgaatcccacccaaaaataactgcctctcgctcctcaacccctcccctccatccctggccccctccctggatgacattaaagaagggttgagctggtccytgcctgcatgtgactgtaaatccctcccatgttttctctgagtctccctttgcctgctgaggctgtatgtgggctccaggtaacagtgctgtcttcgggc

SEQ ID NO: 10514 - DNA, 201 bp, Homo sapiens
aagggactgaagctgctggggccatgtttttagaggccatacccatgtctatcccccccgaggtcaagttcaacaaaccctttgtcttcttaatgattgamcaaaataccaagtctcccctcttcatgggaaaagtggtgaatcccacccaaaaataactgcctctcgctcctcaacccctcccctccatccctggccccc

SEQ ID NO: 10515 - DNA, 201 bp, Homo sapiens
gtttaggcatgtttaacatccagcactgtaagaagctgtccagctgggtgctgctgatgaaatacctgggcaatgccaccgccatcttcttcctgcctgaygaggggaaactacagcacctggaaaatgaactcacccacgatatcatcaccaagttcctggaaaatgaagacagaaggtctgccagcttacatttaccca

SEQ ID NO: 10516 - DNA, 201 bp, Homo sapiens
aactgggcatcactaaggtcttcagcaatggggctgacctctccggggtcacagaggaggcacccctgaagctctccaaggccgtgcataaggctgtgctkaccatcgacgagaaagggactgaagctgctggggccatgtttttagaggccatacccatgtctatcccccccgaggtcaagttcaacaaaccctttgtct

SEQ ID NO: 10517 - DNA, 201 bp, Homo sapiens
cactgtgcccagggcatgcactgcctccacgcagcaaccctcagagtcctgagctgaaccaagaaggaggagggggtcgggcctccgaggaaggcctagcygctgctgctgccaggaattccaggttggaggggcggcaacctcctgccagccttcaggccactctcctgtgcctgccagaagagacagagcttgaggaga

SEQ ID NO: 10518 - DNA, 201 bp, Homo sapiens
ggctgacctctccggggtcacagaggaggcacccctgaagctctccaaggccgtgcataaggctgtgctgaccatcgacgagaaagggactgaagctgctkgggccatgtttttagaggccatacccatgtctatcccccccgaggtcaagttcaacaaaccctttgtcttcttaatgattgaacaaaataccaagtctcc

SEQ ID NO: 10519 - DNA, 201 bp, Homo sapiens
gctctccaaggccgtgcataaggctgtgctgaccatcgacgagaaagggactgaagctgctggggccatgtttttagaggccatacccatgtctatccccyccgaggtcaagttcaacaaaccctttgtcttcttaatgattgaacaaaataccaagtctcccctcttcatgggaaaagtggtgaatcccacccaaaaata

SEQ ID NO: 10520 - DNA, 201 bp, Homo sapiens
tctggtgaattacatcttctttaaaggcaaatgggagagaccctttgaagtcaaggacaccgaggaagaggacttccacgtggaccaggcgaccaccgtgwaggtgcctatgatgaagcgtttaggcatgtttaacatccagcactgtaagaagctgtccagctgggtgctgctgatgaaatacctgggcaatgccaccgc

SEQ ID NO: 10521 - DNA, 201 bp, Homo sapiens
cactgtaagaagctgtccagctgggtgctgctgatgaaatacctgggcaatgccaccgccatcttcttcctgcctgatgaggggaaactacagcacctggwaaatgaactcacccacgatatcatcaccaagttcctggaaaatgaagacagaaggtctgccagcttacatttacccaaactgtccattactggaacctat

SEQ ID NO: 10522 - DNA, 201 bp, Homo sapiens
gtctatcccccccgaggtcaagttcaacaaaccctttgtcttcttaatgattgaacaaaataccaagtctcccctcttcatgggaaaagtggtgaatcccmcccaaaaataactgcctctcgctcctcaacccctcccctccatccctggccccctccctggatgacattaaagaagggttgagctggtccctgcctgcat

SEQ ID NO: 10523 - DNA, 201 bp, Homo sapiens
ctcgtggggcatcctcctgctggcaggcctgtgctgcctggtccctgtctccctggctgaggatccccagggagatgctgcccagaagacagatacatccmaccatgatcaggatcacccaaccttcaacaagatcacccccaacctggctgagttcgccttcagcctataccgccagctggcacaccagtccaacagcac

SEQ ID NO: 10524 - DNA, 201 bp, Homo sapiens
caagttcaacaaaccctttgtcttcttaatgattgaacaaaataccaagtctcccctcttcatgggaaaagtggtgaatcccacccaaaaataactgcctytcgctcctcaacccctcccctccatccctggccccctccctggatgacattaaagaagggttgagctggtccctgcctgcatgtgactgtaaatccctcc

SEQ ID NO: 10525 - DNA, 201 bp, Homo sapiens
ctttaaaggcaaatgggagagaccctttgaagtcaaggacaccgaggaagaggacttccacgtggaccaggcgaccaccgtgaaggtgcctatgatgaagygtttaggcatgtttaacatccagcactgtaagaagctgtccagctgggtgctgctgatgaaatacctgggcaatgccaccgccatcttcttcctgcctga

SEQ ID NO: 10526 - DNA, 201 bp, Homo sapiens
gcccagaagacagatacatcccaccatgatcaggatcacccaaccttcaacaagatcacccccaacctggctgagttcgccttcagcctataccgccagcyggcacaccagtccaacagcaccaatatcttcttctccccagtgagcatcgctacagcctttgcaatgctctccctggggaccaaggctgacactcacgat

SEQ ID NO: 10527 - DNA, 201 bp, Homo sapiens
cggcaatggcctgttcctcagcgagggcctgaagctagtggataagtttttggaggatgttaaaaagttgtaccactcagaagccttcactgtcaacttcrgggacaccgaagaggccaagaaacagatcaacgattacgtggagaagggtactcaagggaaaattgtggatttggtcaaggagcttgacagagacacagt

SEQ ID NO: 10528 - DNA, 201 bp, Homo sapiens
tgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccagcagcctcccccgttgcccctctggatccactgcttaaatacggac

SEQ ID NO: 10529 - DNA, 201 bp, Homo sapiens
tggataagtttttggaggatgttaaaaagttgtaccactcagaagccttcactgtcaacttcggggacaccgaagaggccaagaaacagatcaacgattasgtggagaagggtactcaagggaaaattgtggatttggtcaaggagcttgacagagacacagtttttgctctggtgaattacatcttctttaaaggcaaat

SEQ ID NO: 10530 - DNA, 201 bp, Homo sapiens
ccaaggccctgctaaaggacacagcagccaggaagtcccctgggcccctagctgaaggacagcctgctccctccgtctctaccaggaatggccttgtcctrtggaaggcactgccccatcccaaactaatctaggaatcactgtctaaccactcactgtcatgaatgtgtacttaaaggatgaggttgagtcataccaaat

SEQ ID NO: 10531 - DNA, 201 bp, Homo sapiens
cctgggtcaactgggcatcactaaggtcttcagcaatggggctgacctctccggggtcacagaggaggcacccctgaagctctccaaggccgtgcataagrctgtgctgaccatcgacgagaaagggactgaagctgctggggccatgtttttagaggccatacccatgtctatcccccccgaggtcaagttcaacaaacc

SEQ ID NO: 10532 - DNA, 201 bp, Homo sapiens
tttcaacctcacggagattccggaggctcagatccatgaaggcttccaggaactcctccgtaccctcaaccagccagacagccagctccagctgaccaccrgcaatggcctgttcctcagcgagggcctgaagctagtggataagtttttggaggatgttaaaaagttgtaccactcagaagccttcactgtcaacttcgg

SEQ ID NO: 10533 - DNA, 201 bp, Homo sapiens
gcacccctgaagctctccaaggccgtgcataaggctgtgctgaccatcgacgagaaagggactgaagctgctggggccatgtttttagaggccatacccakgtctatcccccccgaggtcaagttcaacaaaccctttgtcttcttaatgattgaacaaaataccaagtctcccctcttcatgggaaaagtggtgaatccc

SEQ ID NO: 10534 - DNA, 201 bp, Homo sapiens
ccatcgacgagaaagggactgaagctgctggggccatgtttttagaggccatacccatgtctatcccccccgaggtcaagttcaacaaaccctttgtcttyttaatgattgaacaaaataccaagtctcccctcttcatgggaaaagtggtgaatcccacccaaaaataactgcctctcgctcctcaacccctcccctcca

SEQ ID NO: 10535 - DNA, 201 bp, Homo sapiens
taggcctgctgatggctcaggaaggccattgcaaggactcctcagctatgggagaggaagcacatcacccattgacccccgcaacccctccctttcctccyctgagtcccgactggggccacatgcagcctgacttctttgtgcctgttgctgtccctgcagtcttcagagggccaccgcagctccagtgccacggcagga

SEQ ID NO: 10536 - DNA, 201 bp, Homo sapiens
gccttcagcctataccgccagctggcacaccagtccaacagcaccaatatcttcttctccccagtgagcatcgctacagcctttgcaatgctctccctggrgaccaaggctgacactcacgatgaaatcctggagggcctgaatttcaacctcacggagattccggaggctcagatccatgaaggcttccaggaactcctc

SEQ ID NO: 10537 - DNA, 201 bp, Homo sapiens
acagcctttgcaatgctctccctggggaccaaggctgacactcacgatgaaatcctggagggcctgaatttcaacctcacggagattccggaggctcagawccatgaaggcttccaggaactcctccgtaccctcaaccagccagacagccagctccagctgaccaccggcaatggcctgttcctcagcgagggcctgaag

SEQ ID NO: 10538 - DNA, 201 bp, Homo sapiens
gaagaggagggtctctgctttgttttctctatctcctcctcagacttgaccaggcccagcaggccccagaagaccattaccctatatcccttctcctcccyagtcacatggccataggcctgctgatggctcaggaaggccattgcaaggactcctcagctatgggagaggaagcacatcacccattgacccccgcaaccc

SEQ ID NO: 10539 - DNA, 201 bp, Homo sapiens
cacggagattccggaggctcagatccatgaaggcttccaggaactcctccgtaccctcaaccagccagacagccagctccagctgaccaccggcaatggcytgttcctcagcgagggcctgaagctagtggataagtttttggaggatgttaaaaagttgtaccactcagaagccttcactgtcaacttcggggacaccga

SEQ ID NO: 10540 - DNA, 201 bp, Homo sapiens
acagtttttgctctggtgaattacatcttctttaaaggcaaatgggagagaccctttgaagtcaaggacaccgaggaagaggacttccacgtggaccaggygaccaccgtgaaggtgcctatgatgaagcgtttaggcatgtttaacatccagcactgtaagaagctgtccagctgggtgctgctgatgaaatacctgggc

SEQ ID NO: 10541 - DNA, 201 bp, Homo sapiens
cacccaaccttcaacaagatcacccccaacctggctgagttcgccttcagcctataccgccagctggcacaccagtccaacagcaccaatatcttcttctycccagtgagcatcgctacagcctttgcaatgctctccctggggaccaaggctgacactcacgatgaaatcctggagggcctgaatttcaacctcacggag

SEQ ID NO: 10542 - DNA, 201 bp, Homo sapiens
gcatcttcatgtccccctgctcatcccccactcccccccacccagagttgctcatcctgccagggctggctgtgcccaccccaaggctgccctcctggggrccccagaactgcctgatcgtgccgtggcccagttttgtggcatctgcagcaacacaagagagaggacaatgtcctcctcttgacccgctgtcacctaacc

SEQ ID NO: 10543 - DNA, 201 bp, Homo sapiens
aagtcaaggacaccgaggaagaggacttccacgtggaccaggcgaccaccgtgaaggtgcctatgatgaagcgtttaggcatgtttaacatccagcactgkaagaagctgtccagctgggtgctgctgatgaaatacctgggcaatgccaccgccatcttcttcctgcctgatgaggggaaactacagcacctggaaaatg

SEQ ID NO: 10544 - DNA, 201 bp, Homo sapiens
ttctccccagtgagcatcgctacagcctttgcaatgctctccctggggaccaaggctgacactcacgatgaaatcctggagggcctgaatttcaacctcayggagattccggaggctcagatccatgaaggcttccaggaactcctccgtaccctcaaccagccagacagccagctccagctgaccaccggcaatggcctg

SEQ ID NO: 10545 - DNA, 201 bp, Homo sapiens
aggacaccgaggaagaggacttccacgtggaccaggcgaccaccgtgaaggtgcctatgatgaagcgtttaggcatgtttaacatccagcactgtaagaarctgtccagctgggtgctgctgatgaaatacctgggcaatgccaccgccatcttcttcctgcctgatgaggggaaactacagcacctggaaaatgaactca

SEQ ID NO: 10546 - DNA, 201 bp, Homo sapiens
ttcagcctataccgccagctggcacaccagtccaacagcaccaatatcttcttctccccagtgagcatcgctacagcctttgcaatgctctccctggggaycaaggctgacactcacgatgaaatcctggagggcctgaatttcaacctcacggagattccggaggctcagatccatgaaggcttccaggaactcctccgt

SEQ ID NO: 10547 - DNA, 201 bp, Homo sapiens
cacccacgatatcatcaccaagttcctggaaaatgaagacagaaggtctgccagcttacatttacccaaactgtccattactggaacctatgatctgaagwgcgtcctgggtcaactgggcatcactaaggtcttcagcaatggggctgacctctccggggtcacagaggaggcacccctgaagctctccaaggccgtgca

SEQ ID NO: 10548 - DNA, 201 bp, Homo sapiens
cgtttaggcatgtttaacatccagcactgtaagaagctgtccagctgggtgctgctgatgaaatacctgggcaatgccaccgccatcttcttcctgcctgwtgaggggaaactacagcacctggaaaatgaactcacccacgatatcatcaccaagttcctggaaaatgaagacagaaggtctgccagcttacatttaccc

SEQ ID NO: 10549 - DNA, 201 bp, Homo sapiens
accaaggctgacactcacgatgaaatcctggagggcctgaatttcaacctcacggagattccggaggctcagatccatgaaggcttccaggaactcctccrtaccctcaaccagccagacagccagctccagctgaccaccggcaatggcctgttcctcagcgagggcctgaagctagtggataagtttttggaggatgtt

SEQ ID NO: 10550 - DNA, 201 bp, Homo sapiens; identical to SEQ ID NO: 10504

SEQ ID NO: 10551 - DNA, 201 bp, Homo sapiens; identical to SEQ ID NO: 10505

SEQ ID NO: 10552 - DNA, 201 bp, Homo sapiens; identical to SEQ ID NO: 10506

SEQ ID NO: 10553 - DNA, 201 bp, Homo sapiens; identical to SEQ ID NO: 10507

SEQ ID NO: 10554 - DNA, 201 bp, Homo sapiens; identical to SEQ ID NO: 10508

SEQ ID NO: 10555 - DNA, 201 bp, Homo sapiens; identical to SEQ ID NO: 10509

SEQ ID NO: 10556 - DNA, 201 bp, Homo sapiens; identical to SEQ ID NO: 10510

SEQ ID NO: 10557 - DNA, 201 bp, Homo sapiens; identical to SEQ ID NO: 10511

SEQ ID NO: 10558 - DNA, 201 bp, Homo sapiens; identical to SEQ ID NO: 10512

SEQ ID NO: 10559 - DNA, 201 bp, Homo sapiens; identical to SEQ ID NO: 10513

SEQ ID NO: 10560 - DNA, 201 bp, Homo sapiens; identical to SEQ ID NO: 10514

SEQ ID NO: 10561 - DNA, 201 bp, Homo sapiens; identical to SEQ ID NO: 10515

SEQ ID NO: 10562 - DNA, 201 bp, Homo sapiens; identical to SEQ ID NO: 10516

SEQ ID NO: 10563 - DNA, 201 bp, Homo sapiens; identical to SEQ ID NO: 10517

SEQ ID NO: 10564 - DNA, 201 bp, Homo sapiens; identical to SEQ ID NO: 10518

SEQ ID NO: 10565 - DNA, 201 bp, Homo sapiens; identical to SEQ ID NO: 10519

SEQ ID NO: 10566 - DNA, 201 bp, Homo sapiens; identical to SEQ ID NO: 10520

SEQ ID NO: 10567 - DNA, 201 bp, Homo sapiens; identical to SEQ ID NO: 10521

SEQ ID NO: 10568 - DNA, 201 bp, Homo sapiens; identical to SEQ ID NO: 10522

SEQ ID NO: 10569 - DNA, 201 bp, Homo sapiens; identical to SEQ ID NO: 10523

SEQ ID NO: 10570 - DNA, 201 bp, Homo sapiens; identical to SEQ ID NO: 10524

SEQ ID NO: 10571 - DNA, 201 bp, Homo sapiens; identical to SEQ ID NO: 10525

SEQ ID NO: 10572 - DNA, 201 bp, Homo sapiens; identical to SEQ ID NO: 10526

SEQ ID NO: 10573 - DNA, 201 bp, Homo sapiens; identical to SEQ ID NO: 10527

SEQ ID NO: 10574 - DNA, 201 bp, Homo sapiens; identical to SEQ ID NO: 10529

SEQ ID NO: 10575 - DNA, 201 bp, Homo sapiens; identical to SEQ ID NO: 10530

SEQ ID NO: 10576 - DNA, 201 bp, Homo sapiens; identical to SEQ ID NO: 10531

SEQ ID NO: 10577 - DNA, 201 bp, Homo sapiens; identical to SEQ ID NO: 10532

SEQ ID NO: 10578 - DNA, 201 bp, Homo sapiens; identical to SEQ ID NO: 10533

SEQ ID NO: 10579 - DNA, 201 bp, Homo sapiens; identical to SEQ ID NO: 10534

SEQ ID NO: 10580 - DNA, 201 bp, Homo sapiens; identical to SEQ ID NO: 10535

SEQ ID NO: 10581 - DNA, 201 bp, Homo sapiens; identical to SEQ ID NO: 10536

SEQ ID NO: 10582 - DNA, 201 bp, Homo sapiens; identical to SEQ ID NO: 10537

SEQ ID NO: 10583 - DNA, 201 bp, Homo sapiens; identical to SEQ ID NO: 10538

SEQ ID NO: 10584 - DNA, 201 bp, Homo sapiens; identical to SEQ ID NO: 10539

SEQ ID NO: 10585 - DNA, 201 bp, Homo sapiens; identical to SEQ ID NO: 10540

SEQ ID NO: 10586 - DNA, 201 bp, Homo sapiens; identical to SEQ ID NO: 10541

SEQ ID NO: 10587 - DNA, 201 bp, Homo sapiens; identical to SEQ ID NO: 10542

SEQ ID NO: 10588 - DNA, 201 bp, Homo sapiens; identical to SEQ ID NO: 10543

SEQ ID NO: 10589 - DNA, 201 bp, Homo sapiens; identical to SEQ ID NO: 10544

SEQ ID NO: 10590 - DNA, 201 bp, Homo sapiens; identical to SEQ ID NO: 10545

SEQ ID NO: 10591 - DNA, 201 bp, Homo sapiens; identical to SEQ ID NO: 10546

SEQ ID NO: 10592 - DNA, 201 bp, Homo sapiens; identical to SEQ ID NO: 10547

SEQ ID NO: 10593 - DNA, 201 bp, Homo sapiens; identical to SEQ ID NO: 10548

SEQ ID NO: 10594 - DNA, 201 bp, Homo sapiens; identical to SEQ ID NO: 10549

SEQ ID NO: 10595 - DNA, 201 bp, Homo sapiens; identical to SEQ ID NO: 10504

SEQ ID NO: 10596 - DNA, 201 bp, Homo sapiens; identical to SEQ ID NO: 10505

SEQ ID NO: 10597 - DNA, 201 bp, Homo sapiens; identical to SEQ ID NO: 10506

SEQ ID NO: 10598 - DNA, 201 bp, Homo sapiens; identical to SEQ ID NO: 10507

SEQ ID NO: 10599 - DNA, 201 bp, Homo sapiens
ttcaaggagagatgagcgtctctaaagcccctgacagcaagagcccagaactgggacaccattagtgacccagacggcaggacaatgccgtcttctgtctygtggggcatcctcctgctggcaggcctgtgctgcctggtccctgtctccctggctgaggatccccagggagatgctgcccagaagacagatacatcccac

SEQ ID NO: 10600 - DNA, 201 bp, Homo sapiens; identical to SEQ ID NO: 10509

SEQ ID NO: 10601 - DNA, 201 bp, Homo sapiens; identical to SEQ ID NO: 10510

SEQ ID NO: 10602 - DNA, 201 bp, Homo sapiens; identical to SEQ ID NO: 10511

SEQ ID NO: 10603 - DNA, 201 bp, Homo sapiens; identical to SEQ ID NO: 10512

SEQ ID NO: 10604 - DNA, 201 bp, Homo sapiens; identical to SEQ ID NO: 10513

SEQ ID NO: 10605 - DNA, 201 bp, Homo sapiens; identical to SEQ ID NO: 10514

SEQ ID NO: 10606 - DNA, 201 bp, Homo sapiens; identical to SEQ ID NO: 10515

SEQ ID NO: 10607 - DNA, 201 bp, Homo sapiens; identical to SEQ ID NO: 10516

SEQ ID NO: 10608 - DNA, 201 bp, Homo sapiens; identical to SEQ ID NO: 10518

SEQ ID NO: 10609 - DNA, 201 bp, Homo sapiens; identical to SEQ ID NO: 10519

SEQ ID NO: 10610 - DNA, 201 bp, Homo sapiens; identical to SEQ ID NO: 10520

SEQ ID NO: 10611 - DNA, 201 bp, Homo sapiens; identical to SEQ ID NO: 10521

SEQ ID NO: 10612 - DNA, 201 bp, Homo sapiens; identical to SEQ ID NO: 10522

SEQ ID NO: 10613 - DNA, 201 bp, Homo sapiens; identical to SEQ ID NO: 10523

SEQ ID NO: 10614 - DNA, 201 bp, Homo sapiens; identical to SEQ ID NO: 10524

SEQ ID NO: 10615 - DNA, 201 bp, Homo sapiens; identical to SEQ ID NO: 10525

SEQ ID NO: 10616 - DNA, 201 bp, Homo sapiens; identical to SEQ ID NO: 10526

SEQ ID NO: 10617 - DNA, 201 bp, Homo sapiens; identical to SEQ ID NO: 10527

SEQ ID NO: 10618 - DNA, 201 bp, Homo sapiens; identical to SEQ ID NO: 10529

SEQ ID NO: 10619 - DNA, 201 bp, Homo sapiens; identical to SEQ ID NO: 10530

SEQ ID NO: 10620 - DNA, 201 bp, Homo sapiens; identical to SEQ ID NO: 10531

SEQ ID NO: 10621 - DNA, 201 bp, Homo sapiens; identical to SEQ ID NO: 10532

SEQ ID NO: 10622 - DNA, 201 bp, Homo sapiens; identical to SEQ ID NO: 10533

SEQ ID NO: 10623 - DNA, 201 bp, Homo sapiens; identical to SEQ ID NO: 10534

SEQ ID NO: 10624 - DNA, 201 bp, Homo sapiens; identical to SEQ ID NO: 10535

SEQ ID NO: 10625 - DNA, 201 bp, Homo sapiens; identical to SEQ ID NO: 10536

SEQ ID NO: 10626 - DNA, 201 bp, Homo sapiens; identical to SEQ ID NO: 10537

SEQ ID NO: 10627 - DNA, 201 bp, Homo sapiens; identical to SEQ ID NO: 10538

SEQ ID NO: 10628 - DNA, 201 bp, Homo sapiens; identical to SEQ ID NO: 10539

SEQ ID NO: 10629 - DNA, 201 bp, Homo sapiens; identical to SEQ ID NO: 10540

SEQ ID NO: 10630 - DNA, 201 bp, Homo sapiens; identical to SEQ ID NO: 10541

SEQ ID NO: 10631 - DNA, 201 bp, Homo sapiens; identical to SEQ ID NO: 10542

SEQ ID NO: 10632 - DNA, 201 bp, Homo sapiens; identical to SEQ ID NO: 10543

SEQ ID NO: 10633 - DNA, 201 bp, Homo sapiens; identical to SEQ ID NO: 10544

SEQ ID NO: 10634 - DNA, 201 bp, Homo sapiens; identical to SEQ ID NO: 10545

SEQ ID NO: 10635 - DNA, 201 bp, Homo sapiens; identical to SEQ ID NO: 10546

SEQ ID NO: 10636 - DNA, 201 bp, Homo sapiens; identical to SEQ ID NO: 10547

SEQ ID NO: 10637 - DNA, 201 bp, Homo sapiens; identical to SEQ ID NO: 10548

SEQ ID NO: 10638 - DNA, 201 bp, Homo sapiens; identical to SEQ ID NO: 10549

SEQ ID NO: 10639 - DNA, 201 bp, Homo sapiens
ctcctcagcttcaggcaccaccactgacctgggacagtgaatctgttactgatgtcggcaagtacttggcacaggctggtttaataatccctaggcacttycacgtggtgtcaatccctgatcactgggagtcatcatgtgccttgactcggggcctggcccccccatctctgtcttgcaggacaatgccgtcttctgtct

SEQ ID NO: 10640 - DNA, 201 bp, Homo sapiens; identical to SEQ ID NO: 10504

SEQ ID NO: 10641 - DNA, 201 bp, Homo sapiens; identical to SEQ ID NO: 10505

SEQ ID NO: 10642 - DNA, 201 bp, Homo sapiens; identical to SEQ ID NO: 10506

SEQ ID NO: 10643 - DNA, 201 bp, Homo sapiens; identical to SEQ ID NO: 10507

SEQ ID NO: 10644 - DNA, 201 bp, Homo sapiens
cacgtggtgtcaatccctgatcactgggagtcatcatgtgccttgactcggggcctggcccccccatctctgtcttgcaggacaatgccgtcttctgtctygtggggcatcctcctgctggcaggcctgtgctgcctggtccctgtctccctggctgaggatccccagggagatgctgcccagaagacagatacatcccac

SEQ ID NO: 10645 - DNA, 201 bp, Homo sapiens; identical to SEQ ID NO: 10509

SEQ ID NO: 10646 - DNA, 201 bp, Homo sapiens; identical to SEQ ID NO: 10510

SEQ ID NO: 10647 - DNA, 201 bp, Homo sapiens; identical to SEQ ID NO: 10511

SEQ ID NO: 10648 - DNA, 201 bp, Homo sapiens; identical to SEQ ID NO: 10512

SEQ ID NO: 10649 - DNA, 201 bp, Homo sapiens; identical to SEQ ID NO: 10513

SEQ ID NO: 10650 - DNA, 201 bp, Homo sapiens; identical to SEQ ID NO: 10514

SEQ ID NO: 10651 - DNA, 201 bp, Homo sapiens; identical to SEQ ID NO: 10515

SEQ ID NO: 10652 - DNA, 201 bp, Homo sapiens; identical to SEQ ID NO: 10516

SEQ ID NO: 10653 - DNA, 201 bp, Homo sapiens; identical to SEQ ID NO: 10518

SEQ ID NO: 10654 - DNA, 201 bp, Homo sapiens; identical to SEQ ID NO: 10519

SEQ ID NO: 10655 - DNA, 201 bp, Homo sapiens; identical to SEQ ID NO: 10520

SEQ ID NO: 10656 - DNA, 201 bp, Homo sapiens; identical to SEQ ID NO: 10521

SEQ ID NO: 10657 - DNA, 201 bp, Homo sapiens; identical to SEQ ID NO: 10522

SEQ ID NO: 10658 - DNA, 201 bp, Homo sapiens; identical to SEQ ID NO: 10523

SEQ ID NO: 10659 - DNA, 201 bp, Homo sapiens; identical to SEQ ID NO: 10524

SEQ ID NO: 10660 - DNA, 201 bp, Homo sapiens; identical to SEQ ID NO: 10525

SEQ ID NO: 10661 - DNA, 201 bp, Homo sapiens; identical to SEQ ID NO: 10526

SEQ ID NO: 10662 - DNA, 201 bp, Homo sapiens; identical to SEQ ID NO: 10527

SEQ ID NO: 10663 - DNA, 201 bp, Homo sapiens
tgtctcctcagcttcaggcaccaccactgacctgggacagtgaatctgttactgatgtcggcaagtacttggcacaggctggtttaataatccctaggcayttccacgtggtgtcaatccctgatcactgggagtcatcatgtgccttgactcggggcctggcccccccatctctgtcttgcaggacaatgccgtcttctg

SEQ ID NO: 10664 - DNA, 201 bp, Homo sapiens; identical to SEQ ID NO: 10529

SEQ ID NO: 10665 - DNA, 201 bp, Homo sapiens; identical to SEQ ID NO: 10530

SEQ ID NO: 10666 - DNA, 201 bp, Homo sapiens; identical to SEQ ID NO: 10531

SEQ ID NO: 10667 - DNA, 201 bp, Homo sapiens; identical to SEQ ID NO: 10532

SEQ ID NO: 10668 - DNA, 201 bp, Homo sapiens; identical to SEQ ID NO: 10533

SEQ ID NO: 10669 - DNA, 201 bp, Homo sapiens; identical to SEQ ID NO: 10534

SEQ ID NO: 10670 - DNA, 201 bp, Homo sapiens; identical to SEQ ID NO: 10535

SEQ ID NO: 10671 - DNA, 201 bp, Homo sapiens; identical to SEQ ID NO: 10536

SEQ ID NO: 10672 - DNA, 201 bp, Homo sapiens; identical to SEQ ID NO: 10537

SEQ ID NO: 10673 - DNA, 201 bp, Homo sapiens; identical to SEQ ID NO: 10538

SEQ ID NO: 10674 - DNA, 201 bp, Homo sapiens; identical to SEQ ID NO: 10539

SEQ ID NO: 10675 - DNA, 201 bp, Homo sapiens; identical to SEQ ID NO: 10540

SEQ ID NO: 10676 - DNA, 201 bp, Homo sapiens; identical to SEQ ID NO: 10541

SEQ ID NO: 10677 - DNA, 201 bp, Homo sapiens; identical to SEQ ID NO: 10542

SEQ ID NO: 10678 - DNA, 201 bp, Homo sapiens; identical to SEQ ID NO: 10543

SEQ ID NO: 10679 - DNA, 201 bp, Homo sapiens; identical to SEQ ID NO: 10544

SEQ ID NO: 10680 - DNA, 201 bp, Homo sapiens; identical to SEQ ID NO: 10545

SEQ ID NO: 10681 - DNA, 201 bp, Homo sapiens; identical to SEQ ID NO: 10546

SEQ ID NO: 10682 - DNA, 201 bp, Homo sapiens; identical to SEQ ID NO: 10547

SEQ ID NO: 10683 - DNA, 201 bp, Homo sapiens; identical to SEQ ID NO: 10548

SEQ ID NO: 10684 - DNA, 201 bp, Homo sapiens; identical to SEQ ID NO: 10549

SEQ ID NO: 10685 - DNA, 201 bp, Homo sapiens; identical to SEQ ID NO: 10504

SEQ ID NO: 10686 - DNA, 201 bp, Homo sapiens; identical to SEQ ID NO: 10505

SEQ ID NO: 10687 - DNA, 201 bp, Homo sapiens; identical to SEQ ID NO: 10506

SEQ ID NO: 10688 - DNA, 201 bp, Homo sapiens; identical to SEQ ID NO: 10507

SEQ ID NO: 10689 - DNA, 201 bp, Homo sapiens
ctcctgccagccttcaggccactctcctgtgcctgccagaagagacagagcttgaggagagcttgaggagagcaggaaaggacaatgccgtcttctgtctygtggggcatcctcctgctggcaggcctgtgctgcctggtccctgtctccctggctgaggatccccagggagatgctgcccagaagacagatacatcccac

SEQ ID NO: 10690 - DNA, 201 bp, Homo sapiens; identical to SEQ ID NO: 10509

SEQ ID NO: 10691 - DNA, 201 bp, Homo sapiens; identical to SEQ ID NO: 10510

SEQ ID NO: 10692 - DNA, 201 bp, Homo sapiens; identical to SEQ ID NO: 10511

SEQ ID NO: 10693 - DNA, 201 bp, Homo sapiens; identical to SEQ ID NO: 10512

SEQ ID NO: 10694 - DNA, 201 bp, Homo sapiens; identical to SEQ ID NO: 10513

SEQ ID NO: 10695 - DNA, 201 bp, Homo sapiens; identical to SEQ ID NO: 10514

SEQ ID NO: 10696 - DNA, 201 bp, Homo sapiens; identical to SEQ ID NO: 10515

SEQ ID NO: 10697 - DNA, 201 bp, Homo sapiens; identical to SEQ ID NO: 10516

SEQ ID NO: 10698 - DNA, 201 bp, Homo sapiens; identical to SEQ ID NO: 10517

SEQ ID NO: 10699 - DNA, 201 bp, Homo sapiens; identical to SEQ ID NO: 10518

SEQ ID NO: 10700 - DNA, 201 bp, Homo sapiens; identical to SEQ ID NO: 10519

SEQ ID NO: 10701 - DNA, 201 bp, Homo sapiens; identical to SEQ ID NO: 10520

SEQ ID NO: 10702 - DNA, 201 bp, Homo sapiens; identical to SEQ ID NO: 10521

SEQ ID NO: 10703 - DNA, 201 bp, Homo sapiens; identical to SEQ ID NO: 10522

SEQ ID NO: 10704 - DNA, 201 bp, Homo sapiens; identical to SEQ ID NO: 10523

SEQ ID NO: 10705 - DNA, 201 bp, Homo sapiens; identical to SEQ ID NO: 10524

SEQ ID NO: 10706 - DNA, 201 bp, Homo sapiens; identical to SEQ ID NO: 10525

SEQ ID NO: 10707 - DNA, 201 bp, Homo sapiens; identical to SEQ ID NO: 10526

SEQ ID NO: 10708 - DNA, 201 bp, Homo sapiens; identical to SEQ ID NO: 10527

SEQ ID NO: 10709 - DNA, 201 bp, Homo sapiens; identical to SEQ ID NO: 10529

SEQ ID NO: 10710 - DNA, 201 bp, Homo sapiens; identical to SEQ ID NO: 10530

SEQ ID NO: 10711 - DNA, 201 bp, Homo sapiens; identical to SEQ ID NO: 10531

SEQ ID NO: 10712 - DNA, 201 bp, Homo sapiens; identical to SEQ ID NO: 10532

SEQ ID NO: 10713 - DNA, 201 bp, Homo sapiens; identical to SEQ ID NO: 10533

SEQ ID NO: 10714 - DNA, 201 bp, Homo sapiens; identical to SEQ ID NO: 10534

SEQ ID NO: 10715 - DNA, 201 bp, Homo sapiens; identical to SEQ ID NO: 10535

SEQ ID NO: 10716 - DNA, 201 bp, Homo sapiens; identical to SEQ ID NO: 10536

SEQ ID NO: 10717 - DNA, 201 bp, Homo sapiens; identical to SEQ ID NO: 10537

SEQ ID NO: 10718 - DNA, 201 bp, Homo sapiens; identical to SEQ ID NO: 10538

SEQ ID NO: 10719 - DNA, 201 bp, Homo sapiens; identical to SEQ ID NO: 10539

SEQ ID NO: 10720 - DNA, 201 bp, Homo sapiens; identical to SEQ ID NO: 10540

SEQ ID NO: 10721 - DNA, 201 bp, Homo sapiens; identical to SEQ ID NO: 10541

SEQ ID NO: 10722 - DNA, 201 bp, Homo sapiens; identical to SEQ ID NO: 10542

SEQ ID NO: 10723 - DNA, 201 bp, Homo sapiens; identical to SEQ ID NO: 10543

SEQ ID NO: 10724 - DNA, 201 bp, Homo sapiens; identical to SEQ ID NO: 10544

SEQ ID NO: 10725 - DNA, 201 bp, Homo sapiens; identical to SEQ ID NO: 10545

SEQ ID NO: 10726 - DNA, 201 bp, Homo sapiens; identical to SEQ ID NO: 10546

SEQ ID NO: 10727 - DNA, 201 bp, Homo sapiens; identical to SEQ ID NO: 10547

SEQ ID NO: 10728 - DNA, 201 bp, Homo sapiens; identical to SEQ ID NO: 10548

SEQ ID NO: 10729 - DNA, 201 bp, Homo sapiens; identical to SEQ ID NO: 10549

SEQ ID NO: 10730 - DNA, 201 bp, Homo sapiens; identical to SEQ ID NO: 10504

SEQ ID NO: 10731 - DNA, 201 bp, Homo sapiens; identical to SEQ ID NO: 10505

SEQ ID NO: 10732 - DNA, 201 bp, Homo sapiens; identical to SEQ ID NO: 10506

SEQ ID NO: 10733 - DNA, 201 bp, Homo sapiens; identical to SEQ ID NO: 10507

SEQ ID NO: 10734 - DNA, 201 bp, Homo sapiens; identical to SEQ ID NO: 10508

SEQ ID NO: 10735 - DNA, 201 bp, Homo sapiens; identical to SEQ ID NO: 10509

SEQ ID NO: 10736 - DNA, 201 bp, Homo sapiens; identical to SEQ ID NO: 10510

SEQ ID NO: 10737 - DNA, 201 bp, Homo sapiens; identical to SEQ ID NO: 10511

SEQ ID NO: 10738 - DNA, 201 bp, Homo sapiens; identical to SEQ ID NO: 10512

SEQ ID NO: 10739 - DNA, 201 bp, Homo sapiens; identical to SEQ ID NO: 10513

SEQ ID NO: 10740 - DNA, 201 bp, Homo sapiens; identical to SEQ ID NO: 10514

SEQ ID NO: 10741 - DNA, 201 bp, Homo sapiens; identical to SEQ ID NO: 10515

SEQ ID NO: 10742 - DNA, 201 bp, Homo sapiens; identical to SEQ ID NO: 10516

SEQ ID NO: 10743 - DNA, 201 bp, Homo sapiens; identical to SEQ ID NO: 10517

SEQ ID NO: 10744 - DNA, 201 bp, Homo sapiens; identical to SEQ ID NO: 10518

SEQ ID NO: 10745 - DNA, 201 bp, Homo sapiens; identical to SEQ ID NO: 10519

SEQ ID NO: 10746 - DNA, 201 bp, Homo sapiens; identical to SEQ ID NO: 10520

SEQ ID NO: 10747 - DNA, 201 bp, Homo sapiens; identical to SEQ ID NO: 10521

SEQ ID NO: 10748 - DNA, 201 bp, Homo sapiens; identical to SEQ ID NO: 10522

SEQ ID NO: 10749 - DNA, 201 bp, Homo sapiens; identical to SEQ ID NO: 10523

SEQ ID NO: 10750 - DNA, 201 bp, Homo sapiens; identical to SEQ ID NO: 10524

SEQ ID NO: 10751 - DNA, 201 bp, Homo sapiens; identical to SEQ ID NO: 10525

SEQ ID NO: 10752 - DNA, 201 bp, Homo sapiens; identical to SEQ ID NO: 10526

SEQ ID NO: 10753 - DNA, 201 bp, Homo sapiens; identical to SEQ ID NO: 10527

SEQ ID NO: 10754 - DNA, 201 bp, Homo sapiens
tgactcagtaaatggtagatcttgctaccagtggaacagccactaaggattctgcagtgagagcagagggccagctaagtggtactctcccagagactgtstgactcacgccaccccctccaccttggacacaggacgctgtggtttctgagccaggtacaatgactcctttcgcagcctcccccgttgcccctctggatc

SEQ ID NO: 10755 - DNA, 201 bp, Homo sapiens; identical to SEQ ID NO: 10529

SEQ ID NO: 10756 - DNA, 201 bp, Homo sapiens; identical to SEQ ID NO: 10530

SEQ ID NO: 10757 - DNA, 201 bp, Homo sapiens; identical to SEQ ID NO: 10531

SEQ ID NO: 10758 - DNA, 201 bp, Homo sapiens; identical to SEQ ID NO: 10532

SEQ ID NO: 10759 - DNA, 201 bp, Homo sapiens; identical to SEQ ID NO: 10533

SEQ ID NO: 10760 - DNA, 201 bp, Homo sapiens; identical to SEQ ID NO: 10534

SEQ ID NO: 10761 - DNA, 201 bp, Homo sapiens; identical to SEQ ID NO: 10535

SEQ ID NO: 10762 - DNA, 201 bp, Homo sapiens; identical to SEQ ID NO: 10536

SEQ ID NO: 10763 - DNA, 201 bp, Homo sapiens; identical to SEQ ID NO: 10537

SEQ ID NO: 10764 - DNA, 201 bp, Homo sapiens; identical to SEQ ID NO: 10538

SEQ ID NO: 10765 - DNA, 201 bp, Homo sapiens; identical to SEQ ID NO: 10539

SEQ ID NO: 10766 - DNA, 201 bp, Homo sapiens; identical to SEQ ID NO: 10540

SEQ ID NO: 10767 - DNA, 201 bp, Homo sapiens; identical to SEQ ID NO: 10541

SEQ ID NO: 10768 - DNA, 201 bp, Homo sapiens; identical to SEQ ID NO: 10542

SEQ ID NO: 10769 - DNA, 201 bp, Homo sapiens; identical to SEQ ID NO: 10543

SEQ ID NO: 10770 - DNA, 201 bp, Homo sapiens; identical to SEQ ID NO: 10544

SEQ ID NO: 10771 - DNA, 201 bp, Homo sapiens; identical to SEQ ID NO: 10545

SEQ ID NO: 10772 - DNA, 201 bp, Homo sapiens; identical to SEQ ID NO: 10546

SEQ ID NO: 10773 - DNA, 201 bp, Homo sapiens; identical to SEQ ID NO: 10547

SEQ ID NO: 10774 - DNA, 201 bp, Homo sapiens; identical to SEQ ID NO: 10548

SEQ ID NO: 10775 - DNA, 201 bp, Homo sapiens; identical to SEQ ID NO: 10549

SEQ ID NO: 10776 - DNA, 201 bp, Homo sapiens; identical to SEQ ID NO: 10504

SEQ ID NO: 10777 - DNA, 201 bp, Homo sapiens; identical to SEQ ID NO: 10505

SEQ ID NO: 10778 - DNA, 201 bp, Homo sapiens; identical to SEQ ID NO: 10506

SEQ ID NO: 10779 - DNA, 201 bp, Homo sapiens; identical to SEQ ID NO: 10507

SEQ ID NO: 10780 - DNA, 201 bp, Homo sapiens; identical to SEQ ID NO: 10508

SEQ ID NO: 10781 - DNA, 201 bp, Homo sapiens; identical to SEQ ID NO: 10509

SEQ ID NO: 10782 - DNA, 201 bp, Homo sapiens; identical to SEQ ID NO: 10510

SEQ ID NO: 10783 - DNA, 201 bp, Homo sapiens; identical to SEQ ID NO: 10511

SEQ ID NO: 10784 - DNA, 201 bp, Homo sapiens; identical to SEQ ID NO: 10512

SEQ ID NO: 10785 - DNA, 201 bp, Homo sapiens; identical to SEQ ID NO: 10513

SEQ ID NO: 10786 - DNA, 201 bp, Homo sapiens; identical to SEQ ID NO: 10514

SEQ ID NO: 10787 - DNA, 201 bp, Homo sapiens; identical to SEQ ID NO: 10515

SEQ ID NO: 10788 - DNA, 201 bp, Homo sapiens; identical to SEQ ID NO: 10516

SEQ ID NO: 10789 - DNA, 201 bp, Homo sapiens; identical to SEQ ID NO: 10518

SEQ ID NO: 10790 - DNA, 201 bp, Homo sapiens; identical to SEQ ID NO: 10519

SEQ ID NO: 10791 - DNA, 201 bp, Homo sapiens; identical to SEQ ID NO: 10520

SEQ ID NO: 10792 - DNA, 201 bp, Homo sapiens; identical to SEQ ID NO: 10521

SEQ ID NO: 10793 - DNA, 201 bp, Homo sapiens; identical to SEQ ID NO: 10522

SEQ ID NO: 10794 - DNA, 201 bp, Homo sapiens; identical to SEQ ID NO: 10523

SEQ ID NO: 10795 - DNA, 201 bp, Homo sapiens; identical to SEQ ID NO: 10524

SEQ ID NO: 10796 - DNA, 201 bp, Homo sapiens; identical to SEQ ID NO: 10525

SEQ ID NO: 10797 - DNA, 201 bp, Homo sapiens; identical to SEQ ID NO: 10526

SEQ ID NO: 10798 - DNA, 201 bp, Homo sapiens; identical to SEQ ID NO: 10527

SEQ ID NO: 10799 - DNA, 201 bp, Homo sapiens; identical to SEQ ID NO: 10529

SEQ ID NO: 10800 - DNA, 201 bp, Homo sapiens; identical to SEQ ID NO: 10530

SEQ ID NO: 10801 - DNA, 201 bp, Homo sapiens; identical to SEQ ID NO: 10531

SEQ ID NO: 10802 - DNA, 201 bp, Homo sapiens; identical to SEQ ID NO: 10532

SEQ ID NO: 10803 - DNA, 201 bp, Homo sapiens; identical to SEQ ID NO: 10533

SEQ ID NO: 10804 - DNA, 201 bp, Homo sapiens; identical to SEQ ID NO: 10534

SEQ ID NO: 10805 - DNA, 201 bp, Homo sapiens; identical to SEQ ID NO: 10535

SEQ ID NO: 10806 - DNA, 201 bp, Homo sapiens; identical to SEQ ID NO: 10536

SEQ ID NO: 10807 - DNA, 201 bp, Homo sapiens; identical to SEQ ID NO: 10537

SEQ ID NO: 10808 - DNA, 201 bp, Homo sapiens; identical to SEQ ID NO: 10538

SEQ ID NO: 10809 - DNA, 201 bp, Homo sapiens; identical to SEQ ID NO: 10539

SEQ ID NO: 10810 - DNA, 201 bp, Homo sapiens; identical to SEQ ID NO: 10540

SEQ ID NO: 10811 - DNA, 201 bp, Homo sapiens; identical to SEQ ID NO: 10541

SEQ ID NO: 10812 - DNA, 201 bp, Homo sapiens; identical to SEQ ID NO: 10542

SEQ ID NO: 10813 - DNA, 201 bp, Homo sapiens; identical to SEQ ID NO: 10543

SEQ ID NO: 10814 - DNA, 201 bp, Homo sapiens; identical to SEQ ID NO: 10544

SEQ ID NO: 10815 - DNA, 201 bp, Homo sapiens; identical to SEQ ID NO: 10545

SEQ ID NO: 10816 - DNA, 201 bp, Homo sapiens; identical to SEQ ID NO: 10546

SEQ ID NO: 10817 - DNA, 201 bp, Homo sapiens; identical to SEQ ID NO: 10547

SEQ ID NO: 10818 - DNA, 201 bp, Homo sapiens; identical to SEQ ID NO: 10548

SEQ ID NO: 10819 - DNA, 201 bp, Homo sapiens; identical to SEQ ID NO: 10549

SEQ ID NO: 10820 - DNA, 201 bp, Homo sapiens
cttgggtctgagtaatgcgaagctttcatattatgatgggatgatccaactgaactacagaggcggcacaccctataacaatgaaagacacacaccgagarctacgctcatcacctttctctgtgatcgagacgcgggagtgggcttccctgaatatcaggaagaggataactccacctacaacttccggtggtacaccag

SEQ ID NO: 10821 - DNA, 201 bp, Homo sapiens
aaaactaatatcacacttgtatgcaagccaggtgatctggaaagtgcaccagtgttgagaacttctggggaaggcggttgcttttatgagtttgagtggcrcacagctgcggcctgtgtgctgtctaagacagaaggggagaactgcacggtctttgactcccaggcagggttttcttttgacttatcacctctcacaaag

SEQ ID NO: 10822 - DNA, 201 bp, Homo sapiens
actggtggttatgaggcttatgatgagagtgaggatgatgcctccgataccaaccctgatttctacatcaatatttgtcagccactaaatcccatgcacgsagtgccctgtcctgccggagccgctgtgtgcaaagttcctattgatggtccccccatagatatcggccgggtagcaggaccaccaatactcaatccaata

SEQ ID NO: 10823 - DNA, 201 bp, Homo sapiens
aggtggcaaaaagtgatgagaagacttggaacttgggtctgagtaatgcgaagctttcatattatgatgggatgatccaactgaactacagaggcggcacrccctataacaatgaaagacacacaccgagagctacgctcatcacctttctctgtgatcgagacgcgggagtgggcttccctgaatatcaggaagaggata

SEQ ID NO: 10824 - DNA, 201 bp, Homo sapiens
gaattggaagccagcaaggccagtcggaattgagaaaagcctccagctgtccacagagggcttcatcactctgacctacaaagggcctctctctgccaaasgtaccgctgatgcttttatcgtccgctttgtttgcaatgatgatgtttactcagggcccctcaaattcctgcatcaagatatcgactctgggcaagggat

SEQ ID NO: 10825 - DNA, 201 bp, Homo sapiens
cacctccgcctttgccctggcggcgcgaccccgtcccgggcgcggcccccagcagtcgcgcgccgttagcctcgcgcccgccgcgcagtccgggccccgcscgatgggggccgccgccggccggagcccccacctggggcccgcgcccgcccgccgcccgcagcgctctctgctcctgctgcagctgctgctgctcgtcgc

SEQ ID NO: 10826 - DNA, 201 bp, Homo sapiens
ctccacctccgcctttgccctggcggcgcgaccccgtcccgggcgcggcccccagcagtcgcgcgccgttagcctcgcgcccgccgcgcagtccgggcccsgcccgatgggggccgccgccggccggagcccccacctggggcccgcgcccgcccgccgcccgcagcgctctctgctcctgctgcagctgctgctgctcgt

SEQ ID NO: 10827 - DNA, 201 bp, Homo sapiens
ctggagccaacatatgccaggtgaagcccaacgatcagcacttcagtcggaaagttggaacctctgacaagaccaagtactaccttcaagacggcgatctygatgtcgtgtttgcctcttcctctaagtgcggaaaggataagaccaagtctgtttcttccaccatcttcttccactgtgaccctctggtggaggacggga

SEQ ID NO: 10828 - DNA, 201 bp, Homo sapiens
caaataaggaggtgccatgctatgtgtttgatgaagagttgaggaagcatgatctcaatcctctgatcaagcttagtggtgcctacttggtggatgactcygatccggacacttctctattcatcaatgtttgtagagacatagacacactacgagacccaggttcacagctgcgggcctgtccccccggcactgccgcct

SEQ ID NO: 10829 - DNA, 201 bp, Homo sapiens
ccaggtcctgcagctggtgtacaaggatgggtccccttgtccctccaaatccggcctgagctataagagtgtgatcagtttcgtgtgcaggcctgaggccrggccaaccaataggcccatgctcatctccctggacaagcagacatgcactctcttcttctcctggcacacgccgctggcctgcgagcaagcgaccgaatg

SEQ ID NO: 10830 - DNA, 201 bp, Homo sapiens
acgagacccaggttcacagctgcgggcctgtccccccggcactgccgcctgcctggtaagaggacaccaggcgtttgatgttggccagccccgggacggastgaagctggtgcgcaaggacaggcttgtcctgagttacgtgagggaagaggcaggaaagctagacttttgtgatggtcacagccctgcggtgactattac

SEQ ID NO: 10831 - DNA, 201 bp, Homo sapiens
ctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagat

SEQ ID NO: 10832 - DNA, 176 bp, Homo sapiens
tattgctgagaagcaaaccgccctgcagcatccctcagcctgtaccggtttggctggcttgtttgatttcaacatgagtgtattttttaaaattgattttkctcttcatttttttttcaatcaactttactgtaatataaagtattcaacaatttcaataaaagataaattattaa

SEQ ID NO: 10833 - DNA, 201 bp, Homo sapiens
aagttgtctgccctccaaagaagttggagtgcaaattcgtccagaaacacaaaacctacgacctgcggctgctctcctctctcaccgggtcctggtccctsgtccacaacggagtctcgtactatataaatctgtgccagaaaatatataaagggcccctgggctgctctgaaagggccagcatttgcagaaggaccacaa

SEQ ID NO: 10834 - DNA, 201 bp, Homo sapiens
cctgccacagagattacctggaaagtaaaacttgttctctgagcggcgagcagcaggatgtctccatagacctcacaccacttgcccagagcggaggttcrtcctatatttcagatggaaaagaatatttgttttatttgaatgtctgtggagaaactgaaatacagttctgtaataaaaaacaagctgcagtttgccaag

SEQ ID NO: 10835 - DNA, 201 bp, Homo sapiens
agaattgggaagctgtggatggcagtcagacggaaacagagaagaagcattttttcattaatatttgtcacagagtgctgcaggaaggcaaggcacgaggrtgtcccgaggacgcggcagtgtgtgcagtggataaaaatggaagtaaaaatctgggaaaatttatttcctctcccatgaaagagaaaggaaacattcaac

SEQ ID NO: 10836 - DNA, 201 bp, Homo sapiens
cctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccaga

SEQ ID NO: 10837 - DNA, 201 bp, Homo sapiens
aaaaagtgttgatcaaccattcgacctataagaagccttaatttgcacagtgtgtgacttacagaaactgcatgaaaaatcatgggccagagcctcggccmtagcattgcacttggcctcatgctggagggaggctgggcgggtacagcgcggaggaggagggaggccaggcgggcatggcgtggaggaggagggaggccg

SEQ ID NO: 10838 - DNA, 201 bp, Homo sapiens
gcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccag

SEQ ID NO: 10839 - DNA, 201 bp, Homo sapiens
atgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttcc

SEQ ID NO: 10840 - DNA, 201 bp, Homo sapiens
aaataaaaattcaagtggaatatattctgaagctttgcttactacaaatatagtgccaatgtaccagagttttcaagttatatggcgctactttcatgacmccctactgcgaaagtatgctgaagaaagaaatggtgtcaatgtcgtcagtggtcctgtgtttgactttgattatgatggacgttgtgattccttagagaa

SEQ ID NO: 10841 - DNA, 201 bp, Homo sapiens
aagtagctgtgaacattgtctggataccagatatttgaatctttcttactattggtaataaaccttgatggcattgggcaaacagtagacttatagtaggrttggggtagcccatgttatgtgactatctttatgagaattttaaagtggttctggatatcttttaacttggagtttcatttcttttcattgtaatcaaaa

SEQ ID NO: 10842 - DNA, 201 bp, Homo sapiens
ctccccaccacaactaaataaaaattcaagtggaatatattctgaagctttgcttactacaaatatagtgccaatgtaccagagttttcaagttatatggygctactttcatgacaccctactgcgaaagtatgctgaagaaagaaatggtgtcaatgtcgtcagtggtcctgtgtttgactttgattatgatggacgttg

SEQ ID NO: 10843 - DNA, 201 bp, Homo sapiens
ggagacgtgcatagaaccagaacatatatggacttgcaacaaattcaggtgtggtgagaaaaggttgaccagaagcctctgtgcctgttcagatgactgcmaggacaagggcgactgctgcatcaactacagttctgtgtgtcaaggtgagaaaagttgggtagaagaaccatgtgagagcattaatgagccacagtgccc

SEQ ID NO: 10844 - DNA, 201 bp, Homo sapiens
acaaaaactttccccaatcactacagcattgtcaccggattgtatccagaatctcatggcataatcgacaataaaatgtatgatcccaaaatgaatgcttycttttcacttaaaagtaaagagaaatttaatcctgagtggtacaaaggagaaccaatttgggtcacagctaagtatcaaggcctcaagtctggcacattt

SEQ ID NO: 10845 - DNA, 201 bp, Homo sapiens
tttcatttcttttcattgtaatcaaaaaaaaaattaacagaagccaaaatacttctgagaccttgtttcaatctttgctgtatatcccctcaaaatccaarttattaatcttatgtgttttctttttaattttttgattggatttctttagatttaatggttcaaatgagttcaactttgagggacgatctttgaatatac

SEQ ID NO: 10846 - DNA, 201 bp, Homo sapiens
tggcattgggcaaacagtagacttatagtagggttggggtagcccatgttatgtgactatctttatgagaattttaaagtggttctggatatcttttaacwtggagtttcatttcttttcattgtaatcaaaaaaaaaattaacagaagccaaaatacttctgagaccttgtttcaatctttgctgtatatcccctcaaaa

SEQ ID NO: 10847 - DNA, 201 bp, Homo sapiens
tctagctacactattgcattgttcagaaactgtcgaccagagttagaacggagccctcggtgatgcggacatctcagggaaacttgcgtactcagcacagyagtggagagtgttcctgttgaatcttgcacatatttgaatgtgtaagcattgtatacattgatcaagttcgggggaataaagacagaccacacctaaaac

SEQ ID NO: 10848 - DNA, 201 bp, Homo sapiens
atatggacttgcaacaaattcaggtgtggtgagaaaaggttgaccagaagcctctgtgcctgttcagatgactgcaaggacaagggcgactgctgcatcarctacagttctgtgtgtcaaggtgagaaaagttgggtagaagaaccatgtgagagcattaatgagccacagtgcccagcagggtttgaaacgcctcctacc

SEQ ID NO: 10849 - DNA, 201 bp, Homo sapiens
accatgaatctttttgagagaaccttatattttatatagtcctctagctacactattgcattgttcagaaactgtcgaccagagttagaacggagccctcsgtgatgcggacatctcagggaaacttgcgtactcagcacagcagtggagagtgttcctgttgaatcttgcacatatttgaatgtgtaagcattgtataca

SEQ ID NO: 10850 - DNA, 201 bp, Homo sapiens
tccccaaacaccatgaatctttttgagagaaccttatattttatatagtcctctagctacactattgcattgttcagaaactgtcgaccagagttagaacrgagccctcggtgatgcggacatctcagggaaacttgcgtactcagcacagcagtggagagtgttcctgttgaatcttgcacatatttgaatgtgtaagca

SEQ ID NO: 10851 - DNA, 201 bp, Homo sapiens
tagctttcattttgcctcacaggactgataacagcgagagctgtgtgcatgggaagcatgactcctcatgggttgaagaattgttaatgttacacagagcrcggatcacagatgttgagcacatcactggactcagcttctatcaacaaagaaaagagccagtttcagacattttaaagttgaaaacacatttgccaacct

SEQ ID NO: 10852 - DNA, 201 bp, Homo sapiens
gtgcatagaaccagaacatatatggacttgcaacaaattcaggtgtggtgagaaaaggttgaccagaagcctctgtgcctgttcagatgactgcaaggacmagggcgactgctgcatcaactacagttctgtgtgtcaaggtgagaaaagttgggtagaagaaccatgtgagagcattaatgagccacagtgcccagcagg

SEQ ID NO: 10853 - DNA, 201 bp, Homo sapiens; identical to SEQ ID NO: 10845

SEQ ID NO: 10854 - DNA, 201 bp, Homo sapiens; identical to SEQ ID NO: 10846

SEQ ID NO: 10855 - DNA, 201 bp, Homo sapiens; identical to SEQ ID NO: 10847

SEQ ID NO: 10856 - DNA, 201 bp, Homo sapiens; identical to SEQ ID NO: 10849

SEQ ID NO: 10857 - DNA, 201 bp, Homo sapiens; identical to SEQ ID NO: 10850

SEQ ID NO: 10858 - DNA, 201 bp, Homo sapiens; identical to SEQ ID NO: 10851

SEQ ID NO: 10859 - DNA, 201 bp, Homo sapiens; identical to SEQ ID NO: 10852

SEQ ID NO: 10860 - DNA, 201 bp, Homo sapiens; identical to SEQ ID NO: 10848

SEQ ID NO: 10861 - DNA, 201 bp, Homo sapiens; identical to SEQ ID NO: 10840

SEQ ID NO: 10862 - DNA, 201 bp, Homo sapiens; identical to SEQ ID NO: 10841

SEQ ID NO: 10863 - DNA, 201 bp, Homo sapiens; identical to SEQ ID NO: 10843

SEQ ID NO: 10864 - DNA, 201 bp, Homo sapiens; identical to SEQ ID NO: 10842

SEQ ID NO: 10865 - DNA, 201 bp, Homo sapiens; identical to SEQ ID NO: 10844

SEQ ID NO: 10866 - DNA, 201 bp, Homo sapiens
caagacctacgcctacctgttttcccatccctctcggatgcccgtctaccccaaatgggtgggggccgaccatagagatgagatccagtacatctttgggragccctttgccaccccactccgggctaccggccccaagacaggacagtctctaaggccatgaccgcctactggaccaactttgccaaaacaggggacccc

SEQ ID NO: 10867 - DNA, 201 bp, Homo sapiens
cttcctgcgctactggaccctcacctatctggcgctgcccacagtgaccgaccaggaggccagttccatgccctccacaggggactctgaggccactcccrtctcccccgacaggcaactccgagtctgcccccgtccctgcaacgggtgactctcaggatgcccctgtgcccctcacaagtgactctgaggctgcccccg

SEQ ID NO: 10868 - DNA, 201 bp, Homo sapiens
gatgcccgtctaccccaaatgggtgggggccgaccatagagatgagatccagtacatctttggggagccctttgccaccccactccgggctaccggccccragacaggacagtctctaaggccatgaccgcctactggaccaactttgccaaaacaggggaccccaacatgggccactcggctgtgcccacacactgggaa

SEQ ID NO: 10869 - DNA, 201 bp, Homo sapiens
acaggcaactccgagtctgcccccgtccctgcaacgggtgactctcaggatgcccctgtgcccctcacaagtgactctgaggctgcccccgtgcccccctyaggtgactctgaggctcccccgtaccccctacgggtgactctgaggcccgtgcccaccttgggtgactctgaggccgcccctgtgtcccccacagatgac

SEQ ID NO: 10870 - DNA, 201 bp, Homo sapiens
tcccccgacaggcaactccgagtctgcccccgtccctgcaacgggtgactctcaggatgcccctgtgcccctcacaagtgactctgaggctgcccccgtgyccccctcaggtgactctgaggctcccccgtaccccctacgggtgactctgaggcccgtgcccaccttgggtgactctgaggccgcccctgtgtcccccac

SEQ ID NO: 10871 - DNA, 201 bp, Homo sapiens
ccagcacagagccaatgccaagagtgccaagacctacgcctacctgttttcccatccctctcggatgcccgtctaccccaaatgggtgggggccgaccatrgagatgagatccagtacatctttggggagccctttgccaccccactccgggctaccggccccaagacaggacagtctctaaggccatgaccgcctactgg

SEQ ID NO: 10872 - DNA, 201 bp, Homo sapiens
ccaccccactccgggctaccggccccaagacaggacagtctctaaggccatgaccgcctactggaccaactttgccaaaacaggggaccccaacatgggcsactcggctgtgcccacacactgggaaccctacactacggaaaacagcggctacctggagatcaccaagaagatgggcagcagctccatgaagcggagcct

SEQ ID NO: 10873 - DNA, 201 bp, Homo sapiens
cagcacagagccaatgccaagagtgccaagacctacgcctacctgttttcccatccctctcggatgcccgtctaccccaaatgggtgggggccgaccatasagatgagatccagtacatctttggggagccctttgccaccccactccgggctaccggccccaagacaggacagtctctaaggccatgaccgcctactgga

SEQ ID NO: 10874 - DNA, 179 bp, Homo sapiens
tccctgcaacgggtgactctcaggatgcccctgtgcccctcacaagtgactctgaggctgcccccgtgcccccctcaggtgactctgaggctcccccgtaycccctacgggtgactctgaggcccgtgcccaccttgggtgactctgaggccgcccctgtgtcccccacagatgactcc

SEQ ID NO: 10875 - DNA, 201 bp, Homo sapiens
ctaccccaaatgggtgggggccgaccatagagatgagatccagtacatctttggggagccctttgccaccccactccgggctaccggccccaagacaggayagtctctaaggccatgaccgcctactggaccaactttgccaaaacaggggaccccaacatgggccactcggctgtgcccacacactgggaaccctacact

SEQ ID NO: 10876 - DNA, 182 bp, Homo sapiens
cacccagaggctgatgctcaccatggggcgcctgcaactggttgtgttgggcctcacctgctgctgggcagtggcgagtgcygcgaagaccccatgctgcactatgtgggcttcgtccctgtcattgatggagacttcatccccgctgacccgatcaacctgtacgccaacgccgccgacat

SEQ ID NO: 10877 - DNA, 201 bp, Homo sapiens
gtgggggccgaccatagagatgagatccagtacatctttggggagccctttgccaccccactccgggctaccggccccaagacaggacagtctctaaggcyatgaccgcctactggaccaactttgccaaaacaggggaccccaacatgggccactcggctgtgcccacacactgggaaccctacactacggaaaacagcg

SEQ ID NO: 10878 - DNA, 201 bp, Homo sapiens
gagccaatgccaagagtgccaagacctacgcctacctgttttcccatccctctcggatgcccgtctaccccaaatgggtgggggccgaccatagagatgasatccagtacatctttggggagccctttgccaccccactccgggctaccggccccaagacaggacagtctctaaggccatgaccgcctactggaccaactt

SEQ ID NO: 10879 - DNA, 201 bp, Homo sapiens; identical to SEQ ID NO: 10866

SEQ ID NO: 10880 - DNA, 201 bp, Homo sapiens
cttcctgcgctactggaccctcacctatctggcgctgcccacagtgaccgaccaggaggccagttccatgccctccacaggggactctgaggccactcccrtctcccccgacaggcaactccgagtctgcccccgtccctgcaacgggtgactctcaggatgcccctgtgcccctcacaagtgactctgaggctcccccgt

SEQ ID NO: 10881 - DNA, 201 bp, Homo sapiens; identical to SEQ ID NO: 10868

SEQ ID NO: 10882 - DNA, 201 bp, Homo sapiens; identical to SEQ ID NO: 10871

SEQ ID NO: 10883 - DNA, 201 bp, Homo sapiens; identical to SEQ ID NO: 10872

SEQ ID NO: 10884 - DNA, 201 bp, Homo sapiens; identical to SEQ ID NO: 10873

SEQ ID NO: 10885 - DNA, 201 bp, Homo sapiens
ctcccccgacaggcaactccgagtctgcccccgtccctgcaacgggtgactctcaggatgcccctgtgcccctcacaagtgactctgaggctcccccgtaycccctacgggtgactctgaggcccgtgcccaccttgggtgactctgaggccgcccctgtgtcccccacagatgactccgaggaagctcagatgctgcagt

SEQ ID NO: 10886 - DNA, 201 bp, Homo sapiens; identical to SEQ ID NO: 10875

SEQ ID NO: 10887 - DNA, 182 bp, Homo sapiens; identical to SEQ ID NO: 10876

SEQ ID NO: 10888 - DNA, 201 bp, Homo sapiens; identical to SEQ ID NO: 10877

SEQ ID NO: 10889 - DNA, 201 bp, Homo sapiens; identical to SEQ ID NO: 10878

SEQ ID NO: 10890 - DNA, 201 bp, Homo sapiens; identical to SEQ ID NO: 10866

SEQ ID NO: 10891 - DNA, 201 bp, Homo sapiens; identical to SEQ ID NO: 10880

SEQ ID NO: 10892 - DNA, 201 bp, Homo sapiens; identical to SEQ ID NO: 10868

SEQ ID NO: 10893 - DNA, 201 bp, Homo sapiens; identical to SEQ ID NO: 10871

SEQ ID NO: 10894 - DNA, 201 bp, Homo sapiens; identical to SEQ ID NO: 10872

SEQ ID NO: 10895 - DNA, 201 bp, Homo sapiens; identical to SEQ ID NO: 10873

SEQ ID NO: 10896 - DNA, 201 bp, Homo sapiens; identical to SEQ ID NO: 10885

SEQ ID NO: 10897 - DNA, 201 bp, Homo sapiens; identical to SEQ ID NO: 10875

SEQ ID NO: 10898 - DNA, 182 bp, Homo sapiens; identical to SEQ ID NO: 10876

SEQ ID NO: 10899 - DNA, 201 bp, Homo sapiens; identical to SEQ ID NO: 10877

SEQ ID NO: 10900 - DNA, 201 bp, Homo sapiens; identical to SEQ ID NO: 10878

SEQ ID NO: 10901 - DNA, 201 bp, Homo sapiens
ccacccccacgggctaccggccccaagacaggacagtctctaaggccatgatcgcctactggaccaactttgccaaaacaggggaccccaacatgggcgastcggctgtgcccacacactgggaaccctacactacggaaaacagcggctacctggagatcaccaagaagatgggcagcagctccatgaagcggagcctga

SEQ ID NO: 10902 - DNA, 201 bp, Homo sapiens
gatgccgccaggatggcccagtgtctgaaggttactgatccccgagccctgacgctggcctataaggtgccgctggcaggcctggagtaccccatgctgcyctatgtgggcttcgtccctgtcattgatggagacttcatccccgctgacccgatcaacctgtacgccaacgccgccgacatcgactatatagcaggcacc

SEQ ID NO: 10903 - DNA, 201 bp, Homo sapiens
agcagcagttcgaggagctggtgcggcccttcggcagcctggagcgctgcttcctggtctacagtgagcgcactggccaatccaagggctatggctttgcygagtacatgaagaaggactcggctgcccgtgccaagtcggacctgctgggcaagccgctgggaccacgcaccctctacgtgcactggacggatgccgggc

SEQ ID NO: 10904 - DNA, 201 bp, Homo sapiens
caaaggagctggtggccagtggcatgggctgggcagccttcaatctcagcaacgtgactggcaacagtcggatcctctgctcagtgtactgcaatggctcycagataacaggctcctctaacatcaccgtgtacaggctcccggagcgtgtggagctggcacccctgcctccttggcagccggtgggccagaacttcaccc

SEQ ID NO: 10905 - DNA, 201 bp, Homo sapiens
ggaagccaccacccctgctgccatccgtgcttggccctgctgggggtgaccgggaggccctgggcttgggtcccccagcggcccagctcactcctcccccmgcccctgtggggctccgaggctctggcctcagaggcctccagaaagacagtgggcctctgccgacgccccctggggtctcactgctgggggagcccccca

SEQ ID NO: 10906 - DNA, 201 bp, Homo sapiens
tggagcgctgcttcctggtctacagtgagcgcactggccaatccaagggctatggctttgctgagtacatgaagaaggactcggctgcccgtgccaagtcrgacctgctgggcaagccgctgggaccacgcaccctctacgtgcactggacggatgccgggcaactgacgcctgcccttctccactcccgctgcctctgtg

SEQ ID NO: 10907 - DNA, 201 bp, Homo sapiens
aacatcaccgtgtacaggctcccggagcgtgtggagctggcacccctgcctccttggcagccggtgggccagaacttcaccctgcgctgccaagtggaggrtgggtcgccccggaccagcctcacggtggtgctgcttcgctgggaggaggagctgagccggcagcccgcagtggaggagccagcggaggtcactgccact

SEQ ID NO: 10908 - DNA, 201 bp, Homo sapiens
gacgtgtccgttactcaccggcccccgctgagccctaagtctggggccgaagtcgaagccggcgatgccgcggagcgccgggcgccggaagaagagctgcygcctctagatccagaagagatccggaaacgcctggaacacaccgagcgccagttccgtaaccgccgcaagatactgatccggggcctcccgggggacgtg

SEQ ID NO: 10909 - DNA, 184 bp, Homo sapiens
ctgcctcattgctcctgtaattttggcctttcgagtgccttggaggtttccctgacctcccgtgaagatacagagactgtctcctttttttttaactttgwcgctctgattccttcaaggcccggcctgtccgggccaccattccacaccttgcggtttgaaacagctgtttttcccacatttg

SEQ ID NO: 10910 - DNA, 201 bp, Homo sapiens
tgggggaccagatgctgaatgcgacagtcatgaaccacggggacacgctaacggccacagccacagccacggcgcgcgcggatcaggagggtgcccgggaratcgtctgcaacgtgaccctagggggcgagagacgggaggcccgggagaacttgacggtctttagcttcctaggacccattgtgaacctcagcgagccca

SEQ ID NO: 10911 - DNA, 201 bp, Homo sapiens
cggctcgctggtcccagaaggcgccgggtttcccaagatggcggcggacgtgtccgttactcaccggcccccgctgagccctaagtctggggccgaagtcraagccggcgatgccgcggagcgccgggcgccggaagaagagctgccgcctctagatccagaagagatccggaaacgcctggaacacaccgagcgccagtt

SEQ ID NO: 10912 - DNA, 201 bp, Homo sapiens
ttgtggacaaatacaaagggacagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggccct

SEQ ID NO: 10913 - DNA, 201 bp, Homo sapiens
agccttcaatctcagcaacgtgactggcaacagtcggatcctctgctcagtgtactgcaatggctcccagataacaggctcctctaacatcaccgtgtacrggctcccggagcgtgtggagctggcacccctgcctccttggcagccggtgggccagaacttcaccctgcgctgccaagtggaggatgggtcgccccggac

SEQ ID NO: 10914 - DNA, 201 bp, Homo sapiens
ccaatcgacgggcgcgccctcgttgccgctctatgccgctccgccccggctcgctggtcccagaaggcgccgggtttcccaagatggcggcggacgtgtcygttactcaccggcccccgctgagccctaagtctggggccgaagtcgaagccggcgatgccgcggagcgccgggcgccggaagaagagctgccgcctctag

SEQ ID NO: 10915 - DNA, 157 bp, Homo sapiens
ttcccctgcctgcccttcgggcacctcaggaaggcaccttcctctgtcagaatggcyaccatggtaccatccgtgttgtggcccagggcctgctggactctgctggtctgctgtctgctgaccccaggtgtccaggggcaggagttccttttgcggg

SEQ ID NO: 10916 - DNA, 201 bp, Homo sapiens
gcggtgttactgaccctgggcgtggtgactatcgtactggccttaatgtacgtcttcagggagcaccaacggagcggcagttaccatgttagggaggagascacctatctgcccctcacgtctatgcagccgacagaagcaatgggggaagaaccgtccagagctgagtgacgctgggatccgggatcaaagttggcgggg

SEQ ID NO: 10917 - DNA, 201 bp, Homo sapiens
caagaaatacggcactcgctgctccagctgctggctggtgcccaggaaaaatgtccagcccaagaggctatgtggcagatgtggagtgtccctggaccccrttcaggaaggttaaacccagcttcaccctgctgagctgctgcttctgcctccgtttcaccagtgggagaatgggcagaagcagctctcctaggaggattg

SEQ ID NO: 10918 - DNA, 201 bp, Homo sapiens
gagctgctgcttctgcctccgtttcaccagtgggagaatgggcagaagcagctctcctaggaggattggggaaagagccggcctgcctcctctctgccatytccagattcaaggatcccgggggaagacccaggcctcaggtggcagagcctgctaggggtcaccagccccttctccagtcagccttggccgaggccccct

SEQ ID NO: 10919 - DNA, 201 bp, Homo sapiens; identical to SEQ ID NO: 10907

SEQ ID NO: 10920 - DNA, 201 bp, Homo sapiens
tataccccagccgtggggcccggggtccctgccgcagccccctccccttctgatgccttaaaagctgggccccaggccctgctggccagagccacagatgscaagctctgggagcttgactatggaccaaacagctctggcctagggattgggccaccctacccaggatctccaccctggggacagtagaaggggaaagcc

SEQ ID NO: 10921 - DNA, 201 bp, Homo sapiens
ctgcctcattgctcctgtaattttggcctttcgagtgccttggaggtttccctgacctcccgtgaagatacagagactgtctcctttttttttaactttgwcaactgacttctgtttccttttctaagttttatttttcaaaccaccccggacagcccccagctctgattccttcaaggcccggcctgtccgggccaccat

SEQ ID NO: 10922 - DNA, 201 bp, Homo sapiens; identical to SEQ ID NO: 10908

SEQ ID NO: 10923 - DNA, 201 bp, Homo sapiens
aaggggaaagccttcatcttggcgaaccggccccaccaccccctcctacccgggcctccgtgcagagatgggctttctctgccagtcccctgctgtctgtmtgtgggagtcggacattgtgcccatctcccggagcctctgctgtcactcgcttgttgaagatgaattcttgaattctgcctgcccacccccggccagatc

SEQ ID NO: 10924 - DNA, 201 bp, Homo sapiens; identical to SEQ ID NO: 10911

SEQ ID NO: 10925 - DNA, 201 bp, Homo sapiens
aagacgacatgctagacatggcccccctcctccaggagaactcgcggctgggctgccagattgtgctgacaccggagctggaaggagcggaattcaccctkcccaagatcaccaggaacttctacgtggatggccatgtccccaagccccactgacatgaacacctggaccattccacattgccatggccccagggcccag

SEQ ID NO: 10926 - DNA, 201 bp, Homo sapiens; identical to SEQ ID NO: 10913

SEQ ID NO: 10927 - DNA, 201 bp, Homo sapiens
gtcggtgagtcacgtgatgcatgtcatggccgcctccatggcccggggaggcgtgagtgccagggttctgctgcaggctgccaggggcacctggtggaacrgacctgggggcacttccgggtcgggggagggggtggcgctggggacaaccagaaagtttcaagcgacaggctcgcgcccggctggagaggaggacgcggg

SEQ ID NO: 10928 - DNA, 157 bp, Homo sapiens; identical to SEQ ID NO: 10915

SEQ ID NO: 10929 - DNA, 201 bp, Homo sapiens; identical to SEQ ID NO: 10914

SEQ ID NO: 10930 - DNA, 201 bp, Homo sapiens
ggggcacctggtggaacagacctgggggcacttccgggtcgggggagggggtggcgctggggacaaccagaaagtttcaagcgacaggctcgcgcccggckggagaggaggacgcgggcggcccggagcggcccggggacgtggtgaacgtggtgttcgtagaccgctcaggccagcggatcccagtgagtggcagagtcg

SEQ ID NO: 10931 - DNA, 201 bp, Homo sapiens
tccctcgcctccctggcgcggcgcatgctcagtcggtgagtcacgtgatgcatgtcatggccgcctccatggcccggggaggcgtgagtgccagggttctrctgcaggctgccaggggcacctggtggaacagacctgggggcacttccgggtcgggggagggggtggcgctggggacaaccagaaagtttcaagcgacag

SEQ ID NO: 10932 - DNA, 201 bp, Homo sapiens; identical to SEQ ID NO: 10904

SEQ ID NO: 10933 - DNA, 201 bp, Homo sapiens; identical to SEQ ID NO: 10910

SEQ ID NO: 10934 - DNA, 201 bp, Homo sapiens; identical to SEQ ID NO: 10916

SEQ ID NO: 10935 - DNA, 201 bp, Homo sapiens; identical to SEQ ID NO: 10903

SEQ ID NO: 10936 - DNA, 201 bp, Homo sapiens; identical to SEQ ID NO: 10904

SEQ ID NO: 10937 - DNA, 201 bp, Homo sapiens; identical to SEQ ID NO: 10906

SEQ ID NO: 10938 - DNA, 201 bp, Homo sapiens; identical to SEQ ID NO: 10907

SEQ ID NO: 10939 - DNA, 201 bp, Homo sapiens; identical to SEQ ID NO: 10908

SEQ ID NO: 10940 - DNA, 201 bp, Homo sapiens; identical to SEQ ID NO: 10911

SEQ ID NO: 10941 - DNA, 201 bp, Homo sapiens; identical to SEQ ID NO: 10910

SEQ ID NO: 10942 - DNA, 201 bp, Homo sapiens
ctcccgggggacgtgaccaaccagccttcgtgaccctgctgaatggggagcaggccgaggccgcaatcaatgctttccaccagagccgcctgcgggagcgygaactgtcggtgcagctgcagcccacggatgccctgctgtgtgtggccaacctgccccccagcctcacacagcagcagttcgaggagctggtgcggccct

SEQ ID NO: 10943 - DNA, 201 bp, Homo sapiens; identical to SEQ ID NO: 10913

SEQ ID NO: 10944 - DNA, 201 bp, Homo sapiens; identical to SEQ ID NO: 10914

SEQ ID NO: 10945 - DNA, 157 bp, Homo sapiens; identical to SEQ ID NO: 10915

SEQ ID NO: 10946 - DNA, 201 bp, Homo sapiens; identical to SEQ ID NO: 10916

SEQ ID NO: 10947 - DNA, 201 bp, Homo sapiens; identical to SEQ ID NO: 10923

SEQ ID NO: 10948 - DNA, 201 bp, Homo sapiens; identical to SEQ ID NO: 10925

SEQ ID NO: 10949 - DNA, 201 bp, Homo sapiens; identical to SEQ ID NO: 10930

SEQ ID NO: 10950 - DNA, 201 bp, Homo sapiens; identical to SEQ ID NO: 10931

SEQ ID NO: 10951 - DNA, 201 bp, Homo sapiens; identical to SEQ ID NO: 10927

SEQ ID NO: 10952 - DNA, 201 bp, Homo sapiens; identical to SEQ ID NO: 10920

SEQ ID NO: 10953 - DNA, 201 bp, Homo sapiens; identical to SEQ ID NO: 10921

SEQ ID NO: 10954 - DNA, 201 bp, Homo sapiens; identical to SEQ ID NO: 10904

SEQ ID NO: 10955 - DNA, 201 bp, Homo sapiens; identical to SEQ ID NO: 10907

SEQ ID NO: 10956 - DNA, 201 bp, Homo sapiens; identical to SEQ ID NO: 10908

SEQ ID NO: 10957 - DNA, 201 bp, Homo sapiens; identical to SEQ ID NO: 10911

SEQ ID NO: 10958 - DNA, 201 bp, Homo sapiens; identical to SEQ ID NO: 10910

SEQ ID NO: 10959 - DNA, 201 bp, Homo sapiens; identical to SEQ ID NO: 10913

SEQ ID NO: 10960 - DNA, 201 bp, Homo sapiens; identical to SEQ ID NO: 10914

SEQ ID NO: 10961 - DNA, 157 bp, Homo sapiens; identical to SEQ ID NO: 10915

SEQ ID NO: 10962 - DNA, 201 bp, Homo sapiens; identical to SEQ ID NO: 10916

SEQ ID NO: 10963 - DNA, 201 bp, Homo sapiens; identical to SEQ ID NO: 10907

SEQ ID NO: 10964 - DNA, 201 bp, Homo sapiens; identical to SEQ ID NO: 10918

SEQ ID NO: 10965 - DNA, 201 bp, Homo sapiens; identical to SEQ ID NO: 10920

SEQ ID NO: 10966 - DNA, 201 bp, Homo sapiens; identical to SEQ ID NO: 10921

SEQ ID NO: 10967 - DNA, 201 bp, Homo sapiens; identical to SEQ ID NO: 10908

SEQ ID NO: 10968 - DNA, 201 bp, Homo sapiens; identical to SEQ ID NO: 10923

SEQ ID NO: 10969 - DNA, 201 bp, Homo sapiens; identical to SEQ ID NO: 10911

SEQ ID NO: 10970 - DNA, 201 bp, Homo sapiens; identical to SEQ ID NO: 10925

SEQ ID NO: 10971 - DNA, 201 bp, Homo sapiens; identical to SEQ ID NO: 10913

SEQ ID NO: 10972 - DNA, 201 bp, Homo sapiens; identical to SEQ ID NO: 10927

SEQ ID NO: 10973 - DNA, 157 bp, Homo sapiens; identical to SEQ ID NO: 10915

SEQ ID NO: 10974 - DNA, 201 bp, Homo sapiens; identical to SEQ ID NO: 10914

SEQ ID NO: 10975 - DNA, 201 bp, Homo sapiens
agaggtccctctggcctgcatgccaggagtcggtcaccgccctgtgcttcctccaagagacagtggagaggctgggtcagtcccctgcccaggacaccccrgtcctggggccttgctgggacccgatggctctggggactcagggccgcctgctgctggacagggattccaaggacacacagaccaggatcagccaaaagg

SEQ ID NO: 10976 - DNA, 201 bp, Homo sapiens; identical to SEQ ID NO: 10930

SEQ ID NO: 10977 - DNA, 201 bp, Homo sapiens; identical to SEQ ID NO: 10931

SEQ ID NO: 10978 - DNA, 201 bp, Homo sapiens; identical to SEQ ID NO: 10904

SEQ ID NO: 10979 - DNA, 201 bp, Homo sapiens; identical to SEQ ID NO: 10910

SEQ ID NO: 10980 - DNA, 201 bp, Homo sapiens; identical to SEQ ID NO: 10917

SEQ ID NO: 10981 - DNA, 201 bp, Homo sapiens; identical to SEQ ID NO: 10916

SEQ ID NO: 10982 - DNA, 201 bp, Homo sapiens
ctctaacctgccattggaacctcacccatagcccagaagcctcattcacaacccttcccagactccactccaacttagagaacctgaaaaatggacatgtrgacatgtatctgaaagaaagtctaggcggttgcacttagacaagggcctacggctttattaacagatgtcgaggaagctttcaggtgctggtagccatga

SEQ ID NO: 10983 - DNA, 201 bp, Homo sapiens
agaagcctcattcacaacccttcccagactccactccaacttagagaacctgaaaaatggacatgtggacatgtatctgaaagaaagtctaggcggttgcrcttagacaagggcctacggctttattaacagatgtcgaggaagctttcaggtgctggtagccatgagggtctggttttaaggatggcctttaaggaaagg

SEQ ID NO: 10984 - DNA, 201 bp, Homo sapiens
acctccagaggtttccagcgaagctgtaacaatccaccctgcagctctatgacagggaggagggcgaatcaaatccatcatcttacgccagacttcagccstgcgggagctgctgcctccaaagaaagcggggacctgggcggactgcgtctctcccccgtgtggagaacgtgacagatgtgaaggttgggctgacagaca

SEQ ID NO: 10985 - DNA, 201 bp, Homo sapiens
ggacatgtggacatgtatctgaaagaaagtctaggcggttgcacttagacaagggcctacggctttattaacagatgtcgaggaagctttcaggtgctggyagccatgagggtctggttttaaggatggcctttaaggaaaggccgtggcaggcgggctgagaggggcggctccagctcagccctgcccacagcacaggct

SEQ ID NO: 10986 - DNA, 166 bp, Homo sapiens
gaatggctttgtgcttagttttaattgtagtttgtgctattctgtgaattaacaattcaaacaaaataagaaagccatgttgttaaacagtagaggagccrgggactctgtctccattctctcatcacacacaagtcatgcatctaccaaaaaaaaaaaaacaaaa

SEQ ID NO: 10987 - DNA, 201 bp, Homo sapiens
taacagatgtcgaggaagctttcaggtgctggtagccatgagggtctggttttaaggatggcctttaaggaaaggccgtggcaggcgggctgagaggggckgctccagctcagccctgcccacagcacaggctcacagaagccgagatccacatcaccgcctggcatgcaaaggagttgaagacaaaaccatttttttcca

SEQ ID NO: 10988 - DNA, 105 bp, Homo sapiens
caaaataagaaagccatgttgttaaacagtagaggagccagggactctgtctccattctctcatcacacacaagtcatgcatctaccaaaaaaaaaaaaacaaaa

SEQ ID NO: 10989 - DNA, 201 bp, Homo sapiens
gagtacagaggctggagtgcattttctgctaacaaaaaccactgtgatattctcccagtttagagggaaaagtctatctcaggccgactcagatgtggcakaaataagtgggtctgaagtgcattttcagttgtttctgcccggaaggagcccggatgatacaaacaggtctggggttcgtggctctggcaagcgcccaga

SEQ ID NO: 10990 - DNA, 201 bp, Homo sapiens
  misc_feature (1)...(201): n = A,T,C or G, or insertion/deletion polymorphism (see Tables 1-2)
gaaagagaagaggaggctccaaaggcacttgactactgagcatcaccctggacgtgtacaagtctgcgtccttattgttttcttcattgggccgaactttntggtcctcatccaacagctcttctatcacgtgttcgaaagtgtcagccaatgatgtcaagcctcttgaacctgccttgggcccattcacgctctccagag

SEQ ID NO: 10991 - DNA, 201 bp, Homo sapiens
tgactactgagcatcaccctggacgtgtacaagtctgcgtccttattgttttcttcattgggccgaactttctggtcctcatccaacagctcttctatcaygtgttcgaaagtgtcagccaatgatgtcaagcctcttgaacctgccttgggcccattcacgctctccagagtcccatgggtccgcacacctggagatact

SEQ ID NO: 10992 - DNA, 201 bp, Homo sapiens
aatgatgtcaagcctcttgaacctgccttgggcccattcacgctctccagagtcccatgggtccgcacacctggagatactctattatagcaaagaagaawgataatttcattgagccatcctgttttacaggaaattctgcaagtggcaacgtgggtccattccgtgtgtgtcactagagctggcgcaagcccatggcca

SEQ ID NO: 10993 - DNA, 201 bp, Homo sapiens; identical to SEQ ID NO: 10990
  misc_feature (1)...(201): n = A,T,C or G, or insertion/deletion polymorphism (see Tables 1-2)

SEQ ID NO: 10994 - DNA, 201 bp, Homo sapiens; identical to SEQ ID NO: 10991

SEQ ID NO: 10995 - DNA, 201 bp, Homo sapiens
aatgatgtcaagcctcttgaacctgccttgggcccattcacgctctccagagtcccatgggtccgcacacctggagatactctattatagcaaagaagaawgataatttcattgagccatcctgttttacagtattgaattattaccacaaggtaccaaccatatatgcatacttaatagggtattttgtcaaaactatgc

SEQ ID NO: 10996 - DNA, 201 bp, Homo sapiens
tccccctcggtgtatttctactaataaatgcacagctccagaagttgaaaatgcaattagagtaccaggaaacaggagtttctttaccctcactgagatcrtcagatttagatgtcagcccgggtttgtcatggtagggtcccacactgtgcagtgccagaccaatggcagatgggggcccaagctgccacactgctccag

SEQ ID NO: 10997 - DNA, 201 bp, Homo sapiens
ttgcaccagcaaagatgatcaagttggtgtttggagcagccctccccctcggtgtatttctactaataaatgcacagctccagaagttgaaaatgcaattrgagtaccaggaaacaggagtttctttaccctcactgagatcatcagatttagatgtcagcccgggtttgtcatggtagggtcccacactgtgcagtgcca

SEQ ID NO: 10998 - DNA, 201 bp, Homo sapiens
ggacatctttgaattatgaatgccgtcctgggtattttgggaaaatgttctctatctcctgcctagaaaacttggtctggtcaagtgttgaagacaactgyagacgaaaatcatgtggacctccaccagaacccttcaatggaatggtgcatataaacacagatacacagtttggatcaacagttaattattcttgtaatg

SEQ ID NO: 10999 - DNA, 201 bp, Homo sapiens
aggcagcagcgttcatccccgaactctgcaaacaaatgaagaaaatagcagggtccttccttgacaaagtactatacagctgaagaacatctcgaatacarttttggtgggaaaggagccaattgatttcaacagaatcagatctgagcttcataaagtctttgaagtgacttcacagagacgcagacatgtgcacttgaa

SEQ ID NO: 11000 - DNA, 201 bp, Homo sapiens
tcatgggaatggggtttggagcagccctgcccctcgctgtgaactttctgttcgtgctggtcactgtaaaaccccagagcagtttccatttgccagtcctwcgatcccaattaatgactttgagtttccagtcgggacatctttgaattatgaatgccgtcctgggtattttgggaaaatgttctctatctcctgcctaga

SEQ ID NO: 11001 - DNA, 201 bp, Homo sapiens
ggaggcagcagcgttcatccccgaactctgcaaacaaatgaagaaaatagcagggtccttccttgacaaagtactatacagctgaagaacatctcgaatayaattttggtgggaaaggagccaattgatttcaacagaatcagatctgagcttcataaagtctttgaagtgacttcacagagacgcagacatgtgcacttg

SEQ ID NO: 11002 - DNA, 201 bp, Homo sapiens
tgctggcggttgtggtgctgcttgcgctgccggtggcctggggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactg

SEQ ID NO: 11003 - DNA, 201 bp, Homo sapiens
atagcagtgttccagtgtgtgaacaaatcttttgtccaagtcctccagttattcctaatgggagacacacaggaaaacctctggaagtctttccctttggraaaacagtaaattacacatgcgacccccacccagacagagggacgagcttcgacctcattggagagagcaccatccgctgcacaagtgaccctcaaggga

SEQ ID NO: 11004 - DNA, 201 bp, Homo sapiens
tgacttcacagagacgcagacatgtgcacttgaagatgctgccccttccctggtacctagcaaagctcctgcctctttgtgtgcgtcactgtgaaaccccyacccttctgcctcgtgctaaacgcacacagtatctagtcaggggaaaagactgcatttaggagatagaaaatagtttggattacttaaaggaataaggtg

SEQ ID NO: 11005 - DNA, 201 bp, Homo sapiens
gtggaaaatggaatattggtatctgacaacagaagcttattttccttaaatgaagttgtggagtttaggtgtcagcctggctttgtcatgaaaggaccccrccgtgtgaagtgccaggccctgaacaaatgggagccagagttaccaagctgctccagggtgtgtcagccgcctccagaaatcctgcatggtgagcatacc

SEQ ID NO: 11006 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctgcctgcccacatccacccaagatccaaaacgggcattacatt

SEQ ID NO: 11007 - DNA, 201 bp, Homo sapiens
gatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaagaagtaaattgtagcttcccactgtttatgaatggaatctcgaa

SEQ ID NO: 11008 - DNA, 201 bp, Homo sapiens
gggagaaaggtgtttgagcttgtgggtgagccctccatatactgcaccagcaatgacgatcaagtgggcatctggagcggcccggcccctcagtgcattayacctaacaaatgcacgcctccaaatgtggaaaatggaatattggtatctgacaacagaagcttattttccttaaatgaagttgtggagtttaggtgtcag

SEQ ID NO: 11009 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtcaatgcaatgccccagaatggcttccatttgccaggcctaccaacctaactgatgagtttgagtttcccattgggacat

SEQ ID NO: 11010 - DNA, 201 bp, Homo sapiens
aatgggagccggagctaccaagctgctccagggtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagccccca

SEQ ID NO: 11011 - DNA, 201 bp, Homo sapiens
catgggaatggggtttggagcagccctgcccctcgctgtgaactttctgttcgtgctggtcactgtaaaaccccagagcagtttccatttgccagtcctaygatcccaattaatgactttgagtttccagtcgggacatctttgaattatgaatgccgtcctgggtattttgggaaaatgttctctatctcctgcctagaa

SEQ ID NO: 11012 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtcaatgcaatgccccagaatggcttccatttgccaggcctaccaacctaactgatgagtttgagtttc

SEQ ID NO: 11013 - DNA, 201 bp, Homo sapiens
cagtgttccagtgtgtgaacaaatcttttgtccaagtcctccagttattcctaatgggagacacacaggaaaacctctggaagtctttccctttgggaaarcagtaaattacacatgcgacccccacccagacagagggacgagcttcgacctcattggagagagcaccatccgctgcacaagtgaccctcaagggaatgg

SEQ ID NO: 11014 - DNA, 201 bp, Homo sapiens
tccatccgctgcacaagtgaccctcaagggaatggggtttggagcagccctgcccctcgctgtgaactttctgttcctgctgcctgcccacatccacccargatccaaaacgggcattacattggaggacacgtatctctatatcttcctgggatgacaatcagctacatttgtgaccccggctacctgttagtgggaaag

SEQ ID NO: 11015 - DNA, 201 bp, Homo sapiens
gctgtttgagcttgtgggagaacggtcaatatattgcaccagcaaagatgatcaagttggtgtttggagcagccctccccctcggtgtatttctactaatraatgcacagctccagaagttgaaaatgcaattagagtaccaggaaacaggagtttctttaccctcactgagatcatcagatttagatgtcagcccgggtt

SEQ ID NO: 11016 - DNA, 201 bp, Homo sapiens
ctatggatcagtggtgacctaccgctgcaatcctggaagcggagggagaaaggtgtttgagcttgtgggtgagccctccatatactgcaccagcaatgacratcaagtgggcatctggagcggccccgcccctcagtgcattatacctaacaaatgcacgcctccaaatgtggaaaatggaatattggtatctgacaacag

SEQ ID NO: 11017 - DNA, 201 bp, Homo sapiens
tggagacttctacagcaacaatagaacatcttttcacaatggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaataaatgcacagctcc

SEQ ID NO: 11018 - DNA, 201 bp, Homo sapiens
tgggataagaaggcacctatttgtgagatcatatcttgtgagccacctccaaccatatccaatggagacttctacagcaacaatagaacatcttttcacartggaacggtggtaacttaccagtgccacactggaccagatggagaacagctgtttgagcttgtgggagaacggtcaatatattgcaccagcaaagatgat

SEQ ID NO: 11019 - DNA, 201 bp, Homo sapiens
tgtttggagcagccctccccctcggtgtatttctactaataaatgcacagctccagaagttgaaaatgcaattagagtaccaggaaacaggagtttctttwccctcactgagatcatcagatttagatgtcagcccgggtttgtcatggtagggtcccacactgtgcagtgccagaccaatggcagatgggggcccaagct

SEQ ID NO: 11020 - DNA, 201 bp, Homo sapiens
ccccgccgtgtgaagtgccaggccctgaacaaatgggagccagagttaccaagctgctccagggtgtgtcagccgcctccagaaatcctgcatggtgagcrtaccccaagccatcaggacaacttttcacctgggcaggaagtgttctacagctgtgagcctggctatgacctcagaggggctgcgtctctgcactgcaca

SEQ ID NO: 11021 - DNA, 201 bp, Homo sapiens
gccaattgatttcaacagaatcagatctgagcttcataaagtctttgaagtgacttcacagagacgcagacatgtgcacttgaagatgctgccccttcccyggtacctagcaaagctcctgcctctttgtgtgcgtcactgtgaaacccccacccttctgcctcgtgctaaacgcacacagtatctagtcaggggaaaaga

SEQ ID NO: 11022 - DNA, 201 bp, Homo sapiens
tcccacactgtgcagtgccagaccaatggcagatgggggcccaagctgccacactgctccagggtgtgtcagccgcctccagaaatcctgcatggtgagcrtaccctaagccatcaggacaacttttcacctgggcaggaagtgttctacagctgtgagcccagctatgacctcagaggggctgcgtctctgcactgcacg

SEQ ID NO: 11023 - DNA, 201 bp, Homo sapiens
tgaatgccgccctggttattccggaagaccgttttctatcatctgcctaaaaaactcagtctggactggtgctaaggacaggtgcagacgtaaatcatgtygtaatcctccagatcctgtgaatggcatggtgcatgtgatcaaaggcatccagttcggatcccaaattaaatattcttgtactaaaggataccgactcat

SEQ ID NO: 11024 - DNA, 201 bp, Homo sapiens
tttgaagtgtgaagatgggtatactctggaaggcagtccctggagccagtgccaggcggatgacagatgggaccctcctctggccaaatgtacctctcgtrcacatgatgctctcatagttggcactttatctggtacgatcttctttattttactcatcattttcctctcttggataattctaaagcacagaaaaggcaa

SEQ ID NO: 11025 - DNA, 201 bp, Homo sapiens
ttgcaccagcaaagatgatcaagttggtgtttggagcagccctccccctcggtgtatttctactaataaatgcacagctccagaagttgaaaatgcaattrgagtaccaggaaacaggagtttcttttccctcactgagatcatcagatttagatgtcagcccgggtttgtcatggtagggtcccacactgtgcagtgcca

SEQ ID NO: 11026 - DNA, 201 bp, Homo sapiens; identical to SEQ ID NO: 11008

SEQ ID NO: 11027 - DNA, 201 bp, Homo sapiens
gatccaaaacgggcattacattggaggacacgtatctctatatcttcctgggatgacaatcagctacacttgtgaccccggctacctgttagtgggaaagrgcttcattttctgtacagaccagggaatctggagccaattggatcattattgcaaagaagtaaattgtagcttcccactgtttatgaatggaatctcgaa

SEQ ID NO: 11028 - DNA, 201 bp, Homo sapiens
tccatccgctgcacaagtgaccctcaagggaatggggtttggagcagccctgcccctcgctgtgaactttctgttcctgctgcctgcccacatccacccargatccaaaacgggcattacattggaggacacgtatctctatatcttcctgggatgacaatcagctacacttgtgaccccggctacctgttagtgggaaag

SEQ ID NO: 11029 - DNA, 201 bp, Homo sapiens; identical to SEQ ID NO: 11006

SEQ ID NO: 11030 - DNA, 201 bp, Homo sapiens; identical to SEQ ID NO: 11011

SEQ ID NO: 11031 - DNA, 201 bp, Homo sapiens
atagcagtgttccagtgtgtgaacaaatcttttgtccaagtcctccagttattcctaatgggagacacacaggaaaacctctggaagtctttccctttggraaagcagtaaattacacatgcgacccccacccagacagagggacgagcttcgacctcattggagagagcaccatccgctgcacaagtgaccctcaaggga

SEQ ID NO: 11032 - DNA, 201 bp, Homo sapiens
tccccctcggtgtatttctactaataaatgcacagctccagaagttgaaaatgcaattagagtaccaggaaacaggagtttcttttccctcactgagatcrtcagatttagatgtcagcccgggtttgtcatggtagggtcccacactgtgcagtgccagaccaatggcagatgggggcccaagctgccacactgctccag

SEQ ID NO: 11033 - DNA, 201 bp, Homo sapiens; identical to SEQ ID NO: 11002

SEQ ID NO: 11034 - DNA, 201 bp, Homo sapiens; identical to SEQ ID NO: 11021

SEQ ID NO: 11035 - DNA, 201 bp, Homo sapiens; identical to SEQ ID NO: 11016

SEQ ID NO: 11036 - DNA, 201 bp, Homo sapiens; identical to SEQ ID NO: 11009

SEQ ID NO: 11037 - DNA, 201 bp, Homo sapiens; identical to SEQ ID NO: 11012

SEQ ID NO: 11038 - DNA, 201 bp, Homo sapiens; identical to SEQ ID NO: 11024

SEQ ID NO: 11039 - DNA, 201 bp, Homo sapiens; identical to SEQ ID NO: 11010

SEQ ID NO: 11040 - DNA, 201 bp, Homo sapiens
cagtgttccagtgtgtgaacaaatcttttgtccaagtcctccagttattcctaatgggagacacacaggaaaacctctggaagtctttccctttggaaaarcagtaaattacacatgcgacccccacccagacagagggacgagcttcgacctcattggagagagcaccatccgctgcacaagtgaccctcaagggaatgg

SEQ ID NO: 11041 - DNA, 201 bp, Homo sapiens; identical to SEQ ID NO: 11019

SEQ ID NO: 11042 - DNA, 201 bp, Homo sapiens
gctgtttgagcttgtgggagaacggtcaatatattgcaccagcaaagatgatcaagttggtgtttggagcagccctccccctcggtgtatttctactaatraatgcacagctccagaagttgaaaatgcaattagagtaccaggaaacaggagtttcttttccctcactgagatcatcagatttagatgtcagcccgggtt

SEQ ID NO: 11043 - DNA, 201 bp, Homo sapiens; identical to SEQ ID NO: 11017

SEQ ID NO: 11044 - DNA, 201 bp, Homo sapiens; identical to SEQ ID NO: 11018

SEQ ID NO: 11045 - DNA, 201 bp, Homo sapiens; identical to SEQ ID NO: 11022

SEQ ID NO: 11046 - DNA, 201 bp, Homo sapiens; identical to SEQ ID NO: 11020

SEQ ID NO: 11047 - DNA, 201 bp, Homo sapiens; identical to SEQ ID NO: 10998

SEQ ID NO: 11048 - DNA, 201 bp, Homo sapiens; identical to SEQ ID NO: 11000

SEQ ID NO: 11049 - DNA, 201 bp, Homo sapiens; identical to SEQ ID NO: 11005

SEQ ID NO: 11050 - DNA, 201 bp, Homo sapiens; identical to SEQ ID NO: 11023

SEQ ID NO: 11051 - DNA, 201 bp, Homo sapiens; identical to SEQ ID NO: 10999

SEQ ID NO: 11052 - DNA, 201 bp, Homo sapiens; identical to SEQ ID NO: 11001

SEQ ID NO: 11053 - DNA, 201 bp, Homo sapiens; identical to SEQ ID NO: 11004

SEQ ID NO: 11054 - DNA, 201 bp, Homo sapiens
ttgcaccagcaaagatgatcaagttggtgtttggagcagccctccccctcggtgtatttctactaataaatgcacagctccagaagttgaaaatgcaattrgagtaccaggaaacaggagtttcttttccctcactgagatcgtcagatttagatgtcagcccgggtttgtcatggtagggtcccacactgtgcagtgcca

SEQ ID NO: 11055 - DNA, 201 bp, Homo sapiens; identical to SEQ ID NO: 11008

SEQ ID NO: 11056 - DNA, 201 bp, Homo sapiens; identical to SEQ ID NO: 11007

SEQ ID NO: 11057 - DNA, 201 bp, Homo sapiens
tccatccgctgcacaagtgaccgtcaagggaatggggtttggagcagccctgcccctcgctgtgaactttctgttcctgctgcctgcccagatccacccargatccaaaacgggcattacattggaggacacgtatctctatatcttcctgggatgacaatcagctacatttgtgaccccggctacctgttagtgggaaag

SEQ ID NO: 11058 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctgcctgcccagatccacccaagatccaaaacgggcattacatt

SEQ ID NO: 11059 - DNA, 201 bp, Homo sapiens; identical to SEQ ID NO: 11011

SEQ ID NO: 11060 - DNA, 201 bp, Homo sapiens; identical to SEQ ID NO: 11003

SEQ ID NO: 11061 - DNA, 201 bp, Homo sapiens; identical to SEQ ID NO: 11032

SEQ ID NO: 11062 - DNA, 201 bp, Homo sapiens; identical to SEQ ID NO: 11002

SEQ ID NO: 11063 - DNA, 201 bp, Homo sapiens; identical to SEQ ID NO: 11021

SEQ ID NO: 11064 - DNA, 201 bp, Homo sapiens; identical to SEQ ID NO: 11016

SEQ ID NO: 11065 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtcaatgcaatgccccagaatggcttccatttgccaggcctaccaacctaactgatgaatttgagtttcccattgggacat

SEQ ID NO: 11066 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtcaatgcaatgccccagaatggcttccatttgccaggcctaccaacctaactgatgaatttgagtttc

SEQ ID NO: 11067 - DNA, 201 bp, Homo sapiens; identical to SEQ ID NO: 11024

SEQ ID NO: 11068 - DNA, 201 bp, Homo sapiens; identical to SEQ ID NO: 11010

SEQ ID NO: 11069 - DNA, 201 bp, Homo sapiens; identical to SEQ ID NO: 11013

SEQ ID NO: 11070 - DNA, 201 bp, Homo sapiens
tgtttggagcagccctccccctcggtgtatttctactaataaatgcacagctccagaagttgaaaatgcaattagagtaccaggaaacaggagtttctttwccctcactgagatcgtcagatttagatgtcagcccgggtttgtcatggtagggtcccacactgtgcagtgccagaccaatggcagatgggggcccaagct

SEQ ID NO: 11071 - DNA, 201 bp, Homo sapiens
gctgtttgagcttgtgggagaacggtcaatatattgcaccagcaaagatgatcaagttggtgtttggagcagccctccccctcggtgtatttctactaatraatgcacagctccagaagttgaaaatgcaattagagtaccaggaaacaggagtttcttttccctcactgagatcgtcagatttagatgtcagcccgggtt

SEQ ID NO: 11072 - DNA, 201 bp, Homo sapiens; identical to SEQ ID NO: 11017

SEQ ID NO: 11073 - DNA, 201 bp, Homo sapiens; identical to SEQ ID NO: 11018

SEQ ID NO: 11074 - DNA, 201 bp, Homo sapiens; identical to SEQ ID NO: 11022

SEQ ID NO: 11075 - DNA, 201 bp, Homo sapiens; identical to SEQ ID NO: 11020

SEQ ID NO: 11076 - DNA, 201 bp, Homo sapiens; identical to SEQ ID NO: 10998

SEQ ID NO: 11077 - DNA, 201 bp, Homo sapiens; identical to SEQ ID NO: 11000

SEQ ID NO: 11078 - DNA, 201 bp, Homo sapiens; identical to SEQ ID NO: 11005

SEQ ID NO: 11079 - DNA, 201 bp, Homo sapiens; identical to SEQ ID NO: 11023

SEQ ID NO: 11080 - DNA, 201 bp, Homo sapiens; identical to SEQ ID NO: 10999

SEQ ID NO: 11081 - DNA, 201 bp, Homo sapiens
ggaggcagcagcgttcatccccgaactctgcaaacaaatgaagaaaatagcagggtccttccttgacaaagtactatacagctgaagaacatctcgaatayagttttggtgggaaaggagccaattgatttcaacagaatcagatctgagcttcataaagtctttgaagtgacttcacagagacgcagacatgtgcacttg

SEQ ID NO: 11082 - DNA, 201 bp, Homo sapiens; identical to SEQ ID NO: 11004

SEQ ID NO: 11083 - DNA, 201 bp, Homo sapiens
ctactggttcatctcccgggacaaagaggaaactttgccacttgaagatgggtggtgggggccaggcacgaggtccgcagccagggaggacgacagcatcygccctttcaaggtggaaacgtcagatgaggagatccacgacttacaccagaggatcgataagttccgtttcaccccacctttggaggacagctgcttcca

SEQ ID NO: 11084 - DNA, 201 bp, Homo sapiens
gaggatggaggcctggaaaggaagttctccctggacgacctgctgaccaacgtcatgctctactggacaacaggcaccatcatctcctcccagcgcttctmcaaggagaacctgggacagggctggatgacccagaagcatgagcggatgaaggtctatgtgcccactggcttctctgccttcccttttgagctattgcac

SEQ ID NO: 11085 - DNA, 166 bp, Homo sapiens
ctgacttggcaggactgtgcaattgtcagaaggccgtggggagtgggggccagtgcctgcagcctrccctgcctctctcacaggcccttagagcatcgccaggtgcagagctccacagctctctttcccaaggagtaatcagagggtgagaacgtggagcctggtg

SEQ ID NO: 11086 - DNA, 201 bp, Homo sapiens
caccagaggatcgataagttccgtttcaccccacctttggaggacagctgcttccactatggcttcaactccaactacctgaagaaagtcatctcctactrgcggaatgaatttgactggaagaagcaggtggagattctcaacagataccctcacttcaagactaagattgaagggctggacatccacttcatccacgtg

SEQ ID NO: 11087 - DNA, 201 bp, Homo sapiens
tgctgaccaacgtcatgctctactggacaacaggcaccatcatctcctcccagcgcttctacaaggagaacctgggacagggctggatgacccagaagcawgagcggatgaaggtctatgtgcccactggcttctctgccttcccttttgagctattgcacacgcctgaaaagtgggtgaggttcaagtacccaaagctca

SEQ ID NO: 11088 - DNA, 201 bp, Homo sapiens
tctctaccctgaccctcctcctgggacagcgtttcgggaggtttcttggcctcactgagagggatgtggagctgctgtaccccgtcaaggagaaggtattytacagcctgatgagggagagcggctacatgcacatccagtgcaccaagcctgacaccgtaggctctgctctgaatgactctcctgtgggtctggctgcct

SEQ ID NO: 11089 - DNA, 201 bp, Homo sapiens
ctgcttccactatggcttcaactccaactacctgaagaaagtcatctcctactggcggaatgaatttgactggaagaagcaggtggagattctcaacagayaccctcacttcaagactaagattgaagggctggacatccacttcatccacgtgaagcccccccagctgcccgcaggccataccccgaagcccttgctgat

SEQ ID NO: 11090 - DNA, 201 bp, Homo sapiens
atattctagagaagttttccacctggaccaatacggaattccgatacctggaggatggaggcctggaaaggaagttctccctggacgacctgctgaccaaygtcatgctctactggacaacaggcaccatcatctcctcccagcgcttctacaaggagaacctgggacagggctggatgacccagaagcatgagcggatga

SEQ ID NO: 11091 - DNA, 201 bp, Homo sapiens
atctcctattcctacatggttcgtgggggccactttgcggcctttgaggagccggagctgctcgcccaggacatccgcaagttcctgtcggtgctggagcrgcaatgacccacccctctccccccgcctgccacctccccccacaagtgccctccaggcttttcttggggaagataccccttttctgaggaatgagtttgc

SEQ ID NO: 11092 - DNA, 201 bp, Homo sapiens
acattcaaggaggggactgggggtccctgatctgcactaatatggcccagctggtgcccagccacgtgaaaggcctgcacttgaacatggctttggttttragcaacttctctaccctgaccctcctcctgggacagcgtttcgggaggtttcttggcctcactgagagggatgtggagctgctgtaccccgtcaaggaga

SEQ ID NO: 11093 - DNA, 201 bp, Homo sapiens
cttctacaaggagaacctgggacagggctggatgacccagaagcatgagcggatgaaggtctatgtgcccactggcttctctgccttcccttttgagctaytgcacacgcctgaaaagtgggtgaggttcaagtacccaaagctcatctcctattcctacatggttcgtgggggccactttgcggcctttgaggagccgga

SEQ ID NO: 11094 - DNA, 201 bp, Homo sapiens
tgcctgcagcctgccctgcctctctcacaggcccttagagcatcgccaggtgcagagctccacagctctctttcccaaggagtaatcagagggtgagaacrtggagcctggtggacaggtgaaagcactgggatctttctgcccagaaaggggaaagttgcacatttatatcctagagggaagcgacagcagtgcttctcc

SEQ ID NO: 11095 - DNA, 201 bp, Homo sapiens
caggtggagattctcaacagataccctcacttcaagactaagattgaagggctggacatccacttcatccacgtgaagcccccccagctgcccgcaggccrtaccccgaagcccttgctgatggtgcacggctggcccggctctttctacgagttttataagatcatcccactcctgactgaccccaagaaccatggcctg

SEQ ID NO: 11096 - DNA, 201 bp, Homo sapiens
ggctgggcttccaggaattctacattcaaggaggggactgggggtccctgatctgcactaatatggcccagctggtgcccagccacgtgaaaggcctgcayttgaacatggctttggttttaagcaacttctctaccctgaccctcctcctgggacagcgtttcgggaggtttcttggcctcactgagagggatgtggagc

SEQ ID NO: 11097 - DNA, 201 bp, Homo sapiens
ctttggttttaagcaacttctctaccctgaccctcctcctgggacagcgtttcgggaggtttcttggcctcactgagagggatgtggagctgctgtacccygtcaaggagaaggtattctacagcctgatgagggagagcggctacatgcacatccagtgcaccaagcctgacaccgtaggctctgctctgaatgactctc

SEQ ID NO: 11098 - DNA, 201 bp, Homo sapiens
ataagttccgtttcaccccacctttggaggacagctgcttccactatggcttcaactccaactacctgaagaaagtcatctcctactggcggaatgaattygactggaagaagcaggtggagattctcaacagataccctcacttcaagactaagattgaagggctggacatccacttcatccacgtgaagcccccccagc

SEQ ID NO: 11099 - DNA, 201 bp, Homo sapiens
atgaggccactggccagggctatgctgcaccagaccaatggcaccgcccccacccctcccagcgcaggggcagcttggagcagaggcagcactggccaccrctgcgggggcaagtcagcgtcaagagagtccctgagtgagaaggcccagataagcccaggccccccaggccagcggacaggcacaggcagggcctacaga

SEQ ID NO: 11100 - DNA, 201 bp, Homo sapiens
ggccaggcacgaggtccgcagccagggaggacgacagcatccgccctttcaaggtggaaacgtcagatgaggagatccacgacttacaccagaggatcgayaagttccgtttcaccccacctttggaggacagctgcttccactatggcttcaactccaactacctgaagaaagtcatctcctactggcggaatgaatttg

SEQ ID NO: 11101 - DNA, 201 bp, Homo sapiens
cttctcaggcagaagtcttaagttgcatcccattccccagaatccccaggagggagaagagggatgggctgcccctccttcctgccagagccacagctcamgggcagtgggatggccctgcacccagcccaggtaccccttcctctgtgccgaccatgctgtcctttggctccgaggaggccctgagcactgcccaccccc

SEQ ID NO: 11102 - DNA, 201 bp, Homo sapiens
actccaactacctgaagaaagtcatctcctactggcggaatgaatttgactggaagaagcaggtggagattctcaacagataccctcacttcaagactaarattgaagggctggacatccacttcatccacgtgaagcccccccagctgcccgcaggccataccccgaagcccttgctgatggtgcacggctggcccggct

SEQ ID NO: 11103 - DNA, 201 bp, Homo sapiens; identical to SEQ ID NO: 11083

SEQ ID NO: 11104 - DNA, 201 bp, Homo sapiens; identical to SEQ ID NO: 11084

SEQ ID NO: 11105 - DNA, 201 bp, Homo sapiens; identical to SEQ ID NO: 11088

SEQ ID NO: 11106 - DNA, 201 bp, Homo sapiens; identical to SEQ ID NO: 11096

SEQ ID NO: 11107 - DNA, 201 bp, Homo sapiens; identical to SEQ ID NO: 11097

SEQ ID NO: 11108 - DNA, 201 bp, Homo sapiens; identical to SEQ ID NO: 11099

SEQ ID NO: 11109 - DNA, 201 bp, Homo sapiens; identical to SEQ ID NO: 11102

SEQ ID NO: 11110 - DNA, 201 bp, Homo sapiens; identical to SEQ ID NO: 11086

SEQ ID NO: 11111 - DNA, 201 bp, Homo sapiens; identical to SEQ ID NO: 11087

SEQ ID NO: 11112 - DNA, 201 bp, Homo sapiens; identical to SEQ ID NO: 11089

SEQ ID NO: 11113 - DNA, 201 bp, Homo sapiens; identical to SEQ ID NO: 11090

SEQ ID NO: 11114 - DNA, 201 bp, Homo sapiens; identical to SEQ ID NO: 11092

SEQ ID NO: 11115 - DNA, 201 bp, Homo sapiens; identical to SEQ ID NO: 11091

SEQ ID NO: 11116 - DNA, 201 bp, Homo sapiens; identical to SEQ ID NO: 11093

SEQ ID NO: 11117 - DNA, 201 bp, Homo sapiens; identical to SEQ ID NO: 11095

SEQ ID NO: 11118 - DNA, 201 bp, Homo sapiens; identical to SEQ ID NO: 11098

SEQ ID NO: 11119 - DNA, 201 bp, Homo sapiens; identical to SEQ ID NO: 11100

SEQ ID NO: 11120 - DNA, 201 bp, Homo sapiens; identical to SEQ ID NO: 11101

SEQ ID NO: 11121 - DNA, 201 bp, Homo sapiens; identical to SEQ ID NO: 11083

SEQ ID NO: 11122 - DNA, 201 bp, Homo sapiens; identical to SEQ ID NO: 11084

SEQ ID NO: 11123 - DNA, 201 bp, Homo sapiens; identical to SEQ ID NO: 11088

SEQ ID NO: 11124 - DNA, 201 bp, Homo sapiens; identical to SEQ ID NO: 11096

SEQ ID NO: 11125 - DNA, 201 bp, Homo sapiens; identical to SEQ ID NO: 11097

SEQ ID NO: 11126 - DNA, 121 bp, Homo sapiens
atgaggccactggccagggctatgctgcaccagaccaatggcaccgcccccacccctcccagcgcaggggcagcttggagcagaggcagcactggccaccrctgcgggggcaagtcagcgt

SEQ ID NO: 11127 - DNA, 201 bp, Homo sapiens; identical to SEQ ID NO: 11102

SEQ ID NO: 11128 - DNA, 201 bp, Homo sapiens; identical to SEQ ID NO: 11086

SEQ ID NO: 11129 - DNA, 201 bp, Homo sapiens; identical to SEQ ID NO: 11087

SEQ ID NO: 11130 - DNA, 201 bp, Homo sapiens; identical to SEQ ID NO: 11089

SEQ ID NO: 11131 - DNA, 201 bp, Homo sapiens; identical to SEQ ID NO: 11090

SEQ ID NO: 11132 - DNA, 201 bp, Homo sapiens; identical to SEQ ID NO: 11092

SEQ ID NO: 11133 - DNA, 201 bp, Homo sapiens; identical to SEQ ID NO: 11091

SEQ ID NO: 11134 - DNA, 201 bp, Homo sapiens; identical to SEQ ID NO: 11093

SEQ ID NO: 11135 - DNA, 201 bp, Homo sapiens; identical to SEQ ID NO: 11095

SEQ ID NO: 11136 - DNA, 201 bp, Homo sapiens; identical to SEQ ID NO: 11098

SEQ ID NO: 11137 - DNA, 201 bp, Homo sapiens; identical to SEQ ID NO: 11100

SEQ ID NO: 11138 - DNA, 201 bp, Homo sapiens; identical to SEQ ID NO: 11083

SEQ ID NO: 11139 - DNA, 201 bp, Homo sapiens; identical to SEQ ID NO: 11084

SEQ ID NO: 11140 - DNA, 201 bp, Homo sapiens; identical to SEQ ID NO: 11088

SEQ ID NO: 11141 - DNA, 201 bp, Homo sapiens; identical to SEQ ID NO: 11096

SEQ ID NO: 11142 - DNA, 201 bp, Homo sapiens; identical to SEQ ID NO: 11097

SEQ ID NO: 11143 - DNA, 201 bp, Homo sapiens; identical to SEQ ID NO: 11099

SEQ ID NO: 11144 - DNA, 201 bp, Homo sapiens; identical to SEQ ID NO: 11102

SEQ ID NO: 11145 - DNA, 201 bp, Homo sapiens; identical to SEQ ID NO: 11086

SEQ ID NO: 11146 - DNA, 201 bp, Homo sapiens; identical to SEQ ID NO: 11087

SEQ ID NO: 11147 - DNA, 201 bp, Homo sapiens; identical to SEQ ID NO: 11089

SEQ ID NO: 11148 - DNA, 201 bp, Homo sapiens; identical to SEQ ID NO: 11090

SEQ ID NO: 11149 - DNA, 201 bp, Homo sapiens; identical to SEQ ID NO: 11092

SEQ ID NO: 11150 - DNA, 201 bp, Homo sapiens; identical to SEQ ID NO: 11091

SEQ ID NO: 11151 - DNA, 201 bp, Homo sapiens; identical to SEQ ID NO: 11093

SEQ ID NO: 11152 - DNA, 201 bp, Homo sapiens; identical to SEQ ID NO: 11095

SEQ ID NO: 11153 - DNA, 201 bp, Homo sapiens; identical to SEQ ID NO: 11098

SEQ ID NO: 11154 - DNA, 201 bp, Homo sapiens; identical to SEQ ID NO: 11100

SEQ ID NO: 11155 - DNA, 201 bp, Homo sapiens; identical to SEQ ID NO: 11101

SEQ ID NO: 11156 - DNA, 201 bp, Homo sapiens
actccagacagacggctttggaatccaccagctacatccagctccctgaggcagagttgagaatggagagaatgttacctctcctggctctggggctcttrgcggctgggttctgccctgctgtcctctgccaccctaacagcccacttgacgaggagaatctgacccaggagaaccaagaccgagggacacacgtggacc

SEQ ID NO: 11157 - DNA, 201 bp, Homo sapiens
ctggcctctcccagaggggctgctctgaagcatgtggatttgatcaggataatcaagtccgagaacagaacacttggttgtcctggcatttcccaagcagkgggaggagttctctgcaggaataaataagcctcagcattcatgaaaatccactactccagacagacggctttggaatccaccagctacatccagctccct

SEQ ID NO: 11158 - DNA, 152 bp, Homo sapiens
agtggccatggcatgtgtggccctgtctgcttatccttggaaggtgacagcgattccctgtgtagctctcacatgcacaggggcccatggactcttcagtytggagggtcctgggcctcctgacagcaataaataatttcgttggacacgtt

SEQ ID NO: 11159 - DNA, 201 bp, Homo sapiens
gctgccacagcagtcaaaatcaccctcctttctgcattagtggagacaaggaccattgtgcgtttcaacaggcccttcctgatgatcattgtccctacagrcacccagaacatcttcttcatgagcaaagtcaccaatcccaagcaagcctagagcttgccatcaagcagtggggctctcagtaaggaacttggaatgcaa

SEQ ID NO: 11160 - DNA, 201 bp, Homo sapiens
gtctaatcacaagaaaatgacagccaatcccaagttcagggacatttggcaaaatagcccaccactcctacttaaaagtgtcgaggtcttgaaaggcaagraaaccctgggaaatcgtctttggccggaggaaactcagcagacatgacgactaaatgcaatgtagaatcctcggacagaaaaggacattagtaggacagc

SEQ ID NO: 11161 - DNA, 106 bp, Homo sapiens
acagcgattccctgtgtagctctcacatgcacaggggcccatggactcttcagtctggagggtcctgggcctcctgacagcaataaataatttcgttggamacgtt

SEQ ID NO: 11162 - DNA, 201 bp, Homo sapiens
caccctcctttctgcattagtggagacaaggaccattgtgcgtttcaacaggcccttcctgatgatcattgtccctacagacacccagaacatcttcttcrtgagcaaagtcaccaatcccaagcaagcctagagcttgccatcaagcagtggggctctcagtaaggaacttggaatgcaagctggatgcctgggtctctg

SEQ ID NO: 11163 - DNA, 201 bp, Homo sapiens
acgtggacttcgctttcagcctgtacaagcagttagtcctgaaggcccctgataagaatgtcatcttctccccactgagcatctccaccgccttggccttyctgtctctgggggcccataataccaccctgacagagattctcaaaggcctcaagttcaacctcacggagacttctgaggcagaaattcaccagagcttcc

SEQ ID NO: 11164 - DNA, 201 bp, Homo sapiens
acagcccacttgacgaggagaatctgacccaggagaaccaagaccgagggacacacgtggacctcggattagcctccgccaacgtggacttcgctttcagyctgtacaagcagttagtcctgaaggcccctgataagaatgtcatcttctccccactgagcatctccaccgccttggccttcctgtctctgggggcccata

SEQ ID NO: 11165 - DNA, 201 bp, Homo sapiens
aaataagcctcagcattcatgaaaatccactactccagacagacggctttggaatccaccagctacatccagctccctgaggcagagttgagaatggagaraatgttacctctcctggctctggggctcttggcggctgggttctgccctgctgtcctctgccaccctaacagcccacttgacgaggagaatctgacccag

SEQ ID NO: 11166 - DNA, 201 bp, Homo sapiens
atcccaagttcagggacatttggcaaaatagcccaccactcctacttaaaagtgtcgaggtcttgaaaggcaaggaaaccctgggaaatcgtctttggccrgaggaaactcagcagacatgacgactaaatgcaatgtagaatcctcggacagaaaaggacattagtaggacagctggtgaaacccaaaggaagaacctgt

SEQ ID NO: 11167 - DNA, 201 bp, Homo sapiens
gatgccctttgacccccaagatactcatcagtcaaggttctacttgagcaagaaaaagtgggtaatggtgcccatgatgagtttgcatcacctgactatascttacttccgggacgaggagctgtcctgcaccgtggtggagctgaagtacacaggcaatgccagcgcactcttcatcctccctgatcaagacaagatgga

SEQ ID NO: 11168 - DNA, 201 bp, Homo sapiens
gtggacctcggattagcctccgccaacgtggacttcgctttcagcctgtacaagcagttagtcctgaaggcccctgataagaatgtcatcttctccccacygagcatctccaccgccttggccttcctgtctctgggggcccataataccaccctgacagagattctcaaaggcctcaagttcaacctcacggagacttct

SEQ ID NO: 11169 - DNA, 201 bp, Homo sapiens
cagggacatttggcaaaatagcccaccactcctacttaaaagtgtcgaggtcttgaaaggcaaggaaaccctgggaaatcgtctttggccggaggaaactmagcagacatgacgactaaatgcaatgtagaatcctcggacagaaaaggacattagtaggacagctggtgaaacccaaaggaagaacctgtgtcaggaccc

SEQ ID NO: 11170 - DNA, 201 bp, Homo sapiens
aggcaaggaaaccctgggaaatcgtctttggccggaggaaactcagcagacatgacgactaaatgcaatgtagaatcctcggacagaaaaggacattagtrggacagctggtgaaacccaaaggaagaacctgtgtcaggacccccagagcggtgtctccactaagcagaagtctctgtttctctcctggcctctcccaga

SEQ ID NO: 11171 - DNA, 201 bp, Homo sapiens
tataatgtgacaagataacataatgaaaaagaatgaagaataaaatagaaaagtaaaatggattgcatgtcacttgatgacaagtactgtggaatgaggcygtcatctaaatggagcacagaaagtggaacatggcgacatctcagccaaaagacccggcagacaccatcttggccaagggatcgaggttggcatcgccag

SEQ ID NO: 11172 - DNA, 201 bp, Homo sapiens
aagataacataatgaaaaagaatgaagaataaaatagaaaagtaaaatggattgcatgtcacttgatgacaagtactgtggaatgaggccgtcatctaaayggagcacagaaagtggaacatggcgacatctcagccaaaagacccggcagacaccatcttggccaagggatcgaggttggcatcgccagctgtgagcagt

SEQ ID NO: 11173 - DNA, 201 bp, Homo sapiens
catgaaaatccactactccagacagacggctttggaatccaccagctacatccagctccctgaggcagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 11174 - DNA, 201 bp, Homo sapiens
tggtgcccatgatgagtttgcatcacctgactataccttacttccgggacgaggagctgtcctgcaccgtggtggagctgaagtacacaggcaatgccagygcactcttcatcctccctgatcaagacaagatggaggaagtggaagccatgctgctcccagagaccctgaagcggtggagagactctctggagttcagag

SEQ ID NO: 11175 - DNA, 159 bp, Homo sapiens
tgcaccgagtggccatggcatgtgtggccctgtctgcttatccttggaaggtgacagcgattccctgtgtagctctcacatgcacaggggcccatggactyttcagtctggagggtcctgggcctcctgacagcaataaataatttcgttggacacgtt

SEQ ID NO: 11176 - DNA, 168 bp, Homo sapiens
tggtgcacaaagctgtggtggaggtggacgagtcgggaaccagagcagcggcagccacggggacaatmttcactttcagatattcactgaatggccactgtgtgcctggcactgttccaagtgctgaagaaaaatgaagaaaacaaaaatccctgcccttatagagga

SEQ ID NO: 11177 - DNA, 201 bp, Homo sapiens
ctgactttcaggactcagctgcagctaagaagctcatcaacgactacgtgaagaatggaactagggggaaaatcacagatctgatcaaggaccttgactcrcagacaatgatggtcctggtgaattacatcttctttaaagccaaatgggagatgccctttgacccccaagatactcatcagtcaaggttctacttgagca

SEQ ID NO: 11178 - DNA, 201 bp, Homo sapiens
caaagttttccatctcgagggactataacctgaacgacatacttctccagctgggcattgaggaagccttcaccagcaaggctgacctgtcagggatcacrggggccaggaacctagcagtctcccaggtggtccataaggctgtgcttgatgtatttgaggagggcacagaagcatctgctgccacagcagtcaaaatca

SEQ ID NO: 11179 - DNA, 201 bp, Homo sapiens; identical to SEQ ID NO: 11167

SEQ ID NO: 11180 - DNA, 201 bp, Homo sapiens; identical to SEQ ID NO: 11168

SEQ ID NO: 11181 - DNA, 201 bp, Homo sapiens; identical to SEQ ID NO: 11159

SEQ ID NO: 11182 - DNA, 191 bp, Homo sapiens
cactactccagacagacggctttggaatccaccagctacatccagctccctgaggcagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 11183 - DNA, 201 bp, Homo sapiens; identical to SEQ ID NO: 11163

SEQ ID NO: 11184 - DNA, 174 bp, Homo sapiens
cactactccagacagacggctttggaatccaccagctacatccagctccctgaggcagagttgagaatggagaraatgttacctctcctggctctggggctcttggcggctgggttctgccctgctgtcctctgccaccctaacagcccacttgacgaggagaatctgacccag

SEQ ID NO: 11185 - DNA, 201 bp, Homo sapiens; identical to SEQ ID NO: 11164

SEQ ID NO: 11186 - DNA, 201 bp, Homo sapiens; identical to SEQ ID NO: 11174

SEQ ID NO: 11187 - DNA, 201 bp, Homo sapiens; identical to SEQ ID NO: 11177

SEQ ID NO: 11188 - DNA, 201 bp, Homo sapiens; identical to SEQ ID NO: 11178

SEQ ID NO: 11189 - DNA, 201 bp, Homo sapiens; identical to SEQ ID NO: 11167

SEQ ID NO: 11190 - DNA, 201 bp, Homo sapiens; identical to SEQ ID NO: 11174

SEQ ID NO: 11191 - DNA, 201 bp, Homo sapiens
ggctctccctcacccccaataacttttactcttgccaagctacttctctaaaccaaagcagggtccctcctatgagggactctgggcacttccactgctgsggaagcagggtcgagcagggcgacccttgcactcacaccttctccaactgcttgctccaccttcagccaaatgggagatgccctttgacccccaagatac

SEQ ID NO: 11192 - DNA, 201 bp, Homo sapiens; identical to SEQ ID NO: 11159

SEQ ID NO: 11193 - DNA, 201 bp, Homo sapiens; identical to SEQ ID NO: 11178

SEQ ID NO: 11194 - DNA, 201 bp, Homo sapiens; identical to SEQ ID NO: 11167

SEQ ID NO: 11195 - DNA, 201 bp, Homo sapiens; identical to SEQ ID NO: 11168

SEQ ID NO: 11196 - DNA, 201 bp, Homo sapiens; identical to SEQ ID NO: 11159

SEQ ID NO: 11197 - DNA, 201 bp, Homo sapiens
gggagcggaggaatctgtttttccaggagagttttaggcagcagcctggagtgtgtggagtgtgagggagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 11198 - DNA, 201 bp, Homo sapiens; identical to SEQ ID NO: 11163

SEQ ID NO: 11199 - DNA, 201 bp, Homo sapiens
atgatgttttacatcctgggagcggaggaatctgtttttccaggagagttttaggcagcagcctggagtgtgtggagtgtgagggagttgagaatggagaraatgttacctctcctggctctggggctcttggcggctgggttctgccctgctgtcctctgccaccctaacagcccacttgacgaggagaatctgacccag

SEQ ID NO: 11200 - DNA, 201 bp, Homo sapiens; identical to SEQ ID NO: 11164

SEQ ID NO: 11201 - DNA, 201 bp, Homo sapiens; identical to SEQ ID NO: 11174

SEQ ID NO: 11202 - DNA, 201 bp, Homo sapiens; identical to SEQ ID NO: 11177

SEQ ID NO: 11203 - DNA, 201 bp, Homo sapiens; identical to SEQ ID NO: 11178

SEQ ID NO: 11204 - DNA, 201 bp, Homo sapiens; identical to SEQ ID NO: 11167

SEQ ID NO: 11205 - DNA, 201 bp, Homo sapiens; identical to SEQ ID NO: 11168

SEQ ID NO: 11206 - DNA, 201 bp, Homo sapiens; identical to SEQ ID NO: 11159

SEQ ID NO: 11207 - DNA, 201 bp, Homo sapiens
agacggctttggaatccaccagctacatccagctccctgaggcaggactgagtgggcggaggctgaagagttgagaatggagagaatgttacctctcctgrctctggggctcttggcggctgggttctgccctgctgtcctctgccaccctaacagcccacttgacgaggagaatctgacccaggagaaccaagaccgagg

SEQ ID NO: 11208 - DNA, 201 bp, Homo sapiens; identical to SEQ ID NO: 11163

SEQ ID NO: 11209 - DNA, 197 bp, Homo sapiens
cactactccagacagacggctttggaatccaccagctacatccagctccctgaggcaggactgagtgggcggaggctgaagagttgagaatggagaraatgttacctctcctggctctggggctcttggcggctgggttctgccctgctgtcctctgccaccctaacagcccacttgacgaggagaatctgacccag

SEQ ID NO: 11210 - DNA, 201 bp, Homo sapiens; identical to SEQ ID NO: 11164

SEQ ID NO: 11211 - DNA, 201 bp, Homo sapiens; identical to SEQ ID NO: 11174

SEQ ID NO: 11212 - DNA, 201 bp, Homo sapiens; identical to SEQ ID NO: 11177

SEQ ID NO: 11213 - DNA, 201 bp, Homo sapiens; identical to SEQ ID NO: 11178

SEQ ID NO: 11214 - DNA, 201 bp, Homo sapiens
caaagttttccatctcgagggactataacctgaacgacatacttctccagctgggcattgaggaagccttcaccagcaaggctgacctgtcagggatcacrggggccaggaacctagcagtctcccaggtggtccataaggtcgtgtctgatgtatttgaggagggcacagaagcatctgctgccacagcagtcaaaatca

SEQ ID NO: 11215 - DNA, 201 bp, Homo sapiens
caccctcctttctgcattagtggagacaaggaccattgtgcgtttcaacaggcccttcctgatgatcattgtccctacagacacccagaacatcttcttcrtgagcaaagtcaccaatcccagcaagcctagagcttgcatcaagcagtggggctctcagtaaggaacttggaatgcaagctggatgcctgggtctctggg

SEQ ID NO: 11216 - DNA, 201 bp, Homo sapiens; identical to SEQ ID NO: 11167

SEQ ID NO: 11217 - DNA, 201 bp, Homo sapiens
gtggacctcggattagcctccgccaacgtggacttcgctttcagcctgtacaagcagttagtcctgaaggcccttgataagaatgtcatcttctccccacygagcatctccaccgccttggccttcctgtctctgggggcccataataccaccctgacagagattctcaaggcctcgagttcacctcacggagacttactg

SEQ ID NO: 11218 - DNA, 201 bp, Homo sapiens; identical to SEQ ID NO: 11174

SEQ ID NO: 11219 - DNA, 201 bp, Homo sapiens
ctgactttcaggactcagctgcagctaagaagctcatcaacgactacgtgaagaatggaactagggggaaaatcacagatctgatcaaggaccccgactcrcagacaatgatggtcctggtgaattacatcttctttaaagccaaatgggagatgccctttgacccccaagatactcatcagtcaaggttctacttgagca

SEQ ID NO: 11220 - DNA, 201 bp, Homo sapiens
acagcccacttgacgaggagaatctgacccaggagaaccaagaccgagggacacacgtggacctcggattagcctccgccaacgtggacttcgctttcagyctgtacaagcagttagtcctgaaggcccttgataagaatgtcatcttctccccactgagcatctccaccgccttggccttcctgtctctgggggcccata

SEQ ID NO: 11221 - DNA, 201 bp, Homo sapiens
gctgccacagcagtcaaaatcaccctcctttctgcattagtggagacaaggaccattgtgcgtttcaacaggcccttcctgatgatcattgtccctacagrcacccagaacatcttcttcatgagcaaagtcaccaatcccagcaagcctagagcttgcatcaagcagtggggctctcagtaaggaacttggaatgcaagc

SEQ ID NO: 11222 - DNA, 201 bp, Homo sapiens
ggggccccaaagctaggctctgagaaggaaacacactcggctgggcacagtgacgtactccatctcacatctgcctcagtgagggatcagggcagcaaacragggccaagaccatctgagccagccccacatctagaactcccagaccctggacttagccaccagagagctacattttaaaggctgtcttggcaaaaatac

SEQ ID NO: 11223 - DNA, 201 bp, Homo sapiens
agctaagtgtcattgcagaagactctgagagcggcaagcagaatcctggtgacagctgcagcctcgggaccccgcctgggcaggggccccaaagctaggcyctgagaaggaaacacactcggctgggcacagtgacgtactccatctcacatctgcctcagtgagggatcagggcagcaaacaagggccaagaccatctga

SEQ ID NO: 11224 - DNA, 201 bp, Homo sapiens
ggctttcatgatgttttcagaagttggccactgagagtgtaattttcagccttttatatcactaaaataagatcatgttttaattgtgagaaacagggccragcacagtggctcacgcctgtaataccagcaccttagaggtcgaggcaggcggatcacttgaggtcaggagttcaagaccagcctggccaatatggtgaa

SEQ ID NO: 11225 - DNA, 201 bp, Homo sapiens
gggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaa

SEQ ID NO: 11226 - DNA, 201 bp, Homo sapiens
gtgagaaacagaaatacttaaaatgaggaataagaatggagatgttacatctggtagatgtaacattctaccagattatggatggactgatctgaaaatcracctcaactcaagggtggtcagctcaatgctacacagagcacggacttttggattctttgcagtactttgaatttatttttctacctatatatgttttat

SEQ ID NO: 11227 - DNA, 201 bp, Homo sapiens
cgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaa

SEQ ID NO: 11228 - DNA, 201 bp, Homo sapiens
gctgaatttgcagatgagcattcagactgggtaaacatcaccttctgtcctgtggatgacaccattattggaccccctggaatgcaagtagaagtacttgmtgattctttacatatgcgtttcttagcccctaaaattgagaatgaatacgaaacttggactatgaagaatgtgtataactcatggacttataatgtgcaa

SEQ ID NO: 11229 - DNA, 201 bp, Homo sapiens
atatgcgtttcttagcccctaaaattgagaatgaatacgaaacttggactatgaagaatgtgtataactcatggacttataatgtgcaatactggaaaaayggtactgatgaaaagtttcaaattactccccagtatgactttgaggtcctcagaaacctggagccatggacaacttattgtgttcaagttcgagggtttc

SEQ ID NO: 11230 - DNA, 201 bp, Homo sapiens
tgagcaaacaacccatgacgaaacggtcccctcctggatggtggccgtcatcctcatggcctcggtcttcatggtctgcctggcactcctcggctgcttckccttgctgtggtgcgtttacaagaagacaaagtacgccttctcccctaggaattctcttccacagcacctgaaagagtttttgggccatcctcatcataa

SEQ ID NO: 11231 - DNA, 201 bp, Homo sapiens
gctggtgtcagcattgggaatggtaccacctcccgaaaatgtcagaatgaattctgttaatttcaagaacattctacagtgggagtcacctgcttttgccraagggaacctgactttcacagctcagtacctaagttataggatattccaagataaatgcatgaatactaccttgacggaatgtgatttctcaagtctttc

SEQ ID NO: 11232 - DNA, 201 bp, Homo sapiens; identical to SEQ ID NO: 7894

SEQ ID NO: 11233 - DNA, 201 bp, Homo sapiens
ggccgccctcagtgggaggggctctgagaacgactttttaaaacgcagagaaaagctccattcttcccaggacctcagcgcagccctggcccaggaaggcrggagacagaggccaggacggtccagaggtgtcgaaatgtcctggggacctgagcagcagccaccagggaagaggcagggagggagctgaggaccaggctt

SEQ ID NO: 11234 - DNA, 201 bp, Homo sapiens
tctcacactcatcgtcctctgccccgagcaccccacgtgcggctgcatcttcaagaacttcaacctctttctcgccctcatcatctgcaatgccatcatcsaccccctcatctacgccttccacagccaggagctccgcaggacgctcaaggaggtgctgacatgctcctggtgagcgcggtgcacgcggctttaagtgtg

SEQ ID NO: 11235 - DNA, 201 bp, Homo sapiens
agcggaaatggcgcgccgcccggggagggcgggagcagcgtcccgggtgcccctgtgaggatgagcgacgagatgactggagggtccctgaagacctcacyagggtgcccccagccggtccgctcccaggaagcgacacccccacagccccagggctgcagctgagggggtcgccactctggctgggcgaggctgggccct

SEQ ID NO: 11236 - DNA, 201 bp, Homo sapiens
gccccgagcaccccacgtgcggctgcatcttcaagaacttcaacctctttctcgccctcatcatctgcaatgccatcatcgaccccctcatctacgccttycacagccaggagctccgcaggacgctcaaggaggtgctgacatgctcctggtgagcgcggtgcacgcggctttaagtgtgctgggcagagggaggtggtg

SEQ ID NO: 11237 - DNA, 201 bp, Homo sapiens
gcaatgccatcatcgaccccctcatctacgccttccacagccaggagctccgcaggacgctcaaggaggtgctgacatgctcctggtgagcgcggtgcacrcggctttaagtgtgctgggcagagggaggtggtgatattgtgtggtctggttcctgtgtgaccctgggcagttccttacctccctggtccccgtttgtca

SEQ ID NO: 11238 - DNA, 201 bp, Homo sapiens; identical to SEQ ID NO: 7907

SEQ ID NO: 11239 - DNA, 201 bp, Homo sapiens; identical to SEQ ID NO: 7909

SEQ ID NO: 11240 - DNA, 201 bp, Homo sapiens; identical to SEQ ID NO: 7912

SEQ ID NO: 11241 - DNA, 201 bp, Homo sapiens; identical to SEQ ID NO: 7910

SEQ ID NO: 11242 - DNA, 201 bp, Homo sapiens; identical to SEQ ID NO: 7915

SEQ ID NO: 11243 - DNA, 201 bp, Homo sapiens; identical to SEQ ID NO: 7914

SEQ ID NO: 11244 - DNA, 153 bp, Homo sapiens
ggtttctccatgtcggccaggctggtctcgaactcctgacctcaggtgatccmcccgccttgggctcccaaagtgctgggattacagccctgagccaccatggctgacaataataaaaaattttaaagcaaaactaaagatttataaattgta

SEQ ID NO: 11245 - DNA, 201 bp, Homo sapiens
cagaaagcttcatccacagccttgcagcggctcctgcaaaaggaggtgaaatccctgcctcaggccaagggaccaggtttgcaggagcccccctagtggtrtggggctgagccctcctgagggccggttctaaggctcagactgggcactggggcctcagcctgctttcctgcagcagtcgcccaagcagacagccctggc

SEQ ID NO: 11246 - DNA, 201 bp, Homo sapiens; identical to SEQ ID NO: 7918

SEQ ID NO: 11247 - DNA, 201 bp, Homo sapiens
ggtggtgatattgtgtggtctggttcctgtgtgaccctgggcagttccttacctccctggtccccgtttgtcaaagaggatggactaaatgatctctgaargtgttgaagcgcggacccttctgggtccagggaggggtccctgcaaaactccaggcaggacttctcaccagcagtcgtggggaacggaggaggacatggg

SEQ ID NO: 11248 - DNA, 201 bp, Homo sapiens
acctctttctcgccctcatcatctgcaatgccatcatcgaccccctcatctacgccttccacagccaggagctccgcaggacgctcaaggaggtgctgacrtgctcctggtgagcgcggtgcacgcggctttaagtgtgctgggcagagggaggtggtgatattgtgtggtctggttcctgtgtgaccctgggcagttcct

SEQ ID NO: 11249 - DNA, 201 bp, Homo sapiens; identical to SEQ ID NO: 7896

SEQ ID NO: 11250 - DNA, 201 bp, Homo sapiens; identical to SEQ ID NO: 7897

SEQ ID NO: 11251 - DNA, 201 bp, Homo sapiens
gtcgaaatgtcctggggacctgagcagcagccaccagggaagaggcagggagggagctgaggaccaggcttggttgtgagaatccctgagcccaggcggtwgatgccaggaggtgtctggactggctgggccatgcctgggctgacctgtccagccagggagagggtgtgagggcagatctgggggtgcccagatggaagg

SEQ ID NO: 11252 - DNA, 201 bp, Homo sapiens
ggagatccgcggtgtgagggaccccctgggtcctgcacgccgcctggtggcaggccgggccatggtgggtgctcacgcccccggcatgtggccgccctcartgggaggggctctgagaacgactttttaaaacgcagagaaaagctccattcttcccaggacctcagcgcagccctggcccaggaaggcaggagacagagg

SEQ ID NO: 11253 - DNA, 201 bp, Homo sapiens; identical to SEQ ID NO: 7899

SEQ ID NO: 11254 - DNA, 201 bp, Homo sapiens; identical to SEQ ID NO: 7900

SEQ ID NO: 11255 - DNA, 201 bp, Homo sapiens
ggggccctggtgaccaggacagactgtggtgttttttaacgtaaaggagatccgcggtgtgagggaccccctgggtcctgcacgccgcctggtggcaggcygggccatggtgggtgctcacgcccccggcatgtggccgccctcagtgggaggggctctgagaacgactttttaaaacgcagagaaaagctccattcttcc

SEQ ID NO: 11256 - DNA, 201 bp, Homo sapiens
tggggaggttgtggggcctcaggctccgggcaccaggggccaacctcaggctcctaaagagacattttccgcccactcctgggacactccgtctgctccartgactgagcagcatccaccccaccccatctttgctgccagctctcaggaccgtgccctcgtcagctgggatgtgaagtctctgggtggaagtgtgtgcca

SEQ ID NO: 11257 - DNA, 201 bp, Homo sapiens
cttccacccttcagcacagacgcagtcttcagcaaggaagtgctgggaacgccctggagtgaacccaggaagatgcctgcagtgggtgccagggcccctcyccaccgtccctgctgggcttcggggccacgcccgactgctgtgaacggcctgcggagcaccacgtgcgacggctggaggcgagaggtctgcctttgatgt

SEQ ID NO: 11258 - DNA, 201 bp, Homo sapiens; identical to SEQ ID NO: 7903

SEQ ID NO: 11259 - DNA, 201 bp, Homo sapiens; identical to SEQ ID NO: 7904

SEQ ID NO: 11260 - DNA, 201 bp, Homo sapiens; identical to SEQ ID NO: 7901

SEQ ID NO: 11261 - DNA, 201 bp, Homo sapiens; identical to SEQ ID NO: 7905

SEQ ID NO: 11262 - DNA, 201 bp, Homo sapiens; identical to SEQ ID NO: 7908

SEQ ID NO: 11263 - DNA, 201 bp, Homo sapiens; identical to SEQ ID NO: 7911

SEQ ID NO: 11264 - DNA, 201 bp, Homo sapiens; identical to SEQ ID NO: 7921

SEQ ID NO: 11265 - DNA, 201 bp, Homo sapiens
actgactgatcactctcatcagtggcagattttggtgtaacataggacacatcactcccaattcaggtcaagtcccaattatcttgcctctcaatatgacmtgttcaatgttgtatttcattctacttcattttaatgtaaaaagtcttttctggtgaagtcagtcttttattttctcataaaaattcaccctttgggttt

SEQ ID NO: 11266 - DNA, 201 bp, Homo sapiens
tgctgaaagctgaacactcaatgggaagacctgtttgcagagaggagccagccactccagggtctcctttctgctagaagctgaacactcgttgggacacmcttgctgtggaaaggacatccttactgtggaaatgagctactaactgcaggagctgaggagctgcacagcaaggttaaaagagctgtaacacaaacaggg

SEQ ID NO: 11267 - DNA, 201 bp, Homo sapiens
ggagagaaactacccattccagaacctcctctctgctgaaagctgaacactcaatgggaagacctgtttgcagagaggagccagccactccagggtctcckttctgctagaagctgaacactcgttgggacacacttgctgtggaaaggacatccttactgtggaaatgagctactaactgcaggagctgaggagctgcac

SEQ ID NO: 11268 - DNA, 201 bp, Homo sapiens
tttattgaatgaacaggaaacagggaaagacattgaccagaaaaagtgtttattcatcaagtctttaaagatacaaaaacacgtgtcttctgtggagctcwgagaacaggactccagcaaagcacttttcagccttgtggtcttcaagcatttccaagatctgtgacattggaaagaaaaaaaattaagacagatttgggt

SEQ ID NO: 11269 - DNA, 201 bp, Homo sapiens
ttttcagccttgtggtcttcaagcatttccaagatctgtgacattggaaagaaaaaaaattaagacagatttgggtctccatgagcagagagtattctttsccttagttctgggtagcatagtgcccaaggaaacctaatcagtacagtgggaaaccaaatctattccaaatcattacccataagcaatcctatggactct

SEQ ID NO: 11270 - DNA, 201 bp, Homo sapiens
caatgatatttattgaatgaacaggaaacagggaaagacattgaccagaaaaagtgtttattcatcaagtctttaaagatacaaaaacacgtgtcttctgkggagctctgagaacaggactccagcaaagcacttttcagccttgtggtcttcaagcatttccaagatctgtgacattggaaagaaaaaaaattaagacag

SEQ ID NO: 11271 - DNA, 201 bp, Homo sapiens
aagaaaaaaaattaagacagatttgggtctccatgagcagagagtattctttcccttagttctgggtagcatagtgcccaaggaaacctaatcagtacagwgggaaaccaaatctattccaaatcattacccataagcaatcctatggactctctgaggtttgacagagtcagcggccctctccaataaatgtgtttttct

SEQ ID NO: 11272 - DNA, 201 bp, Homo sapiens
cttctgcatgaatcctcccttcattattttcagctcatctattattgaatctgaaaccccaggttaactgactgatcactctcatcagtggcagattttgktgtaacataggacacatcactcccaattcaggtcaagtcccaattatcttgcctctcaatatgacctgttcaatgttgtatttcattctacttcatttta

SEQ ID NO: 11273 - DNA, 201 bp, Homo sapiens
attgaatgaacaggaaacagggaaagacattgaccagaaaaagtgtttattcatcaagtctttaaagatacaaaaacacgtgtcttctgtggagctctgaraacaggactccagcaaagcacttttcagccttgtggtcttcaagcatttccaagatctgtgacattggaaagaaaaaaaattaagacagatttgggtctc

SEQ ID NO: 11274 - DNA, 164 bp, Homo sapiens
atggcccaagctgacatcgtgctgatcggattggcagtcatgggccagaacttaattctgaccrtgaaagaccatggctttgtggtctgtgcttttaataggactgtctccgaagtggatgatttcttggccaatgaggcaaagggaaccaaagtggtgggtgc

SEQ ID NO: 11275 - DNA, 201 bp, Homo sapiens
cacctgatgaaagacgtgctgggcatggcacaggacaagatggcccaggcctttgaggattggaataagacagagctagactcattcctgattgaaatcasagccaatattctcaagttccaaggtgctgatggcaaacacttgctgccaaagatcagggacagtgcagggcagaagggcatggggaagtggaccaccatc

SEQ ID NO: 11276 - DNA, 201 bp, Homo sapiens
ctagcaaaaagctgaagggtccccaaaagttccagtttgatggctttatgctgctaaggcagggagccaccgagtttggctggaccctcaattatggtgayattgccctgatgtggagagggggctgcattattagaagtgtattcctaggaaagataaaggatgcgtttgatcgaaacccagaacctcagaacctcctac

SEQ ID NO: 11277 - DNA, 201 bp, Homo sapiens
gtgctgatggcaaacacttgctgccaaagatcagggacagtgcagggcagaagggcatggggaagtggaccaccatctctgccctggagtacggcataccygtcaccctcattggagaagccgtctttgcttggtgcctgtcatctctgaaggatgggagaattcaagctagcaaaaagctgaagggtccccaaaagttcc

SEQ ID NO: 11278 - DNA, 201 bp, Homo sapiens
ccaccgagtttggctggaccctcaattatggtgacattgccctgatgtggagagggggctgcattattagaagtgtattcctaggaaagataaaggatgcrtttgatcgaaacccagaacctcagaacctcctactggacgacttcttaagtcagctgttgaaaaccgctaggactcttggtggtgggcagtcagcactgg

SEQ ID NO: 11279 - DNA, 124 bp, Homo sapiens
atggcccaagctgacatcgtgctratcggattggcagtcatgggccagaacttaattctgaccatgaaagaccatggctttgtggtctgtgcttttaataggactgtctccgaagtggatgatt

SEQ ID NO: 11280 - DNA, 201 bp, Homo sapiens
tatagggacaccacaagacggtgccaagacctcaaggccaagggaattttatttgtggggagcggagtcagtggtggagaggaaggggcctggatagagtrtggggacatgcagctgatctgtgaggcataccacctgatgaaagacgtgctgggcatggcacaggacaagatggcccaggcctttgaggattggaataag

SEQ ID NO: 11281 - DNA, 201 bp, Homo sapiens
atcatcattgatggaggaaattctgaatatagggacaccacaagacggtgccaagacctcaaggccaagggaattttatttgtggggagcggagtcagtgrtggagaggaaggggcctggatagagtatggggacatgcagctgatctgtgaggcataccacctgatgaaagacgtgctgggcatggcacaggacaagatg

SEQ ID NO: 11282 - DNA, 201 bp, Homo sapiens
ggcattcccatgccctgttttgtcactgccctctccttctatgacaagtacagacacgagatgcttccagccaacctcatccaggctcagcgggattcctytggggctcacacctatgaactcttggccaaaccagggcagtttatccacaccaactggacaggccacggtggcagtgtatcatcctcgtcatacaatgcc

SEQ ID NO: 11283 - DNA, 192 bp, Homo sapiens
catgagcttgcctactttccttggtatttcatttttggagccagaaacaaaatcctcccagatgctctgcttggcccctgtgagtctgacctgcaggcctrtgtctggcagagggcacgcaacagtggctcacctcccactcgcactgcgcaggggctgacacagggagaacgggagtcatagctctgtgtc

SEQ ID NO: 11284 - DNA, 201 bp, Homo sapiens
gtctcgaactcctggcctcaagtgaccctcctaccttggtctaccaaaatgcttcatttacaggcatgagctaccatgcctggcctacttcttgcggggargtgggaggtacagaagagttctgttccctgttatataaaggcccaccctccaggaactgtgatttgtagctcagttggtaggaggggtcttgcaacctgg

SEQ ID NO: 11285 - DNA, 201 bp, Homo sapiens
agctgagattgaggattctgacatgcatgagcttgcctactttccttggtatttcatttttggagccagaaacaaaatcctcccagatgctctgcttggcycctgtgagtctgacctgcaggcctgtgtctggcagagggcacgcaacagtggctcacctcccactcgcactgcgcaggggctgacacagggagaacggga

SEQ ID NO: 11286 - DNA, 201 bp, Homo sapiens
cgaactcctggcctcaagtgaccctcctaccttggtctaccaaaatgcttcatttacaggcatgagctaccatgcctggcctacttcttgcggggaggtgsgaggtacagaagagttctgttccctgttatataaaggcccaccctccaggaactgtgatttgtagctcagttggtaggaggggtcttgcaacctggcccg

SEQ ID NO: 11287 - DNA, 201 bp, Homo sapiens
tctgttccctgttatataaaggcccaccctccaggaactgtgatttgtagctcagttggtaggaggggtcttgcaacctggcccgaggcagtgactaaggyacaggctatatgtggggccctggggtttgtcatctctgctgctaacaaaggtggaaaattcctacttcctgagctgagattgaggattctgacatgcatg

SEQ ID NO: 11288 - DNA, 150 bp, Homo sapiens
agaaacaaaatcctcccagatgctctgcttggcccctgtgagtctgacctgcaggcctgtgtctggcagagggcacgcaacagtggctcacctcccactcrcactgcgcaggggctgacacagggagaacgggagtcatagctctgtgtc

SEQ ID NO: 11289 - DNA, 201 bp, Homo sapiens
tttcccaaataagagctgctattatgaggcattaatgtacagaccgtttcatatgtatacttggttgcttaggaacaaagataattccagttccagaatayatgaattgcagaattagtaacttctgttaaagataattggaggttaagagaattagtcagggaagctgaaaaaggaaactaaagttagagacagaaacta

SEQ ID NO: 11290 - DNA, 201 bp, Homo sapiens
atatgtatacttggttgcttaggaacaaagataattccagttccagaatatatgaattgcagaattagtaacttctgttaaagataattggaggttaagasaattagtcagggaagctgaaaaaggaaactaaagttagagacagaaactaagtaaagataagaaaaatgagctttacaaagctactctagtggcatctgg

SEQ ID NO: 11291 - DNA, 201 bp, Homo sapiens
gttcttaggtgattagcacacttcccctccccatcttcccacttaatttctccatatttcttcttccccttttaggtaaacttactggtccttgctctatraagtttctcctaaaagtcacccctttcaccactgtgtccttttacacactttgtacaagttacttctaacagtgatttgcttacatgtttgtcctcccca

SEQ ID NO: 11292 - DNA, 201 bp, Homo sapiens
ttttgatcccatctcttaatatttcctgttgacttctgttcattcctattgcaaggaacattattgctgcctttgataaggccattatcatttttctctcrtatcttcctaatatgcatttttttaaccagtcttcctgcctccagtcttgcctcctccaatcgatccttgatgctgccaaagtggtatttgtgaaatgca

SEQ ID NO: 11293 - DNA, 201 bp, Homo sapiens
atggtttaaatgtactataaccctttcccaaataagagctgctattatgaggcattaatgtacagaccgtttcatatgtatacttggttgcttaggaacamagataattccagttccagaatatatgaattgcagaattagtaacttctgttaaagataattggaggttaagagaattagtcagggaagctgaaaaaggaa

SEQ ID NO: 11294 - DNA, 201 bp, Homo sapiens
ccataactctaaacagcaatctgcagtcatgtccttttgatcccatctcttaatatttcctgttgacttctgttcattcctattgcaaggaacattattgytgcctttgataaggccattatcatttttctctcgtatcttcctaatatgcatttttttaaccagtcttcctgcctccagtcttgcctcctccaatcgatc

SEQ ID NO: 11295 - DNA, 201 bp, Homo sapiens
cattattgctgcctttgataaggccattatcatttttctctcgtatcttcctaatatgcatttttttaaccagtcttcctgcctccagtcttgcctcctcmaatcgatccttgatgctgccaaagtggtatttgtgaaatgcagtttagcatgctgcttcagctttgtaattgtttctcctaatggtcaaacccaaactcc

SEQ ID NO: 11296 - DNA, 201 bp, Homo sapiens
gtcacccctttcaccactgtgtccttttacacactttgtacaagttacttctaacagtgatttgcttacatgtttgtcctccccacatctagcccagtgaytggttcaaaaaaggcactaaaaaaatggataaaattaaatatattactcttaatgattagtgtaatataaatatttacaccccatatctaagttctggct

SEQ ID NO: 11297 - DNA, 201 bp, Homo sapiens
ccagatgccactagagtagctttgtaaagctcattttcttatctttacttagtttctgtctctaactttagtttcctttttcagcttccctgactaattcscttaacctccaattatctttaacagaagttactaattctgcaattcatatattctggaactggaattatctttgttcctaagcaaccaagtatacatatg

SEQ ID NO: 11298 - DNA, 201 bp, Homo sapiens
tggggaggacaaacatgtaagcaaatcactgttagaagtaacttgtacaaagtgtgtaaaaggacacagtggtgaaaggggtgacttttaggagaaacttratagagcaaggaccagtaagtttacctaaaaggggaagaagaaatatggagaaattaagtgggaagatggggaggggaagtgtgctaatcacctaagaac

SEQ ID NO: 11299 - DNA, 201 bp, Homo sapiens
tagtttctgtctctaactttagtttcctttttcagcttccctgactaattctcttaacctccaattatctttaacagaagttactaattctgcaattcatytattctggaactggaattatctttgttcctaagcaaccaagtatacatatgaaacggtctgtacattaatgcctcataatagcagctcttatttgggaaa

SEQ ID NO: 11300 - DNA, 201 bp, Homo sapiens
ttcctttttcagcttccctgactaattctcttaacctccaattatctttaacagaagttactaattctgcaattcatatattctggaactggaattatctmtgttcctaagcaaccaagtatacatatgaaacggtctgtacattaatgcctcataatagcagctcttatttgggaaagggttatagtacatttaaaccat

SEQ ID NO: 11301 - DNA, 201 bp, Homo sapiens
ggagtttgggtttgaccattaggagaaacaattacaaagctgaagcagcatgctaaactgcatttcacaaataccactttggcagcatcaaggatcgattmgaggaggcaagactggaggcaggaagactggttaaaaaaatgcatattaggaagatatgagagaaaaatgataatggccttatcaaaggcagcaataatg

SEQ ID NO: 11302 - DNA, 201 bp, Homo sapiens
agccagaacttagatatggggtgtaaatatttatattacactaatcattaagagtaatatatttaattttatccatttttttagtgccttttttgaaccaytcactgggctagatgtggggaggacaaacatgtaagcaaatcactgttagaagtaacttgtacaaagtgtgtaaaaggacacagtggtgaaaggggtgac

SEQ ID NO: 11303 - DNA, 201 bp, Homo sapiens
tgcatttcacaaataccactttggcagcatcaaggatcgattggaggaggcaagactggaggcaggaagactggttaaaaaaatgcatattaggaagatargagagaaaaatgataatggccttatcaaaggcagcaataatgttccttgcaataggaatgaacagaagtcaacaggaaatattaagagatgggatcaaaa

SEQ ID NO: 11304 - DNA, 201 bp, Homo sapiens
gatcgattggaggaggcaagactggaggcaggaagactggttaaaaaaatgcatattaggaagatatgagagaaaaatgataatggccttatcaaaggcaycaataatgttccttgcaataggaatgaacagaagtcaacaggaaatattaagagatgggatcaaaaggacatgactgcagattgctgtttagagttatgg

SEQ ID NO: 11305 - DNA, 201 bp, Homo sapiens
cgccttaagagctgtaacactcaccgcaaaggtctgcagcttcactcctgagccagcgagaccacgaacccaccagaaggaagaaactccgaacacatccraacatcagaaggaacaaactccagacgcaccaccttaagagctgtaacactcaccgcaagggtccgcagtttcattcttgaagtcagtgagaccaagaac

SEQ ID NO: 11306 - DNA, 201 bp, Homo sapiens
cctgtcttagcactgccctgctagctcttcctgaaaaggcctataaataaacagggctggctgttcgctcgtgctatggggagtccctgatgggcacagaygggagtggctggggcgtacctcggtgggtgcacacatgttgctggccaggaagatgccgtggcaggccctggaggaggctcttgacattagggggctttg

SEQ ID NO: 11307 - DNA, 201 bp, Homo sapiens
tctggaaaaaaaagaaaaaagatacgactctcagaagcctgttttaaggaagccctaaaatgtggactgggtttcctgtcttagcactgccctgctagctyttcctgaaaaggcctataaataaacagggctggctgttcgctcgtgctatggggagtccctgatgggcacagacgggagtggctggggcgtacctcggtg

SEQ ID NO: 11308 - DNA, 201 bp, Homo sapiens
tcatccccgtggcgtacttggtcttctgggccttcctgctggtcttcagcttcatctcagagcctatggtctgtggggtcggcgtcatcatcatccttackggggtgcccattttctttctgggagtgttctggagaagcaaaccaaagtgtgtgcacagactcacagagtccatgacacactggggccaggagctgtgtt

SEQ ID NO: 11309 - DNA, 201 bp, Homo sapiens
gtccccccaggagctgctctcctccaatgcggtggctgtggtgagtgggcccctgctcggtccctggctcctgcccaggcccctgccccggccttacacayggcctctctactgtgcccacccagaccttcggggagaagctgctgggctacttttcttgggtcatgcctgtctccgtggctctgtcaaccttcggaggga

SEQ ID NO: 11310 - DNA, 201 bp, Homo sapiens
ggctgtgcttctctggagcccgcgaggggcacctgcccagcctgctggccatgatccacgtcagacactgcacccccatccccgccctcctcgtctgttgyggggccacagccgtcatcatgctcgtgggcgacacgtacacgctcatcaactatgtgtccttcatcaactacctctgctacggcgtcaccatcctgggcc

SEQ ID NO: 11311 - DNA, 144 bp, Homo sapiens
gaggatggggtagcagctcagtccgcccctaccccaggcccctcgatgccagtctgagctcggccacccaggagagctcaggggctccaggctgggattgyctttcttcccgtaaatcaccacagagtgaaggtcaggacttca

SEQ ID NO: 11312 - DNA, 201 bp, Homo sapiens
tgctctcctccaatgcggtggctgtggtgagtgggcccctgctcggtccctggctcctgcccaggcccctgccccggccttacacatggcctctctactgygcccacccagaccttcggggagaagctgctgggctacttttcttgggtcatgcctgtctccgtggctctgtcaaccttcggagggatcaatggttacctg

SEQ ID NO: 11313 - DNA, 201 bp, Homo sapiens
ctcgtgggcgacacgtacacgctcatcaactatgtgtccttcatcaactacctctgctacggcgtcaccatcctgggcctgctgctgctgcgctggaggcrgcctgcactccacaggcccatcaaggtgaaccttctcatccccgtggcgtacttggtcttctgggccttcctgctggtcttcagcttcatctcagagcct

SEQ ID NO: 11314 - DNA, 201 bp, Homo sapiens
gctacttttcttgggtcatgcctgtctccgtggctctgtcaaccttcggagggatcaatggttacctgttcacctactccaggtgactgcactggggagaygtgggcatggggagggaaggctggggtgcaggtgtgcaccagtcatgccgtgggccagaggaagggacacctgccgggggaggggtctgcctgaagctgg

SEQ ID NO: 11315 - DNA, 201 bp, Homo sapiens; identical to SEQ ID NO: 11306

SEQ ID NO: 11316 - DNA, 201 bp, Homo sapiens; identical to SEQ ID NO: 11307

SEQ ID NO: 11317 - DNA, 201 bp, Homo sapiens; identical to SEQ ID NO: 11308

SEQ ID NO: 11318 - DNA, 201 bp, Homo sapiens; identical to SEQ ID NO: 11309

SEQ ID NO: 11319 - DNA, 201 bp, Homo sapiens; identical to SEQ ID NO: 11310

SEQ ID NO: 11320 - DNA, 144 bp, Homo sapiens; identical to SEQ ID NO: 11311

SEQ ID NO: 11321 - DNA, 201 bp, Homo sapiens; identical to SEQ ID NO: 11312

SEQ ID NO: 11322 - DNA, 201 bp, Homo sapiens; identical to SEQ ID NO: 11313

SEQ ID NO: 11323 - DNA, 201 bp, Homo sapiens; identical to SEQ ID NO: 11314

SEQ ID NO: 11324 - DNA, 201 bp, Homo sapiens; identical to SEQ ID NO: 11306

SEQ ID NO: 11325 - DNA, 201 bp, Homo sapiens; identical to SEQ ID NO: 11308

SEQ ID NO: 11326 - DNA, 201 bp, Homo sapiens; identical to SEQ ID NO: 11310

SEQ ID NO: 11327 - DNA, 201 bp, Homo sapiens
gggggcgtgacggctctgggctccctctgctatgcagagctgggagtcgccatccccaagtctggcggggactacgcctacgtcacagagatcttcggggrcctggctggctttctgctgctctggagcgccgtcctcatcatgtaccccaccagccttgctgtcatctccatgaccttctccaactacgtgctgcagccc

SEQ ID NO: 11328 - DNA, 144 bp, Homo sapiens; identical to SEQ ID NO: 11311

SEQ ID NO: 11329 - DNA, 201 bp, Homo sapiens; identical to SEQ ID NO: 11307

SEQ ID NO: 11330 - DNA, 201 bp, Homo sapiens; identical to SEQ ID NO: 11313

SEQ ID NO: 11331 - DNA, 201 bp, Homo sapiens
ccggcccgtggcagtgcaacacggtggacgagtgtggagacggctctgatgagggcaactgctcggcgcccgcctccgagcctccaggcagcctgtgcccyggggggaccttcccatgcagcggggcgcgctccacgcgctgcctgcctgtggagcggcgctgtgacggcttgcaggactgcggcgacggctcggatgagg

SEQ ID NO: 11332 - DNA, 201 bp, Homo sapiens
caaagccccctaatgtcaagagcctcctccagggcctgccacggcatcttcctggccagcaacatgtgtgcacccaccgaggtacgccccagccactcccrtctgtgcccatcagggactccccatagcacgagcgaacagccagccctgtttatttataggccttttcaggaagagctagcagggcagtgctaagacagg

SEQ ID NO: 11333 - DNA, 201 bp, Homo sapiens
gcacgtggctggtggacacacaggactcccggcgggtgctgctgcagctggaactgcggctgggctatgacgactacgtgcaggtatacgagggcctgggygagcgcggggaccgcctgctgcagacgctgtcctaccgcagcaaccaccggcccgtgagcctggaggccgcccagggccgcctcaccgtggcctaccacg

SEQ ID NO: 11334 - DNA, 201 bp, Homo sapiens
ggaagctggagcagcacacggagcggcgtggggtcatctacagcccggcctggcccctcaactacccgccaggcaccaactgcagctggtacatccagggygaccgtggtgacatgattaccatcagcttccgcaactttgacgtggaggagtcccaccagtgctccctggactggctcctgctgggcccagcagccccac

SEQ ID NO: 11335 - DNA, 201 bp, Homo sapiens
caccgaggtacgccccagccactcccgtctgtgcccatcagggactccccatagcacgagcgaacagccagccctgtttatttataggccttttcaggaaragctagcagggcagtgctaagacaggaaacccagtccacattttagggcttccttaaaacaggcttctgagagtcgtatcttttttcttttttttccaga

SEQ ID NO: 11336 - DNA, 201 bp, Homo sapiens
acggctctgatgagggcaactgctcggcgcccgcctccgagcctccaggcagcctgtgccccggggggaccttcccatgcagcggggcgcgctccacgcgytgcctgcctgtggagcggcgctgtgacggcttgcaggactgcggcgacggctcggatgaggcgggctgccccgacctggcgtgcggccggcggctgggca

SEQ ID NO: 11337 - DNA, 201 bp, Homo sapiens
actgcggcgacggctcggatgaggcgggctgccccgacctggcgtgcggccggcggctgggcagcttctacggctcctttgcctccccagacctgttcggygccgctcgcgggccctcagaccttcactgcacgtggctggtggacacacaggactcccggcgggtgctgctgcagctggaactgcggctgggctatgacg

SEQ ID NO: 11338 - DNA, 201 bp, Homo sapiens
atctctgcccgcgaccatgtctggattttcttccactcagacgcctccagctccggccaggcccagggcttccgtctgtcttacatccgagggaagctggrccaggcatcctgccaggcagatgagttccgctgtgacaacggcaagtgcctgcccggcccgtggcagtgcaacacggtggacgagtgtggagacggctct

SEQ ID NO: 11339 - DNA, 201 bp, Homo sapiens
gctgtacatgaagcccctggagttccctgcaggcctcaaagcccccaggacatgctgctctgtgctttctggggacagagaggccgaggcaccaacagcartggccacgtctgttccatcctatctcagggcctcggtttccccacctgtaagccagggtgagactgtgggctctgaagtcctgaccttcactctgtggtg

SEQ ID NO: 11340 - DNA, 201 bp, Homo sapiens
gcctctggaggacctgggttgggtggctcctgccaaaccctcatgcccctggccaggcaggcgccctttgccctccctgaaggtccaatctcctgggcacygtggaagggctggggtgtgtgcctgctgtacatgaagcccctggagttccctgcaggcctcaaagcccccaggacatgctgctctgtgctttctggggac

SEQ ID NO: 11341 - DNA, 201 bp, Homo sapiens
tagcggcctgcagtgggaagctggagcagcacacggagcggcgtggggtcatctacagcccggcctggcccctcaactacccgccaggcaccaactgcagytggtacatccagggcgaccgtggtgacatgattaccatcagcttccgcaactttgacgtggaggagtcccaccagtgctccctggactggctcctgctgg

SEQ ID NO: 11342 - DNA, 201 bp, Homo sapiens
tgctggtcatcgcgctgggctgcgccttcaagctctactcactgcgcacgcaggaatacagggccttcgagacccagatgacgcgcctggaggctgagttygtgcggcgggaggcacccccatcctatggtcagctcatcgcccagggcctcattccacccgtggaggactttcctgtctacagtgcgtcccaggcctctg

SEQ ID NO: 11343 - DNA, 201 bp, Homo sapiens
atcctatctcagggcctcggtttccccacctgtaagccagggtgagactgtgggctctgaagtcctgaccttcactctgtggtgatttacgggaagaaagrcaatcccagcctggagcccctgagctctcctgggtggccgagctcagactggcatcgaggggcctggggtaggggcggactgagctgctaccccatcctc

SEQ ID NO: 11344 - DNA, 201 bp, Homo sapiens
cctgggcccccactcgccagagccactgggggtctgcaggaaccccccgcccccctgctccccaatgctggaggccagcgatgatgaggccctgttggtcwgttgaccgctgggctcgctggtgaccgccacagccccgctttgtaaccagggaatacacagtcatttctaccctgcctctgcgtcctttcttatggagag

SEQ ID NO: 11345 - DNA, 201 bp, Homo sapiens
agctggccgtcgtctgtctggtgaacatctttctcaccgggagactcagcagtgcggttcctgccttagcggcctgcagtgggaagctggagcagcacacrgagcggcgtggggtcatctacagcccggcctggcccctcaactacccgccaggcaccaactgcagctggtacatccagggcgaccgtggtgacatgatta

SEQ ID NO: 11346 - DNA, 201 bp, Homo sapiens
cgtgcgggagcagtagtgacagtgacgggggcagcctgggcgaccagggctgcttctcagagccacagcgctgtgatggctggtggcattgtgccagcggycgagacgagcagggctgccctgcctgcccgcccgaccagtacccctgcgagggtggcagtggtctgtgctacacgcctgccgaccgctgcaacaaccaga

SEQ ID NO: 11347 - DNA, 201 bp, Homo sapiens
ccggaggtgggaccttcagggccacccttgccctcgggcctgcgagacccagagtgcaggcccgtggacaaggacagaaaggtctgcagggagccactggyagacggcccagctcctgcagatgcacctcgggagccctgctcagcccaggacccgcacccccaggtctccactgccagcagcaccctgggcccccactcg

SEQ ID NO: 11348 - DNA, 201 bp, Homo sapiens
acgagggcctgggcgagcgcggggaccgcctgctgcagacgctgtcctaccgcagcaaccaccggcccgtgagcctggaggccgcccagggccgcctcacygtggcctaccacgcgcgcgcccgcagcgccggccacggcttcaatgccacctaccaggtgaagggctattgcctcccctgggagcagccgtgcgggagca

SEQ ID NO: 11349 - DNA, 201 bp, Homo sapiens
gctcaaggcttaactccaacacgcaaggggagatgaagtttgaggtggaaaacctcatcctacacaaggactacagcgctgacacgcttgctcaccacaaygacattgccttgctgaagatccgttccaaggagggcaggtgtgcgcagccatcccggactatacagaccatctgcctgccctcgatgtataacgatcccc

SEQ ID NO: 11350 - DNA, 201 bp, Homo sapiens
tggttgtcatttttgcagtagagtcatctccatcagctgtaagaagagactgggaagataggctctgcacagatggatttgcctgtgccacccaccagggygaacgacaatagctttaccctcaggcataggcctgggtgctggctgcccagacccctctggccaggatggaggggtggtcctgactcaacatgttactga

SEQ ID NO: 11351 - DNA, 201 bp, Homo sapiens
caaggggagatgaagtttgaggtggaaaacctcatcctacacaaggactacagcgctgacacgcttgctcaccacaacgacattgccttgctgaagatccrttccaaggagggcaggtgtgcgcagccatcccggactatacagaccatctgcctgccctcgatgtataacgatccccagtttggcacaagctgtgagatc

SEQ ID NO: 11352 - DNA, 201 bp, Homo sapiens
cccgctttcttgctggttgtcatttttgcagtagagtcatctccatcagctgtaagaagagactgggaagataggctctgcacagatggatttgcctgtgscacccaccagggtgaacgacaatagctttaccctcaggcataggcctgggtgctggctgcccagacccctctggccaggatggaggggtggtcctgactc

SEQ ID NO: 11353 - DNA, 201 bp, Homo sapiens
agcttagccaatgtgggagcagcggtttggggagcagagacactaacgacttcagggcagggctctgatattccatgaatgtatcaggaaatatatatgtktgtgtatgtttgcacacttgtgtgtgggctgtgagtgtaagtgtgagtaagagctggtgtctgattgttaagtctaaatatttccttaaactgtgtggac

SEQ ID NO: 11354 - DNA, 201 bp, Homo sapiens
ccacagtggaaaacagattcctgccagggagactcagggggacccctcgtctgttccctccaaggccgcatgactttgactggaattgtgagctggggccktggatgtgccctgaaggacaagccaggcgtctacacgagagtctcacacttcttaccctggatccgcagtcacaccaaggaagagaatggcctggccctc

SEQ ID NO: 11355 - DNA, 201 bp, Homo sapiens
ctgacaccatgggccggccctgcctgccctggaactctgccactgtccttcagcaaacgtaccatgcccacagatctgatgctcttcagctgggcctgggraaacataattactgcaggaacccagacaaccggaggcgaccctggtgctatgtgcaggtgggcctaaagccgcttgtccaagagtgcatggtgcatgact

SEQ ID NO: 11356 - DNA, 201 bp, Homo sapiens
gctcgcgccctcctgccgcagccaccgagccgccgtctagcgccccgacctcgccaccatgagagccctgctggcgcgcctgcttctctgcgtcctggtcktgagcgactccaaaggcagcaatgaacttcatcaagttccatcgaactgtgactgtctaaatggaggaacatgtgtgtccaacaagtacttctccaacat

SEQ ID NO: 11357 - DNA, 201 bp, Homo sapiens
tcgcagcacagtgcggagaccgcagccccggagcccgggccagggtccacctgtccccgcagcgccggctcgcgccctcctgccgcagccaccgagccgcygtctagcgccccgacctcgccaccatgagagccctgctggcgcgcctgcttctctgcgtcctggtcgtgagcgactccaaaggcagcaatgaacttcatc

SEQ ID NO: 11358 - DNA, 201 bp, Homo sapiens
agatctgatgctcttcagctgggcctggggaaacataattactgcaggaacccagacaaccggaggcgaccctggtgctatgtgcaggtgggcctaaagcygcttgtccaagagtgcatggtgcatgactgcgcagatggaaaaaagccctcctctcctccagaagaattaaaatttcagtgtggccaaaagactctgagg

SEQ ID NO: 11359 - DNA, 201 bp, Homo sapiens
acagtgcggagaccgcagccccggagcccgggccagggtccacctgtccccgcagcgccggctcgcgccctcctgccgcagccaccgagccgccgtctagmgccccgacctcgccaccatgagagccctgctggcgcgcctgcttctctgcgtcctggtcgtgagcgactccaaaggcagcaatgaacttcatcaagttcc

SEQ ID NO: 11360 - DNA, 201 bp, Homo sapiens
caggaggcaccgggggggctctgtcacctacgtgtgtggaggcagcctcatcagcccttgctgggtgatcagcgccacacactgcttcattgattacccamagaaggaggactacatcgtctacctgggtcgctcaaggcttaactccaacacgcaaggggagatgaagtttgaggtggaaaacctcatcctacacaagga

SEQ ID NO: 11361 - DNA, 201 bp, Homo sapiens; identical to SEQ ID NO: 11349

SEQ ID NO: 11362 - DNA, 179 bp, Homo sapiens
agcaatcagcatgacagcctccagccaagtaatctggagtcatgagagctgctaggggagcaacatgaatcatgacggyccctgggaatttcctgataactaacctgggagtttcgggagccgccgtctagcgccccgacctcgccaccatgagagccctgctggcgcgcctgcttctc

SEQ ID NO: 11363 - DNA, 201 bp, Homo sapiens; identical to SEQ ID NO: 11350

SEQ ID NO: 11364 - DNA, 201 bp, Homo sapiens; identical to SEQ ID NO: 11351

SEQ ID NO: 11365 - DNA, 201 bp, Homo sapiens; identical to SEQ ID NO: 11352

SEQ ID NO: 11366 - DNA, 201 bp, Homo sapiens; identical to SEQ ID NO: 11353

SEQ ID NO: 11367 - DNA, 146 bp, Homo sapiens
agcaatcagcatgacagcctccagccaagtaatctggagtcatgaragctgctaggggagcaacatgaatcatgacggcccctgggaatttcctgataactaacctgggagtttcgggagccgccgtctagcgccccgacctcgcc

SEQ ID NO: 11368 - DNA, 201 bp, Homo sapiens; identical to SEQ ID NO: 11354

SEQ ID NO: 11369 - DNA, 201 bp, Homo sapiens
cctgataactaacctgggagtttcgggagccgccgtctagcgccccgacctcgccaccatgagagccctgctggcgcgcctgcttctctgcgtcctggtcktgagcgactccaaaggcagcaatgaacttcatcaagttccatcgaactgtgactgtctaaatggaggaacatgtgtgtccaacaagtacttctccaacat

SEQ ID NO: 11370 - DNA, 201 bp, Homo sapiens; identical to SEQ ID NO: 11355

SEQ ID NO: 11371 - DNA, 201 bp, Homo sapiens
ccaagtaatctggagtcatgagagctgctaggggagcaacatgaatcatgacggcccctgggaatttcctgataactaacctgggagtttcgggagccgcygtctagcgccccgacctcgccaccatgagagccctgctggcgcgcctgcttctctgcgtcctggtcgtgagcgactccaaaggcagcaatgaacttcatc

SEQ ID NO: 11372 - DNA, 201 bp, Homo sapiens; identical to SEQ ID NO: 11358

SEQ ID NO: 11373 - DNA, 201 bp, Homo sapiens
atctggagtcatgagagctgctaggggagcaacatgaatcatgacggcccctgggaatttcctgataactaacctgggagtttcgggagccgccgtctagmgccccgacctcgccaccatgagagccctgctggcgcgcctgcttctctgcgtcctggtcgtgagcgactccaaaggcagcaatgaacttcatcaagttcc

SEQ ID NO: 11374 - DNA, 201 bp, Homo sapiens; identical to SEQ ID NO: 11360

SEQ ID NO: 11375 - DNA, 201 bp, Homo sapiens
cgtggcatttccgtggacagcccgccgtcagggtggctggggctggcacgggtgtcgaggcaggaaggattgtttctggtgactgcagccgctgccgtcgygacacagggcttggtggtggtagcatttgggtctgagatcggcccagctctgactgaaggggcttggcttccactcagcatcagcgtggcagtcaccacc

SEQ ID NO: 11376 - DNA, 201 bp, Homo sapiens
gctggggctggcacgggtgtcgaggcaggaaggattgtttctggtgactgcagccgctgccgtcgcgacacagggcttggtggtggtagcatttgggtctkagatcggcccagctctgactgaaggggcttggcttccactcagcatcagcgtggcagtcaccaccccagtgaggacctcgatgtccagctgctgtcaggt

SEQ ID NO: 11377 - DNA, 201 bp, Homo sapiens
taaatgccccatctcatgggggagagacagccacggaggccttcctctgaccatagctgatggactggcggttgctcaggtccggctccgagaatgttccygtgtctgagcctggaagaggctcgggtctggctccgggcgtggttcccttcccgtgtctgagcctggaagaggctcgggtccggctccgagcgtggttcc

SEQ ID NO: 11378 - DNA, 136 bp, Homo sapiens
agaggctcgggtctggctccgggcgtggttcccttcccgtgtctgagcctggaagaggctcgggtccggctccgagcgtggttcccttcccgtgtctgagyctggaagaggctcgggtccggctccgagcgtggtt

SEQ ID NO: 11379 - DNA, 201 bp, Homo sapiens
gccacggaggccttcctctgaccatagctgatggactggcggttgctcaggtccggctccgagaatgttcctgtgtctgagcctggaagaggctcgggtcyggctccgggcgtggttcccttcccgtgtctgagcctggaagaggctcgggtccggctccgagcgtggttcccttcccgtgtctgagtctggaagaggctc

SEQ ID NO: 11380 - DNA, 201 bp, Homo sapiens
cggcgaagaactggacaagctctggcgggagttcctgcatcacaaagagaaagttcacgagtacaacgtcctgctggagaccctgagcaggaccgaagaartccacgagaacgtcattagcccctcggacctgagcgacatcaagggcagcgtcctgcacagcaggcacacggagctgaaggagaagctgcgcagcatcaa

SEQ ID NO: 11381 - DNA, 201 bp, Homo sapiens
agatcggcccagctctgactgaaggggcttggcttccactcagcatcagcgtggcagtcaccaccccagtgaggacctcgatgtccagctgctgtcaggtytgatagtcctctgctaaaacaacacgatttacataaaaaatcttacacatctgccaccggaaataccatgcacagagtccttaaaaaatagagtgcagta

SEQ ID NO: 11382 - DNA, 201 bp, Homo sapiens
aggccttcctctgaccatagctgatggactggcggttgctcaggtccggctccgagaatgttcctgtgtctgagcctggaagaggctcgggtctggctccrggcgtggttcccttcccgtgtctgagcctggaagaggctcgggtccggctccgagcgtggttcccttcccgtgtctgagtctggaagaggctcgggtccg

SEQ ID NO: 11383 - DNA, 201 bp, Homo sapiens
ggaggggcggaccaaggagctgggctacacggtgaagaagcatctgcaggacctgtccggcaggatctccagagctcggcacaacgaactctgaaggcatyggggagcccagcccggcagggaagaggccagcgtgaaggacctgggctcttggccgtggcatttccgtggacagcccgccgtcagggtggctggggctgg

SEQ ID NO: 11384 - DNA, 201 bp, Homo sapiens
ccatgcacagagtccttaaaaaatagagtgcagtatttaaaccacccgcttgttggctggtcactaagtgtcctggtggctggggccggagccagtgctcktgaagggatcgcgtcatagccagcttcccctctgggccctgtgggtctttgcagccaacctccttttcccgtgagacggcccggcctgatttaaagccaa

SEQ ID NO: 11385 - DNA, 162 bp, Homo sapiens
agaatgttcctgtgtctgagcctggaagaggctcgggtctggctccgggcgtggttcccttcccgtgtctgagcctggaagaggctcgggtccggctccgrgcgtggttcccttcccgtgtctgagtctggaagaggctcgggtccggctccgagcgtggtt

SEQ ID NO: 11386 - DNA, 201 bp, Homo sapiens
ggcggaccaaggagctgggctacacggtgaagaagcatctgcaggacctgtccggcaggatctccagagctcggcacaacgaactctgaaggcattggggrgcccagcccggcagggaagaggccagcgtgaaggacctgggctcttggccgtggcatttccgtggacagcccgccgtcagggtggctggggctggcacgg

SEQ ID NO: 11387 - DNA, 201 bp, Homo sapiens
gcagccaacctccttttcccgtgagacggcccggcctgatttaaagccaagagcgcttgagttgagtttgaggggaagatgtggagcgtgtggttctgtgkacagtcagagactgtggcctgggggcagcgtctttcaactctcacctctgcagctcagggacctcgggagacctcaccaaacctgcagggcctccgtgtc

SEQ ID NO: 11388 - DNA, 133 bp, Homo sapiens
gggcatcggcaggctaggttttctccgcgcagsgccagtcgcagaggaagatggcgccgcggagggtcaggtcgtttctgcgcgggctcccggcgctgctactgctgctgctcttcctcgggccctggcccgc

SEQ ID NO: 11389 - DNA, 201 bp, Homo sapiens
tgcacagcaggcacacggagctgaaggagaagctgcgcagcatcaaccagggcctggaccgcctgcgcagggtcagccaccagggctacagcactgaggcygagttcgaggagcccagggtgattgacctgtgggacctggcgcagtccgccaacctcacggacaaggagctggaggcgttccgggaggagctcaagcact

SEQ ID NO: 11390 - DNA, 201 bp, Homo sapiens
tggaggggcggaccaaggagctgggctacacggtgaagaagcatctgcaggacctgtccggcaggatctccagagctcggcacaacgaactctgaaggcaytggggagcccagcccggcagggaagaggccagcgtgaaggacctgggctcttggccgtggcatttccgtggacagcccgccgtcagggtggctggggctg

SEQ ID NO: 11391 - DNA, 201 bp, Homo sapiens
ctggaggggcggaccaaggagctgggctacacggtgaagaagcatctgcaggacctgtccggcaggatctccagagctcggcacaacgaactctgaaggcrttggggagcccagcccggcagggaagaggccagcgtgaaggacctgggctcttggccgtggcatttccgtggacagcccgccgtcagggtggctggggct

SEQ ID NO: 11392 - DNA, 201 bp, Homo sapiens
agagtccttaaaaaatagagtgcagtatttaaaccacccgcttgttggctggtcactaagtgtcctggtggctggggccggagccagtgctcgtgaagggrtcgcgtcatagccagcttcccctctgggccctgtgggtctttgcagccaacctccttttcccgtgagacggcccggcctgatttaaagccaagagcgctt

SEQ ID NO: 11393 - DNA, 201 bp, Homo sapiens
tccgggaggagctcaagcacttcgaagccaaaatcgagaagcacaaccactaccagaagcagctggagattgcgcacgagaagctgaggcacgcagagagygtgggcgacggcgagcgtgtgagccgcagccgcgagaagcacgccctgctggaggggcggaccaaggagctgggctacacggtgaagaagcatctgcagg

SEQ ID NO: 11394 - DNA, 201 bp, Homo sapiens
agctcaagcacttcgaagccaaaatcgagaagcacaaccactaccagaagcagctggagattgcgcacgagaagctgaggcacgcagagagcgtgggcgayggcgagcgtgtgagccgcagccgcgagaagcacgccctgctggaggggcggaccaaggagctgggctacacggtgaagaagcatctgcaggacctgtccg

SEQ ID NO: 11395 - DNA, 201 bp, Homo sapiens
caacgaactctgaaggcattggggagcccagcccggcagggaagaggccagcgtgaaggacctgggctcttggccgtggcatttccgtggacagcccgccrtcagggtggctggggctggcacgggtgtcgaggcaggaaggattgtttctggtgactgcagccgctgccgtcgcgacacagggcttggtggtggtagcat

SEQ ID NO: 11396 - DNA, 201 bp, Homo sapiens
ccgggaggagctcaagcacttcgaagccaaaatcgagaagcacaaccactaccagaagcagctggagattgcgcacgagaagctgaggcacgcagagagcrtgggcgacggcgagcgtgtgagccgcagccgcgagaagcacgccctgctggaggggcggaccaaggagctgggctacacggtgaagaagcatctgcagga

SEQ ID NO: 11397 - DNA, 201 bp, Homo sapiens
ctgaagatacaggagagggacgaactcgcctggaagaaactaaagcttgacggcttggacgaagatggggagaaggaagcgagactcatacgcaacctcartgtcatcttggccaagtatggtctggacggaaagaaggacgctcggcaggtgaccagcaactccctcagtggcacccaggaagacgggctggatgacccc

SEQ ID NO: 11398 - DNA, 201 bp, Homo sapiens
tcttggccgtggcatttccgtggacagcccgccgtcagggtggctggggctggcacgggtgtcgaggcaggaaggattgtttctggtagcatttgggtctkagatcggcccagctctgactgaaggggcttggcttccactcagcatcagcgtggcagtcaccaccccagtgaggacctcgatgtccagctgctgtcaggt

SEQ ID NO: 11399 - DNA, 201 bp, Homo sapiens; identical to SEQ ID NO: 11377

SEQ ID NO: 11400 - DNA, 136 bp, Homo sapiens; identical to SEQ ID NO: 11378

SEQ ID NO: 11401 - DNA, 201 bp, Homo sapiens; identical to SEQ ID NO: 11379

SEQ ID NO: 11402 - DNA, 201 bp, Homo sapiens; identical to SEQ ID NO: 11380

SEQ ID NO: 11403 - DNA, 201 bp, Homo sapiens; identical to SEQ ID NO: 11381

SEQ ID NO: 11404 - DNA, 201 bp, Homo sapiens; identical to SEQ ID NO: 11382

SEQ ID NO: 11405 - DNA, 201 bp, Homo sapiens; identical to SEQ ID NO: 11383

SEQ ID NO: 11406 - DNA, 201 bp, Homo sapiens; identical to SEQ ID NO: 11384

SEQ ID NO: 11407 - DNA, 162 bp, Homo sapiens; identical to SEQ ID NO: 11385

SEQ ID NO: 11408 - DNA, 201 bp, Homo sapiens; identical to SEQ ID NO: 11386

SEQ ID NO: 11409 - DNA, 201 bp, Homo sapiens; identical to SEQ ID NO: 11387

SEQ ID NO: 11410 - DNA, 133 bp, Homo sapiens; identical to SEQ ID NO: 11388

SEQ ID NO: 11411 - DNA, 201 bp, Homo sapiens; identical to SEQ ID NO: 11389

SEQ ID NO: 11412 - DNA, 201 bp, Homo sapiens; identical to SEQ ID NO: 11390

SEQ ID NO: 11413 - DNA, 201 bp, Homo sapiens; identical to SEQ ID NO: 11391

SEQ ID NO: 11414 - DNA, 201 bp, Homo sapiens; identical to SEQ ID NO: 11392

SEQ ID NO: 11415 - DNA, 201 bp, Homo sapiens; identical to SEQ ID NO: 11393

SEQ ID NO: 11416 - DNA, 201 bp, Homo sapiens; identical to SEQ ID NO: 11394

SEQ ID NO: 11417 - DNA, 201 bp, Homo sapiens
caacgaactctgaaggcattggggagcccagcccggcagggaagaggccagcgtgaaggacctgggctcttggccgtggcatttccgtggacagcccgccrtcagggtggctggggctggcacgggtgtcgaggcaggaaggattgtttctggtagcatttgggtctgagatcggcccagctctgactgaaggggcttggc

SEQ ID NO: 11418 - DNA, 201 bp, Homo sapiens; identical to SEQ ID NO: 11396

SEQ ID NO: 11419 - DNA, 201 bp, Homo sapiens; identical to SEQ ID NO: 11397

SEQ ID NO: 11420 - DNA, 201 bp, Homo sapiens
cttcaggggactgttctcaccttaactcagccagaaagatgccctagttgtgatcaaaggtaactcgaggtggagggtagccctggggcccctcgacatcrccgtcattgatggagcctgaaccgtgtgctcctcggcagatgctgttgttgttacttccctccaagaggctggaaaagggctcagagctgctgagcagga

SEQ ID NO: 11421 - DNA, 201 bp, Homo sapiens
tgctgaatcctgagaagtacaaagccaagtcccgttccccagggtctccggtaggggaaggcactggatcgcctcccaagtggcagattggtgagcaggawtttgaagccctcatgcggatgctcgataatctgggctacagaactggctacccttatcgataccctgctctgagagagaagtctaaaaaatacagcgatg

SEQ ID NO: 11422 - DNA, 201 bp, Homo sapiens
cacgtcattgtgagcaccacgggccccaaccccttcaccacactcacagaccgtgagctggaggagtaccgcagggaggtggagaggaagcagaagggctstgaagagaatctggacgaggctagagaacagaaagaaaagagtcctccagaccagcctgcggtcccccacccgcctcccagcactcccatcaagctggag

SEQ ID NO: 11423 - DNA, 201 bp, Homo sapiens
ttcgggcacttgctccccactcagacacagttttcagaagcagcagcgggagaagacaagatggctgaactctggccggggcgacgaagcttccgaggaakggcagaatggaagcagtcccaagtcgaagactaagtggactaaagaggatggacatagaacttccacctctgctgtccctaacctgtttgttccattgaa

SEQ ID NO: 11424 - DNA, 201 bp, Homo sapiens
cgtcgtgcacattcacaccccagcaggggctgcggtctctgcaatgaaatgtggcctcttgccaatctccccggaggcgctttcccttggagaagtggctwatcatgactaccatggcattctggttgatgaagaggaaaaagttttgattcagaaaaatctggggcctaaaagcaaggttcttattctccggaaccatgg

SEQ ID NO: 11425 - DNA, 201 bp, Homo sapiens
ggggaggcttcaggggactgttctcaccttaactcagccagaaagatgccctagttgtgatcaaaggtaactcgaggtggagggtagccctggggcccctygacatcaccgtcattgatggagcctgaaccgtgtgctcctcggcagatgctgttgttgttacttccctccaagaggctggaaaagggctcagagctgctg

SEQ ID NO: 11426 - DNA, 164 bp, Homo sapiens
gaacctagaaagattgtacaatgaatggtgattctcgtgctgcggtggtgacctcaccaccccygaccacagcccctcacaaggagaggtacttcgaccgagtagatgagaacaacccagagtacttgagggagaggaacatggcaccagaccttcgccaggac

SEQ ID NO: 11427 - DNA, 201 bp, Homo sapiens
aacgtgatgctatgcatgtctgaccgacgatccctcgaccagaatcagattcaggagctcagtttctttttcacttgggtctctggattcctgtcataggraaggtatatcaggaggggaagaggcctttctagaattttctttgagcaggtttacaatttagcttacatttttcgactgtgaacgtgaataggctgcttt

SEQ ID NO: 11428 - DNA, 102 bp, Homo sapiens
gracctagaaagattgtacaatgaatggtgattctcgtgctgcggtggtgacctcaccacccccgaccacagcccctcacaaggagaggtacttcgaccgag

SEQ ID NO: 11429 - DNA, 201 bp, Homo sapiens
cagcggccttgaagaggcaggtctgggccagatgctgggcaggaaaccccagcggcagatgggcctgtgtgcacccaacgtgatgctatgcatgtctgacygacgatccctcgaccagaatcagattcaggagctcagtttctttttcacttgggtctctggattcctgtcatagggaaggtatatcaggaggggaagagg

SEQ ID NO: 11430 - DNA, 201 bp, Homo sapiens
gcctcagcttctgggggagacatgctctccccacaggggggaggcactaagtcatggtcctggctggaaggtactgaaggcttctgcagctttggctgcasgtcaccctcctgagcctcacctttcctgccgtccctcctgttgtgaaatcaccacattctgtctctgcttggcttcccctccaccctaaagtctcaggtg

SEQ ID NO: 11431 - DNA, 201 bp, Homo sapiens
aaggagatatagtagatcgtggaagcactaatctgggagtgaatcaggccggcttcaccttacactctgcaatttatgctgcacgcccggacgtgaagtgygtcgtgcacattcacaccccagcaggggctgcggtctctgcaatgaaatgtggcctcttgccaatctccccggaggcgctttcccttggagaagtggctt

SEQ ID NO: 11432 - DNA, 201 bp, Homo sapiens
tgttacttccctccaagaggctggaaaagggctcagagctgctgagcaggaaccggagggtgacccatttcaggaggtgccggtaccagcctgactaggtrcaggcaagcttgtgtgggcccaacaggcccttggtagagctggtgccagatgtgggctcagatcctgggcatgatgggccgagccacctcggatcccact

SEQ ID NO: 11433 - DNA, 201 bp, Homo sapiens
ctggagatgacagtgatgctgccacctttaagccaactctccccgatctgtcccctgatgaaccttcagaagcactcggcttcccaatgttagagaaggakgaggaagcccatagacccccaagccccactgaggcccctactgaggccagccccgagccagccccagacccagccccggtggctgaagaggctgccccct

SEQ ID NO: 11434 - DNA, 201 bp, Homo sapiens
ggacatagaacttccacctctgctgtccctaacctgtttgttccattgaacactaacccaaaagaggtccaggagatgaggaacaagatccgagagcagawtttacaggacattaagacggctggccctcagtcccaggttttgtgtggtgtagtgatggacaggagcctcgtccagggagagctggtgacggcctccaag

SEQ ID NO: 11435 - DNA, 201 bp, Homo sapiens; identical to SEQ ID NO: 11420

SEQ ID NO: 11436 - DNA, 201 bp, Homo sapiens; identical to SEQ ID NO: 11421

SEQ ID NO: 11437 - DNA, 201 bp, Homo sapiens; identical to SEQ ID NO: 11422

SEQ ID NO: 11438 - DNA, 201 bp, Homo sapiens
ttcgggcacttgctccccactcagacacagttttcagaagcagcagcgggagaagacaagatggctgaactctggccggggcgacgaagcttccgaggaakggcagaatggaagcagtcccaagtcgaagactaaggtgtggacgaacattacacacgatcacgtgaaacccttgctgcagtctctctcgtccggtgtctg

SEQ ID NO: 11439 - DNA, 201 bp, Homo sapiens
cgtcgtgcacattcacaccccagcaggggctgcggtctctgcaatgaaatgtggcctcttgccaatctccccggaggcgctttcccttggagaagtggctwatcatgactaccatggcattctggttgatgaagaggaaaaagttttgattcagaaaaatctggggcctaaaagcaaggttcgaactctggccagtgcagg

SEQ ID NO: 11440 - DNA, 201 bp, Homo sapiens
tattctgaaattgagagagtgactttatgaggtaagtattctaggcaaccagttacctttgttaaaaccttcatgatgagaaacggttcaggcacttttcsttgagttctagaaggagcgagcatgctgagggctgtgtccacccctctggtcatgccccttgtaatgcatgcatatgtgagggtggcacatacaccacca

SEQ ID NO: 11441 - DNA, 201 bp, Homo sapiens
atgctgagggctgtgtccacccctctggtcatgccccttgtaatgcatgcatatgtgagggtggcacatacaccaccagctttggggctcagattcggccygggttcagcagcgttctgtgtaaggcgctaggagagggtgggtttagggactcttgttctggtacatattgctgtctgcaacaaagtgctgcttgggttg

SEQ ID NO: 11442 - DNA, 201 bp, Homo sapiens; identical to SEQ ID NO: 11425

SEQ ID NO: 11443 - DNA, 201 bp, Homo sapiens; identical to SEQ ID NO: 11427

SEQ ID NO: 11444 - DNA, 201 bp, Homo sapiens; identical to SEQ ID NO: 11429

SEQ ID NO: 11445 - DNA, 201 bp, Homo sapiens; identical to SEQ ID NO: 11432

SEQ ID NO: 11446 - DNA, 201 bp, Homo sapiens; identical to SEQ ID NO: 11431

SEQ ID NO: 11447 - DNA, 201 bp, Homo sapiens
ggacatagaacttccacctctgctgtccctaacctgtttgttccattgaacactaacccaaaagaggtccaggagatgaggaacaagatccgagagcagawtttacaggacattaagacggctggccctcagtcccaggttttgtgtggtgtagtgatggacaggagcctcgtccaggtgagagcccagagtgtctctgac

SEQ ID NO: 11448 - DNA, 201 bp, Homo sapiens; identical to SEQ ID NO: 11420

SEQ ID NO: 11449 - DNA, 201 bp, Homo sapiens; identical to SEQ ID NO: 11421

SEQ ID NO: 11450 - DNA, 201 bp, Homo sapiens; identical to SEQ ID NO: 11422

SEQ ID NO: 11451 - DNA, 201 bp, Homo sapiens; identical to SEQ ID NO: 11438

SEQ ID NO: 11452 - DNA, 201 bp, Homo sapiens; identical to SEQ ID NO: 11424

SEQ ID NO: 11453 - DNA, 201 bp, Homo sapiens; identical to SEQ ID NO: 11425

SEQ ID NO: 11454 - DNA, 164 bp, Homo sapiens; identical to SEQ ID NO: 11426

SEQ ID NO: 11455 - DNA, 201 bp, Homo sapiens; identical to SEQ ID NO: 11427

SEQ ID NO: 11456 - DNA, 102 bp, Homo sapiens; identical to SEQ ID NO: 11428

SEQ ID NO: 11457 - DNA, 201 bp, Homo sapiens; identical to SEQ ID NO: 11429

SEQ ID NO: 11458 - DNA, 201 bp, Homo sapiens; identical to SEQ ID NO: 11430

SEQ ID NO: 11459 - DNA, 201 bp, Homo sapiens; identical to SEQ ID NO: 11431

SEQ ID NO: 11460 - DNA, 201 bp, Homo sapiens; identical to SEQ ID NO: 11433

SEQ ID NO: 11461 - DNA, 201 bp, Homo sapiens; identical to SEQ ID NO: 11432

SEQ ID NO: 11462 - DNA, 201 bp, Homo sapiens; identical to SEQ ID NO: 11434

SEQ ID NO: 11463 - DNA, 107 bp, Homo sapiens
ggagccrgagccggagccgacgggcggtggccgcactgggaccccggaatcccgcgcgctgcccacgattcgcttctgaggggccttttgagcagctgcttctgcaa

SEQ ID NO: 11464 - DNA, 201 bp, Homo sapiens; identical to SEQ ID NO: 11420

SEQ ID NO: 11465 - DNA, 201 bp, Homo sapiens; identical to SEQ ID NO: 11421

SEQ ID NO: 11466 - DNA, 201 bp, Homo sapiens; identical to SEQ ID NO: 11422

SEQ ID NO: 11467 - DNA, 201 bp, Homo sapiens; identical to SEQ ID NO: 11423

SEQ ID NO: 11468 - DNA, 201 bp, Homo sapiens; identical to SEQ ID NO: 11424

SEQ ID NO: 11469 - DNA, 201 bp, Homo sapiens
tgcttctgcaagaggacatccggagacacaggaatagaaatgatccgatcagagtaattaaaggcttttaactgagctctgaggtcccaaacagggcacaytccgtcagcctaaagctgtgaagaagaaccttcaacataaggaacctagaaagattgtacaatgaatggtgattctcgtgctgcggtggtgacctcacca

SEQ ID NO: 11470 - DNA, 201 bp, Homo sapiens; identical to SEQ ID NO: 11425

SEQ ID NO: 11471 - DNA, 201 bp, Homo sapiens; identical to SEQ ID NO: 11427

SEQ ID NO: 11472 - DNA, 201 bp, Homo sapiens
tcagcctaaagctgtgaagaagaaccttcaacataaggaacctagaaagattgtacaatgaatggtgattctcgtgctgcggtggtgacctcaccaccccygaccacagcccctcacaaggagaggtacttcgaccgagtagatgagaacaacccagagtacttgagggagaggaacatggcaccagaccttcgccaggac

SEQ ID NO: 11473 - DNA, 201 bp, Homo sapiens; identical to SEQ ID NO: 11429

SEQ ID NO: 11474 - DNA, 201 bp, Homo sapiens
tccgatcagagtaattaaaggcttttaactgagctctgaggtcccaaacagggcacactccgtcagcctaaagctgtgaagaagaaccttcaacataaggracctagaaagattgtacaatgaatggtgattctcgtgctgcggtggtgacctcaccacccccgaccacagcccctcacaaggagaggtacttcgaccgag

SEQ ID NO: 11475 - DNA, 201 bp, Homo sapiens; identical to SEQ ID NO: 11432

SEQ ID NO: 11476 - DNA, 201 bp, Homo sapiens; identical to SEQ ID NO: 11434

SEQ ID NO: 11477 - DNA, 201 bp, Homo sapiens; identical to SEQ ID NO: 11431

SEQ ID NO: 11478 - DNA, 107 bp, Homo sapiens; identical to SEQ ID NO: 11463

SEQ ID NO: 11479 - DNA, 201 bp, Homo sapiens; identical to SEQ ID NO: 11420

SEQ ID NO: 11480 - DNA, 201 bp, Homo sapiens; identical to SEQ ID NO: 11421

SEQ ID NO: 11481 - DNA, 201 bp, Homo sapiens; identical to SEQ ID NO: 11422

SEQ ID NO: 11482 - DNA, 201 bp, Homo sapiens; identical to SEQ ID NO: 11438

SEQ ID NO: 11483 - DNA, 201 bp, Homo sapiens; identical to SEQ ID NO: 11424

SEQ ID NO: 11484 - DNA, 201 bp, Homo sapiens; identical to SEQ ID NO: 11469

SEQ ID NO: 11485 - DNA, 201 bp, Homo sapiens; identical to SEQ ID NO: 11425

SEQ ID NO: 11486 - DNA, 201 bp, Homo sapiens; identical to SEQ ID NO: 11472

SEQ ID NO: 11487 - DNA, 201 bp, Homo sapiens; identical to SEQ ID NO: 11427

SEQ ID NO: 11488 - DNA, 201 bp, Homo sapiens; identical to SEQ ID NO: 11429

SEQ ID NO: 11489 - DNA, 201 bp, Homo sapiens; identical to SEQ ID NO: 11474

SEQ ID NO: 11490 - DNA, 201 bp, Homo sapiens; identical to SEQ ID NO: 11430

SEQ ID NO: 11491 - DNA, 201 bp, Homo sapiens; identical to SEQ ID NO: 11431

SEQ ID NO: 11492 - DNA, 201 bp, Homo sapiens; identical to SEQ ID NO: 11433

SEQ ID NO: 11493 - DNA, 201 bp, Homo sapiens; identical to SEQ ID NO: 11432

SEQ ID NO: 11494 - DNA, 201 bp, Homo sapiens; identical to SEQ ID NO: 11434

SEQ ID NO: 11495 - DNA, 201 bp, Homo sapiens; identical to SEQ ID NO: 11420

SEQ ID NO: 11496 - DNA, 201 bp, Homo sapiens; identical to SEQ ID NO: 11421

SEQ ID NO: 11497 - DNA, 201 bp, Homo sapiens; identical to SEQ ID NO: 11422

SEQ ID NO: 11498 - DNA, 201 bp, Homo sapiens; identical to SEQ ID NO: 11423

SEQ ID NO: 11499 - DNA, 201 bp, Homo sapiens; identical to SEQ ID NO: 11424

SEQ ID NO: 11500 - DNA, 201 bp, Homo sapiens; identical to SEQ ID NO: 11425

SEQ ID NO: 11501 - DNA, 164 bp, Homo sapiens; identical to SEQ ID NO: 11426

SEQ ID NO: 11502 - DNA, 201 bp, Homo sapiens; identical to SEQ ID NO: 11427

SEQ ID NO: 11503 - DNA, 102 bp, Homo sapiens; identical to SEQ ID NO: 11428

SEQ ID NO: 11504 - DNA, 201 bp, Homo sapiens; identical to SEQ ID NO: 11429

SEQ ID NO: 11505 - DNA, 201 bp, Homo sapiens; identical to SEQ ID NO: 11430

SEQ ID NO: 11506 - DNA, 201 bp, Homo sapiens; identical to SEQ ID NO: 11431

SEQ ID NO: 11507 - DNA, 201 bp, Homo sapiens; identical to SEQ ID NO: 11433

SEQ ID NO: 11508 - DNA, 201 bp, Homo sapiens; identical to SEQ ID NO: 11432

SEQ ID NO: 11509 - DNA, 201 bp, Homo sapiens; identical to SEQ ID NO: 11434

SEQ ID NO: 11510 - DNA, 107 bp, Homo sapiens; identical to SEQ ID NO: 11463

SEQ ID NO: 11511 - DNA, 201 bp, Homo sapiens; identical to SEQ ID NO: 11420

SEQ ID NO: 11512 - DNA, 201 bp, Homo sapiens; identical to SEQ ID NO: 11421

SEQ ID NO: 11513 - DNA, 201 bp, Homo sapiens; identical to SEQ ID NO: 11422

SEQ ID NO: 11514 - DNA, 201 bp, Homo sapiens; identical to SEQ ID NO: 11423

SEQ ID NO: 11515 - DNA, 201 bp, Homo sapiens; identical to SEQ ID NO: 11424

SEQ ID NO: 11516 - DNA, 201 bp, Homo sapiens; identical to SEQ ID NO: 11469

SEQ ID NO: 11517 - DNA, 201 bp, Homo sapiens; identical to SEQ ID NO: 11425

SEQ ID NO: 11518 - DNA, 201 bp, Homo sapiens; identical to SEQ ID NO: 11472

SEQ ID NO: 11519 - DNA, 201 bp, Homo sapiens; identical to SEQ ID NO: 11427

SEQ ID NO: 11520 - DNA, 201 bp, Homo sapiens; identical to SEQ ID NO: 11429

SEQ ID NO: 11521 - DNA, 201 bp, Homo sapiens; identical to SEQ ID NO: 11474

SEQ ID NO: 11522 - DNA, 201 bp, Homo sapiens; identical to SEQ ID NO: 11430

SEQ ID NO: 11523 - DNA, 201 bp, Homo sapiens; identical to SEQ ID NO: 11431

SEQ ID NO: 11524 - DNA, 201 bp, Homo sapiens; identical to SEQ ID NO: 11433

SEQ ID NO: 11525 - DNA, 201 bp, Homo sapiens; identical to SEQ ID NO: 11432

SEQ ID NO: 11526 - DNA, 201 bp, Homo sapiens; identical to SEQ ID NO: 11434

SEQ ID NO: 11527 - DNA, 107 bp, Homo sapiens; identical to SEQ ID NO: 11463

SEQ ID NO: 11528 - DNA, 201 bp, Homo sapiens; identical to SEQ ID NO: 11420

SEQ ID NO: 11529 - DNA, 201 bp, Homo sapiens; identical to SEQ ID NO: 11421

SEQ ID NO: 11530 - DNA, 201 bp, Homo sapiens; identical to SEQ ID NO: 11422

SEQ ID NO: 11531 - DNA, 201 bp, Homo sapiens; identical to SEQ ID NO: 11438

SEQ ID NO: 11532 - DNA, 201 bp, Homo sapiens; identical to SEQ ID NO: 11424

SEQ ID NO: 11533 - DNA, 201 bp, Homo sapiens; identical to SEQ ID NO: 11469

SEQ ID NO: 11534 - DNA, 201 bp, Homo sapiens; identical to SEQ ID NO: 11425

SEQ ID NO: 11535 - DNA, 201 bp, Homo sapiens; identical to SEQ ID NO: 11427

SEQ ID NO: 11536 - DNA, 201 bp, Homo sapiens; identical to SEQ ID NO: 11472

SEQ ID NO: 11537 - DNA, 201 bp, Homo sapiens; identical to SEQ ID NO: 11429

SEQ ID NO: 11538 - DNA, 201 bp, Homo sapiens; identical to SEQ ID NO: 11474

SEQ ID NO: 11539 - DNA, 201 bp, Homo sapiens; identical to SEQ ID NO: 11432

SEQ ID NO: 11540 - DNA, 201 bp, Homo sapiens; identical to SEQ ID NO: 11434

SEQ ID NO: 11541 - DNA, 201 bp, Homo sapiens; identical to SEQ ID NO: 11431

SEQ ID NO: 11542 - DNA, 107 bp, Homo sapiens; identical to SEQ ID NO: 11463

SEQ ID NO: 11543 - DNA, 201 bp, Homo sapiens
cttcaggggactgttctcaccttaactcagccagaaagatgccctagttgtgatcaaaggtaactcgaggtggagggtagccctggggcccctcgacatcrccgtcattgatggagcctgaaccgtgtgctcctcggcagatgctgttgttgttacttccctccaagaggctgtgccggtaccagcctgactaggtacagg

SEQ ID NO: 11544 - DNA, 201 bp, Homo sapiens; identical to SEQ ID NO: 11421

SEQ ID NO: 11545 - DNA, 201 bp, Homo sapiens; identical to SEQ ID NO: 11422

SEQ ID NO: 11546 - DNA, 201 bp, Homo sapiens; identical to SEQ ID NO: 11423

SEQ ID NO: 11547 - DNA, 201 bp, Homo sapiens; identical to SEQ ID NO: 11424

SEQ ID NO: 11548 - DNA, 201 bp, Homo sapiens; identical to SEQ ID NO: 11469

SEQ ID NO: 11549 - DNA, 201 bp, Homo sapiens
ggggaggcttcaggggactgttctcaccttaactcagccagaaagatgccctagttgtgatcaaaggtaactcgaggtggagggtagccctggggcccctygacatcaccgtcattgatggagcctgaaccgtgtgctcctcggcagatgctgttgttgttacttccctccaagaggctgtgccggtaccagcctgactag

SEQ ID NO: 11550 - DNA, 201 bp, Homo sapiens; identical to SEQ ID NO: 11472

SEQ ID NO: 11551 - DNA, 201 bp, Homo sapiens; identical to SEQ ID NO: 11427

SEQ ID NO: 11552 - DNA, 201 bp, Homo sapiens; identical to SEQ ID NO: 11429

SEQ ID NO: 11553 - DNA, 201 bp, Homo sapiens; identical to SEQ ID NO: 11474

SEQ ID NO: 11554 - DNA, 201 bp, Homo sapiens; identical to SEQ ID NO: 11430

SEQ ID NO: 11555 - DNA, 201 bp, Homo sapiens; identical to SEQ ID NO: 11431

SEQ ID NO: 11556 - DNA, 201 bp, Homo sapiens; identical to SEQ ID NO: 11433

SEQ ID NO: 11557 - DNA, 201 bp, Homo sapiens
catcaccgtcattgatggagcctgaaccgtgtgctcctcggcagatgctgttgttgttacttccctccaagaggctgtgccggtaccagcctgactaggtrcaggcaagcttgtgtgggcccaacaggcccttggtagagctggtgccagatgtgggctcagatcctgggcatgatgggccgagccacctcggatcccact

SEQ ID NO: 11558 - DNA, 201 bp, Homo sapiens; identical to SEQ ID NO: 11434

SEQ ID NO: 11559 - DNA, 107 bp, Homo sapiens; identical to SEQ ID NO: 11463

SEQ ID NO: 11560 - DNA, 201 bp, Homo sapiens; identical to SEQ ID NO: 11420

SEQ ID NO: 11561 - DNA, 201 bp, Homo sapiens; identical to SEQ ID NO: 11421

SEQ ID NO: 11562 - DNA, 201 bp, Homo sapiens; identical to SEQ ID NO: 11422

SEQ ID NO: 11563 - DNA, 201 bp, Homo sapiens; identical to SEQ ID NO: 11423

SEQ ID NO: 11564 - DNA, 201 bp, Homo sapiens; identical to SEQ ID NO: 11424

SEQ ID NO: 11565 - DNA, 201 bp, Homo sapiens; identical to SEQ ID NO: 11469

SEQ ID NO: 11566 - DNA, 201 bp, Homo sapiens; identical to SEQ ID NO: 11425

SEQ ID NO: 11567 - DNA, 201 bp, Homo sapiens; identical to SEQ ID NO: 11427

SEQ ID NO: 11568 - DNA, 201 bp, Homo sapiens; identical to SEQ ID NO: 11472

SEQ ID NO: 11569 - DNA, 201 bp, Homo sapiens; identical to SEQ ID NO: 11429

SEQ ID NO: 11570 - DNA, 201 bp, Homo sapiens; identical to SEQ ID NO: 11474

SEQ ID NO: 11571 - DNA, 201 bp, Homo sapiens; identical to SEQ ID NO: 11430

SEQ ID NO: 11572 - DNA, 201 bp, Homo sapiens; identical to SEQ ID NO: 11431

SEQ ID NO: 11573 - DNA, 201 bp, Homo sapiens; identical to SEQ ID NO: 11432

SEQ ID NO: 11574 - DNA, 201 bp, Homo sapiens; identical to SEQ ID NO: 11433

SEQ ID NO: 11575 - DNA, 201 bp, Homo sapiens; identical to SEQ ID NO: 11434

SEQ ID NO: 11576 - DNA, 107 bp, Homo sapiens; identical to SEQ ID NO: 11463

SEQ ID NO: 11577 - DNA, 201 bp, Homo sapiens; identical to SEQ ID NO: 11543

SEQ ID NO: 11578 - DNA, 201 bp, Homo sapiens; identical to SEQ ID NO: 11421

SEQ ID NO: 11579 - DNA, 201 bp, Homo sapiens; identical to SEQ ID NO: 11422

SEQ ID NO: 11580 - DNA, 201 bp, Homo sapiens; identical to SEQ ID NO: 11438

SEQ ID NO: 11581 - DNA, 201 bp, Homo sapiens; identical to SEQ ID NO: 11424

SEQ ID NO: 11582 - DNA, 201 bp, Homo sapiens; identical to SEQ ID NO: 11469

SEQ ID NO: 11583 - DNA, 201 bp, Homo sapiens; identical to SEQ ID NO: 11549

SEQ ID NO: 11584 - DNA, 201 bp, Homo sapiens; identical to SEQ ID NO: 11472

SEQ ID NO: 11585 - DNA, 201 bp, Homo sapiens; identical to SEQ ID NO: 11427

SEQ ID NO: 11586 - DNA, 201 bp, Homo sapiens; identical to SEQ ID NO: 11429

SEQ ID NO: 11587 - DNA, 201 bp, Homo sapiens; identical to SEQ ID NO: 11474

SEQ ID NO: 11588 - DNA, 201 bp, Homo sapiens; identical to SEQ ID NO: 11430

SEQ ID NO: 11589 - DNA, 201 bp, Homo sapiens; identical to SEQ ID NO: 11431

SEQ ID NO: 11590 - DNA, 201 bp, Homo sapiens; identical to SEQ ID NO: 11433

SEQ ID NO: 11591 - DNA, 201 bp, Homo sapiens; identical to SEQ ID NO: 11557

SEQ ID NO: 11592 - DNA, 201 bp, Homo sapiens; identical to SEQ ID NO: 11434

SEQ ID NO: 11593 - DNA, 201 bp, Homo sapiens
ccccctcctcctcgctcaccttaaaaccatcgtgcatcaccatggcgagttgctccttcactcgcgaccaagcgacaagaagactaagaggtgcagcagcrgcggcagcggcagctctagcagcagtggtgaccaccccgcttctttcctcgggaaccccgaccgcactcattgggaccgggtcgtcttgtccgggagcca

SEQ ID NO: 11594 - DNA, 201 bp, Homo sapiens
ctcctataactgggaccccaaagatgcagcttcaaagccttcaggtgagggatcattctcaaagcctggagatgggggatcaccttcaaagccttcagatsatgagcccccaaagaataaagctaagagacctaaccgactttcttttattacaaaaggatataaaatcaagccaaaaccacaaaagcccacacatgagca

SEQ ID NO: 11595 - DNA, 201 bp, Homo sapiens
gggcaccgcaggtgggcacggttcaggtggtggccagagacctggaggtgggcatggctcaggtggtggccagggacctggagatggccatggctcaggtkgtggcaagaactctggggggggcaaaggctcaggaagtgggaaaggatccgatggtgatggtgaacgtggaaaatctctgaagaaaagatcctattttgg

SEQ ID NO: 11596 - DNA, 201 bp, Homo sapiens
cctcctcctcgctcaccttaaaaccatcgtgcatcaccatggcgagttgctccttcactcgcgaccaagcgacaagaagactaagaggtgcagcagcggcrgcagcggcagctctagcagcagtggtgaccaccccgcttctttcctcgggaaccccgaccgcactcattgggaccgggtcgtcttgtccgggagccatgt

SEQ ID NO: 11597 - DNA, 201 bp, Homo sapiens
gaccccaaagatgcagcttcaaagccttcaggtgagggatcattctcaaagcctggagatgggggatcaccttcaaagccttcagatcatgagcccccaamgaataaagctaagagacctaaccgactttcttttattacaaaaggatataaaatcaagccaaaaccacaaaagcccacacatgagcagagagaagctgac

SEQ ID NO: 11598 - DNA, 201 bp, Homo sapiens
catggcgagttgctccttcactcgcgaccaagcgacaagaagactaagaggtgcagcagcggcggcagcggcagctctagcagcagtggtgaccaccccgyttctttcctcgggaaccccgaccgcactcattgggaccgggtcgtcttgtccgggagccatgtggctctccacggccactggctcccggtcagactccga

SEQ ID NO: 11599 - DNA, 201 bp, Homo sapiens
gaggaagagggtgactacattgaagtaattttcaactcagcaatgacaccagccatggctcttgctgacagtgccattcgctatgatgctgaaacaggtcsaatctatgtggtcgacccattttctgagtgctgtatggatatttctctctcccccagccgatgttctgaaccaccacctgtagctaggctgctgcaggaa

SEQ ID NO: 11600 - DNA, 201 bp, Homo sapiens
agggcaaagaagatcaggaaggaagcggaggtgactacatgcctatgaacaattggggctcaggaaatggccggggctcaggaggtggccagggctcaaawggccaaggctccagtagccatagctcgggaggaaaccagtgttcaggcgagggacagggatcccgaggtggtcagggctcaaatggccagggctcaggag

SEQ ID NO: 11601 - DNA, 201 bp, Homo sapiens
acggttttggcgggcaggatggtggtgagctgcggccgctgcagagtgaaggcgctgcagcgctggtcaccaaggggtgccagcgattggcagcccagggygcacggcctgaggcccccaaacggaaatgggccgaggatggtggggatgccccttcacccagcaaacggccctgggccaggcaagagaaccaggaggcag

SEQ ID NO: 11602 - DNA, 201 bp, Homo sapiens
tcccaagcccttagggaccgcagaggacttggggaccagcaagcaacccccagggcacgagaagagctcttgctgtctgccctgcctcaccctgccccacrccaggcccggtggcccccagctgcatcaagtggaggcggaggaggaggcggaggagggtggcaccatgggcccgggcggtgccctccatgcccgggggat

SEQ ID NO: 11603 - DNA, 201 bp, Homo sapiens
aaggccatgaaccaggctgtcgaagcattggtgccctcatggcccatgtggacgccgtcatccgccactgcgcagggcggctgggcagctatgtcatcaaygggcgcaccaaggccatggtggcgtgttacccaggcaacgggctcgggtacgtaaggcacgttgacaatccccacggcgatgggcgctgcatcacctgta

SEQ ID NO: 11604 - DNA, 201 bp, Homo sapiens
ccgtggtagccaacatcgagccactctttgaccggttgctcattttctggtctgaccggcggaacccccacgaggtgaagccagcctatgccaccaggtaygccatcactgtctggtattttgatgccaaggagcgggcagcagccaaagacaagtatcagctagcatcaggacagaaaggtgtccaagtacctgtatcac

SEQ ID NO: 11605 - DNA, 201 bp, Homo sapiens
tgggggcagcactgggcggtcgcgtgctggccgaggtggaggccctcaaacggggtgggcgcctgcgagacgggcagctagtgagccagagggcgatcccrccgcgcagcatccgtggggaccagattgcctgggtggaaggccatgaaccaggctgtcgaagcattggtgccctcatggcccatgtggacgccgtcatcc

SEQ ID NO: 11606 - DNA, 142 bp, Homo sapiens
gctttcccctgcctgcctgtctctagtttctctcacatccctttttttttttcctttctctagccaccctgaagggtcccttcccaagcccttagggaccgcagaggacttggggaccagcaagcaacccccagggcacgag

SEQ ID NO: 11607 - DNA, 201 bp, Homo sapiens
atgtggacgccgtcatccgccactgcgcagggcggctgggcagctatgtcatcaacgggcgcaccaaggccatggtggcgtgttacccaggcaacgggctygggtacgtaaggcacgttgacaatccccacggcgatgggcgctgcatcacctgtatctattacctgaatcagaactgggacgttaaggtgcatggcggcc

SEQ ID NO: 11608 - DNA, 201 bp, Homo sapiens
ggacttggggaccagcaagcaacccccagggcacgagaagagctcttgctgtctgccctgcctcaccctgccccacgccaggcccggtggcccccagctgyatcaagtggaggcggaggaggaggcggaggagggtggcaccatgggcccgggcggtgccctccatgcccgggggatgaagacactgctgccatggacagc

SEQ ID NO: 11609 - DNA, 201 bp, Homo sapiens
tctggtctgaccggcggaacccccacgaggtgaagccagcctatgccaccaggtacgccatcactgtctggtattttgatgccaaggagcgggcagcagcyaaagacaagtatcagctagcatcaggacagaaaggtgtccaagtacctgtatcacagccgcctacgcccacctagtggccagtcccagagccgcatggca

SEQ ID NO: 11610 - DNA, 154 bp, Homo sapiens
gctttcccctgcctgcctgtctctagtttctctcacatccctttttttttttcytttctctagccaccctgaagggtcccttcccaagcccttagggaccgcagaggacttggggaccagcaagcaacccccagggcacgagaagagctcttgc

SEQ ID NO: 11611 - DNA, 201 bp, Homo sapiens
ccaaggaggagaagagacctttgctgccccatcatgggggctggggttgtcacctggacagggggcagccgtggaggccaccgttaccaactgaagctggrggcctgggtcctaccctgtctggtcatgaccccattaggtatggagagctgggaggaggcattgtcacttcccaccaggatgcaggacttggggttgagg

SEQ ID NO: 11612 - DNA, 201 bp, Homo sapiens
acttcccaccaggatgcaggacttggggttgaggtgagtcatggcctcttgctggcaatggggtgggaggagtacccccaagtcctctcactcctccagcmtggaatgtgaagtgactccccaacccctttggccatggcaggcaccttttggactgggctgccactgcttgggcagagtaaaaggtgccaggaggagcat

SEQ ID NO: 11613 - DNA, 201 bp, Homo sapiens; identical to SEQ ID NO: 11601

SEQ ID NO: 11614 - DNA, 201 bp, Homo sapiens; identical to SEQ ID NO: 11602

SEQ ID NO: 11615 - DNA, 201 bp, Homo sapiens; identical to SEQ ID NO: 11603

SEQ ID NO: 11616 - DNA, 201 bp, Homo sapiens; identical to SEQ ID NO: 11604

SEQ ID NO: 11617 - DNA, 201 bp, Homo sapiens; identical to SEQ ID NO: 11605

SEQ ID NO: 11618 - DNA, 201 bp, Homo sapiens; identical to SEQ ID NO: 11608

SEQ ID NO: 11619 - DNA, 201 bp, Homo sapiens; identical to SEQ ID NO: 11607

SEQ ID NO: 11620 - DNA, 201 bp, Homo sapiens; identical to SEQ ID NO: 11609

SEQ ID NO: 11621 - DNA, 201 bp, Homo sapiens; identical to SEQ ID NO: 11611

SEQ ID NO: 11622 - DNA, 201 bp, Homo sapiens; identical to SEQ ID NO: 11612

SEQ ID NO: 11623 - DNA, 201 bp, Homo sapiens; identical to SEQ ID NO: 11601

SEQ ID NO: 11624 - DNA, 201 bp, Homo sapiens; identical to SEQ ID NO: 11602

SEQ ID NO: 11625 - DNA, 201 bp, Homo sapiens; identical to SEQ ID NO: 11603

SEQ ID NO: 11626 - DNA, 201 bp, Homo sapiens; identical to SEQ ID NO: 11604

SEQ ID NO: 11627 - DNA, 201 bp, Homo sapiens; identical to SEQ ID NO: 11605

SEQ ID NO: 11628 - DNA, 201 bp, Homo sapiens; identical to SEQ ID NO: 11608

SEQ ID NO: 11629 - DNA, 201 bp, Homo sapiens; identical to SEQ ID NO: 11607

SEQ ID NO: 11630 - DNA, 201 bp, Homo sapiens; identical to SEQ ID NO: 11609

SEQ ID NO: 11631 - DNA, 201 bp, Homo sapiens; identical to SEQ ID NO: 11611

SEQ ID NO: 11632 - DNA, 201 bp, Homo sapiens; identical to SEQ ID NO: 11612

SEQ ID NO: 11633 - DNA, 201 bp, Homo sapiens
gtgggaagagggtgcagcactggaccccttccctgccacccatccacgtgcatcatcagtgtaatctctgattggattcctaattggggaggtcttgcccrtctctagtcagtaactcactgtttctaagcctcctggaccatggcccaattcttctcccagtgaggtggttgctcagagtgccgacccttccatagggag

SEQ ID NO: 11634 - DNA, 201 bp, Homo sapiens; identical to SEQ ID NO: 11604

SEQ ID NO: 11635 - DNA, 201 bp, Homo sapiens
cccatccacgtgcatcatcagtgtaatctctgattggattcctaattggggaggtcttgcccatctctagtcagtaactcactgtttctaagcctcctggrccatggcccaattcttctcccagtgaggtggttgctcagagtgccgacccttccatagggagtgagcagtgcaaagaaggtgccccctcctgaaccttga

SEQ ID NO: 11636 - DNA, 201 bp, Homo sapiens
tatcttgaaacaaatcaaactctgttactaattgagccctagctgggtgccaggccccaggtatgtgtgttgggagggagtgggctcttgaggcccaggarctgaggtttctgatagacttggggatgggattttggctgaaaaagaaagtcttttggggcaggagcttggaacccttgacccaaggagtcatggggaaga

SEQ ID NO: 11637 - DNA, 201 bp, Homo sapiens; identical to SEQ ID NO: 11609

SEQ ID NO: 11638 - DNA, 201 bp, Homo sapiens; identical to SEQ ID NO: 11612

SEQ ID NO: 11639 - DNA, 201 bp, Homo sapiens
tgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctg

SEQ ID NO: 11640 - DNA, 201 bp, Homo sapiens
ttcatggctgcttctctaagatgtgcctgcctagccccagtaaacctacctccctccatccctgccaggccatggtggcgtgttacccaggcaacgggctygggtacgtaaggcacgttgacaatccccacggcgatgggcgctgcatcacctgtatctattacctgaatcagaactgggacgttaaggtaggggtgaggg

SEQ ID NO: 11641 - DNA, 201 bp, Homo sapiens; identical to SEQ ID NO: 11611

SEQ ID NO: 11642 - DNA, 201 bp, Homo sapiens; identical to SEQ ID NO: 11601

SEQ ID NO: 11643 - DNA, 201 bp, Homo sapiens; identical to SEQ ID NO: 11602

SEQ ID NO: 11644 - DNA, 201 bp, Homo sapiens; identical to SEQ ID NO: 11603

SEQ ID NO: 11645 - DNA, 201 bp, Homo sapiens; identical to SEQ ID NO: 11604

SEQ ID NO: 11646 - DNA, 201 bp, Homo sapiens; identical to SEQ ID NO: 11605

SEQ ID NO: 11647 - DNA, 201 bp, Homo sapiens; identical to SEQ ID NO: 11608

SEQ ID NO: 11648 - DNA, 201 bp, Homo sapiens; identical to SEQ ID NO: 11607

SEQ ID NO: 11649 - DNA, 201 bp, Homo sapiens; identical to SEQ ID NO: 11609

SEQ ID NO: 11650 - DNA, 201 bp, Homo sapiens
ccaaggaggagaagagacctttgctgccccatcatgggggctggggttgtcacctggacagggggcagccgtggaggccaccgttaccaactgaagctggrggcctgggtcctaccctgtctggtcatgaccccattaggtatggagagctgggaggcaatggggtgggaggagtacccccaagtcctctcactcctccag

SEQ ID NO: 11651 - DNA, 119 bp, Homo sapiens
gcctgggtcctaccctgtctggtcatgaccccattaggtatggagagctgggaggcaatggggtgggaggagtacccccaagtcctctcactcctccagcmtggaatgtgaagtgactc

SEQ ID NO: 11652 - DNA, 201 bp, Homo sapiens
agtcctggattccacatgcagctcaaccgtacagttcctagaatatgaactaaatgttttgggaacacacaaaatcgaagatggtacgttagcctctaagrctaaaggaacatttgcacaccgtgacttcagtgcagaatatgaagaagatggcaaatatgaaggacttcaggaatgggaaggaaaagcgcacctcaatat

SEQ ID NO: 11653 - DNA, 201 bp, Homo sapiens
tggaaacaacccagtctcaaaaggtttactaatattcgatgcatctagttcctggggaccacagatgtctgcttcagttcatttggactccaaaaagaaayagcatttgtttgtcaaagaagtcaagattgatgggcagttcagagtctcttcgttctatgctaaaggcacatatggcctgtcttgtcagagggatcctaa

SEQ ID NO: 11654 - DNA, 201 bp, Homo sapiens
cttgtcatgcctacgttccatgtcccatttacagatcttcaggttccatcgtgcaaacttgacttcagagaaatacaaatctataagaagctgagaacttmatcatttgccctcaacctaccaacactccccgaggtaaaattccctgaagttgatgtgttaacaaaatattctcaaccagaagactccttgattcccttt

SEQ ID NO: 11655 - DNA, 201 bp, Homo sapiens
gcacttccaaaattgatgatatctggaaccttgaagtaaaagaaaattttgctggagaagccacactccaacgcatatattccctctgggagcacagtacraaaaaccacttacagctagagggcctctttttcaccaacggagaacatacaagcaaagccaccctggaactctctccatggcaaatgtcagctcttgttc

SEQ ID NO: 11656 - DNA, 201 bp, Homo sapiens
gtatctggaaagcctacaggacaccaaaataaccttaatcatcaattggttacaggaggctttaagttcagcatctttggctcacatgaaggccaaattcygagagaccctagaagatacacgagaccgaatgtatcaaatggacattcagcaggaacttcaacgatacctgtctctggtaggccaggtttatagcacact

SEQ ID NO: 11657 - DNA, 201 bp, Homo sapiens
tctgtctctgagcaacaaatttgtggagggtagtcataacagtactgtgagcttaaccacgaaaaatatggaagtgtcagtggcaacaaccacaaaagccsaaattccaattttgagaatgaatttcaagcaagaacttaatggaaataccaagtcaaaacctactgtctcttcctccatggaatttaagtatgatttcaa

SEQ ID NO: 11658 - DNA, 201 bp, Homo sapiens
aatcaagtgtcatcacactgaataccaatgctgaactttttaaccagtcagatattgttgctcatctcctttcttcatcttcatctgtcattgatgcactrcagtacaaattagagggcaccacaagattgacaagaaaaaggggattgaagttagccacagctctgtctctgagcaacaaatttgtggagggtagtcata

SEQ ID NO: 11659 - DNA, 201 bp, Homo sapiens
tcatctaccaaaggagatgtcaagggttcggttctttctcgggaatattcaggaactattgctagtgaggccaacacttacttgaattccaagagcacacrgtcttcagtgaagctgcagggcacttccaaaattgatgatatctggaaccttgaagtaaaagaaaattttgctggagaagccacactccaacgcatatat

SEQ ID NO: 11660 - DNA, 201 bp, Homo sapiens
cctaggttctgacgtccgtgtgccttcatacacattaatcctgccatcattagagctgccagtccttcatgtccctagaaatctcaagctttctcttccasatttcaaggaattgtgtaccataagccatatttttattcctgccatgggcaatattacctatgatttctcctttaaatcaagtgtcatcacactgaatac

SEQ ID NO: 11661 - DNA, 201 bp, Homo sapiens
gcaagtaagtgctaggttcaatcagtataagtacaaccaaaatttctctgctggaaacaacgagaacattatggaggcccatgtaggaataaatggagaarcaaatctggatttcttaaacattcctttaacaattcctgaaatgcgtctaccttacacaataatcacaactcctccactgaaagatttctctctatggga

SEQ ID NO: 11662 - DNA, 201 bp, Homo sapiens
ttgttgcttttgtaaagtatgataaaaaccaagatgttcactccattaacctcccattttttgagaccttgcaagaatattttgagaggaatcgacaaacmattatagttgtactggaaaacgtacagagaaacctgaagcacatcaatattgatcaatttgtaagaaaatacagagcagccctgggaaaactcccacagc

SEQ ID NO: 11663 - DNA, 201 bp, Homo sapiens
gaagttgatgtgttaacaaaatattctcaaccagaagactccttgattcccttttttgagataaccgtgcctgaatctcagttaactgtgtcccagttcaygcttccaaaaagtgtttcagatggcattgctgctttggatctaaatgcagtagccaacaagatcgcagactttgagttgcccaccatcatcgtgcctgag

SEQ ID NO: 11664 - DNA, 201 bp, Homo sapiens
agataccaaaaaaatgacttccaatttccctgtggatctctccgattatcctaagagcttgcatatgtatgctaatagactcctggatcacagagtccctsaaacagacatgactttccggcacgtgggttccaaattaatagttgcaatgagctcatggcttcagaaggcatctgggagtcttccttatacccagacttt

SEQ ID NO: 11665 - DNA, 201 bp, Homo sapiens
caaggatttttcccagacagtgtcaacaaagctttgtactgggttaatggtcaagttcctgatggtgtctctaaggtcttagtggaccactttggctatamcaaagatgataaacatgagcaggatatggtaaatggaataatgctcagtgttgagaagctgattaaagatttgaaatccaaagaagtcccggaagccaga

SEQ ID NO: 11666 - DNA, 201 bp, Homo sapiens
atcacggagttactgaaaaagctgcaatcaaccacagtcatgaacccctacatgaagcttgctccaggagaacttactatcatcctctaattttttaaaakaaatcttcatttattcttcttttccaattgaactttcacatagcacagaaaaaattcaaactgcctatattgcacatatgaactggacctgcaccaaagc

SEQ ID NO: 11667 - DNA, 201 bp, Homo sapiens
tattcaggaatatcttagcatccttaccgatccagatggaaaagggaaagagaagattgcagagctttctgccactgctcaggaaataattaaaagccagrccattgcgacgaagaaaataatttctgattaccaccagcagtttagatataaactgcaagatttttcagaccaactctctgattactatgaaaaatttat

SEQ ID NO: 11668 - DNA, 201 bp, Homo sapiens
ttccctctgggagcacagtacgaaaaaccacttacagctagagggcctctttttcaccaacggagaacatacaagcaaagccaccctggaactctctccayggcaaatgtcagctcttgttcaggtccatgcaagtcagcccagttccttccatgatttccctgaccttggccaggaagtggccctgaatgctaacactaa

SEQ ID NO: 11669 - DNA, 201 bp, Homo sapiens
ttcattttccaactaatagaagataacattaaacagctgaaagagatgaaatttacttatcttattaattatatccaagatgagatcaacacaatcttcartgattatatcccatatgtttttaaattgttgaaagaaaacctatgccttaatcttcataagttcaatgaatttattcaaaacgagcttcaggaagcttct

SEQ ID NO: 11670 - DNA, 201 bp, Homo sapiens
ctgatgatccagaaagctgccatccaggctctgcggaaaatggagcctaaagacaaggaccaggaggttcttcttcagactttccttgatgatgcttctcygggagataagcgactggctgcctatcttatgttgatgaggagtccttcacaggcagatattaacaaaattgtccaaattctaccatgggaacagaatgag

SEQ ID NO: 11671 - DNA, 114 bp, Homo sapiens
attcccaccgggasctgcggggctgagtgcccttctcggttgctgccgctgaggagcccgcccagccagccagggccgcgaggccgaggccaggccgcagcccaggagccgccc

SEQ ID NO: 11672 - DNA, 201 bp, Homo sapiens
gtcatctaccaaaggagatgtcaagggttcggttctttctcgggaatattcaggaactattgctagtgaggccaacacttacttgaattccaagagcacayggtcttcagtgaagctgcagggcacttccaaaattgatgatatctggaaccttgaagtaaaagaaaattttgctggagaagccacactccaacgcatata

SEQ ID NO: 11673 - DNA, 201 bp, Homo sapiens
gagcacacggtcttcagtgaagctgcagggcacttccaaaattgatgatatctggaaccttgaagtaaaagaaaattttgctggagaagccacactccaaygcatatattccctctgggagcacagtacgaaaaaccacttacagctagagggcctctttttcaccaacggagaacatacaagcaaagccaccctggaact

SEQ ID NO: 11674 - DNA, 201 bp, Homo sapiens
aactttgccacttctaacaagatggatatgaccttctctaagcaaaatgcactgctgcgttctgaatatcaggctgattacgagtcattgaggttcttcascctgctttctggatcactaaattcccatggtcttgagttaaatgctgacatcttaggcactgacaaaattaatagtggtgctcacaaggcgacactaagg

SEQ ID NO: 11675 - DNA, 201 bp, Homo sapiens
gtctccattcaccatagagatgtcggcattcggctatgtgttcccaaaagcagtcagcatgcctagtttctccatcctaggttctgacgtccgtgtgcctycatacacattaatcctgccatcattagagctgccagtccttcatgtccctagaaatctcaagctttctcttccagatttcaaggaattgtgtaccataag

SEQ ID NO: 11676 - DNA, 201 bp, Homo sapiens
taaaagaaaattttgctggagaagccacactccaacgcatatattccctctgggagcacagtacgaaaaaccacttacagctagagggcctctttttcacyaacggagaacatacaagcaaagccaccctggaactctctccatggcaaatgtcagctcttgttcaggtccatgcaagtcagcccagttccttccatgatt

SEQ ID NO: 11677 - DNA, 201 bp, Homo sapiens
cctgggactgctgattcaagaagtgccaccaggatcaactgcaaggttgagctggaggttccccagctctgcagcttcatcctgaagaccagccagtgcaycctgaaagaggtgtatggcttcaaccctgagggcaaagccttgctgaagaaaaccaagaactctgaggagtttgctgcagccatgtccaggtatgagctc

SEQ ID NO: 11678 - DNA, 201 bp, Homo sapiens
ctcacctcttacttttccattgagtcatctaccaaaggagatgtcaagggttcggttctttctcgggaatattcaggaactattgctagtgaggccaacayttacttgaattccaagagcacacggtcttcagtgaagctgcagggcacttccaaaattgatgatatctggaaccttgaagtaaaagaaaattttgctgga

SEQ ID NO: 11679 - DNA, 201 bp, Homo sapiens
agcacctagctggaaagttaaaacaacacattgaggctattgatgttagagtgcttttagatcaattgggaactacaatttcatttgaaagaataaatgaygttcttgagcatgtcaaacactttgttataaatcttattggggattttgaagtagctgagaaaatcaatgccttcagagccaaagtccatgagttaatcg

SEQ ID NO: 11680 - DNA, 201 bp, Homo sapiens
acaccagaatttaccatccttaacaccttccacattccttcctttacaattgactttgtagaaatgaaagtaaagatcatcagaaccattgaccagatgcwgaacagtgagctgcagtggcccgttccagatatatatctcagggatctgaaggtggaggacattcctctagcgagaatcaccctgccagacttccgttta

SEQ ID NO: 11681 - DNA, 201 bp, Homo sapiens
ccgatctccatctgcgctaccagaaagacaagaaaggcatctccacctcagcagcctccccagccgtaggcaccgtgggcatggatatggatgaagatgaygacttttctaaatggaacttctactacagccctcagtcctctccagataaaaaactcaccttaattgggaagaagaggcagcttctggcttgctaacctc

SEQ ID NO: 11682 - DNA, 201 bp, Homo sapiens
tcaaagacttaaaaaatataaaaatcccatccaggttttccacaccagaatttaccatccttaacaccttccacattccttcctttacaattgactttgtmgaaatgaaagtaaagatcatcagaaccattgaccagatgctgaacagtgagctgcagtggcccgttccagatatatatctcagggatctgaaggtggagg

SEQ ID NO: 11683 - DNA, 201 bp, Homo sapiens
atcaccctgccagacttccgtttaccagaaatcgcaattccagaattcataatcccaactctcaaccttaatgattttcaagttcctgaccttcacatacyagaattccagcttccccacatctcacacacaattgaagtacctacttttggcaagctatacagtattctgaaaatccaatctcctcttttcacattagat

SEQ ID NO: 11684 - DNA, 201 bp, Homo sapiens
tcaacgatacctgtctctggtaggccaggtttatagcacacttgtcacctacatttctgattggtggactcttgctgctaagaaccttactgactttgcaragcaatattctatccaagattgggctaaacgtatgaaagcattggtagagcaagggttcactgttcctgaaatcaagaccatccttgggaccatgcctgc

SEQ ID NO: 11685 - DNA, 201 bp, Homo sapiens
caggaactattgctagtgaggccaacacttacttgaattccaagagcacacggtcttcagtgaagctgcagggcacttccaaaattgatgatatctggaascttgaagtaaaagaaaattttgctggagaagccacactccaacgcatatattccctctgggagcacagtacgaaaaaccacttacagctagagggcctct

SEQ ID NO: 11686 - DNA, 201 bp, Homo sapiens
aagagtaaaccaaaacttggtttatgaatctggctccctcaacttttctaaacttgaaattcaatcacaagtcgattcccagcatgtgggccacagtgttytaactgctaaaggcatggcactgtttggagaagggaaggcagagtttactgggaggcatgatgctcatttaaatggaaaggttattggaactttgaaaaa

SEQ ID NO: 11687 - DNA, 201 bp, Homo sapiens
aaggaattgtgtaccataagccatatttttattcctgccatgggcaatattacctatgatttctcctttaaatcaagtgtcatcacactgaataccaatgstgaactttttaaccagtcagatattgttgctcatctcctttcttcatcttcatctgtcattgatgcactgcagtacaaattagagggcaccacaagattg

SEQ ID NO: 11688 - DNA, 201 bp, Homo sapiens
tgcaggctgaactggtggcaaaaccctccgtgtctgtggagtttgtgacaaatatgggcatcatcattccggacttcgctaggagtggggtccagatgaayaccaacttcttccacgagtcgggtctggaggctcatgttgccctaaaagctgggaagctgaagtttatcattccttccccaaagagaccagtcaagctgc

SEQ ID NO: 11689 - DNA, 201 bp, Homo sapiens
gaacacaggcaccaatgtagataccaaaaaaatgacttccaatttccctgtggatctctccgattatcctaagagcttgcatatgtatgctaatagactcmtggatcacagagtccctcaaacagacatgactttccggcacgtgggttccaaattaatagttgcaatgagctcatggcttcagaaggcatctgggagtct

SEQ ID NO: 11690 - DNA, 201 bp, Homo sapiens
aatggttcagaaatactgttttcctatttccaagacctagtgattacacttcctttcgagttaaggaaacataaactaatagatgtaatctcgatgtatasggaactgttgaaagatttgtgctacgtaatcttcaggaccttttacaattcattttccaactaatagaagataacattaaacagctgaaagagatgaaat

SEQ ID NO: 11691 - DNA, 201 bp, Homo sapiens
ggcccagaatctgtaccaggaactgttgactcaggaaggccaagccagtttccagggactcaaggataacgtgtttgatggcttggtacgagttactcaaraattccatatgaaagtcaagcatctgattgactcactcattgattttctgaacttccccagattccagtttccggggaaacctgggatatacactaggga

SEQ ID NO: 11692 - DNA, 201 bp, Homo sapiens
gctcaccctgagagaagtgtcttcaaagctgagaagaaatctgcagaacaatgctgagtgggtttatcaaggggccattaggcaaattgatgatatcgacrtgaggttccagaaagcagccagtggcaccactgggacctaccaagagtggaaggacaaggcccagaatctgtaccaggaactgttgactcaggaaggcca

SEQ ID NO: 11693 - DNA, 201 bp, Homo sapiens
gcactggggatgaagattacacctatttgattctgcgggtcattggaaatatgggccaaaccatggagcagttaactccagaactcaagtcttcaatcctsaaatgtgtccaaagtacaaagccatcactgatgatccagaaagctgccatccaggctctgcggaaaatggagcctaaagacaaggaccaggaggttcttc

SEQ ID NO: 11694 - DNA, 201 bp, Homo sapiens
cagaatgagcaagtgaagaactttgtggcttcccatattgccaatatcttgaactcagaagaattggatatccaagatctgaaaaagttagtgaaagaagytctgaaagaatctcaacttccaactgtcatggacttcagaaaattctctcggaactatcaactctacaaatctgtttctcttccatcacttgacccagcc

SEQ ID NO: 11695 - DNA, 201 bp, Homo sapiens
ctttgagccaacattggaagctctttttgggaagcaaggatttttcccagacagtgtcaacaaagctttgtactgggttaatggtcaagttcctgatggtrtctctaaggtcttagtggaccactttggctataccaaagatgataaacatgagcaggatatggtaaatggaataatgctcagtgttgagaagctgattaa

SEQ ID NO: 11696 - DNA, 201 bp, Homo sapiens
ttctcctacaagaataagtatgggatggtagcacaagtgacacagactttgaaacttgaagacacaccaaagatcaacagccgcttctttggtgaaggtamtaagaagatgggcctcgcatttgagagcaccaaatccacatcacctccaaagcaggccgaagctgttttgaagactctccaggaactgaaaaaactaacc

SEQ ID NO: 11697 - DNA, 201 bp, Homo sapiens
ctccatccctgtaaaagttttggctgataaattcattattcctgggctgaaactaaatgatctaaattcagttcttgtcatgcctacgttccatgtcccayttacagatcttcaggttccatcgtgcaaacttgacttcagagaaatacaaatctataagaagctgagaacttcatcatttgccctcaacctaccaacact

SEQ ID NO: 11698 - DNA, 201 bp, Homo sapiens
aacattggaagctctttttgggaagcaaggatttttcccagacagtgtcaacaaagctttgtactgggttaatggtcaagttcctgatggtgtctctaagrtcttagtggaccactttggctataccaaagatgataaacatgagcaggatatggtaaatggaataatgctcagtgttgagaagctgattaaagatttgaa

SEQ ID NO: 11699 - DNA, 201 bp, Homo sapiens
taccacatgaaggctgactctgtggttgacctgctttcctacaatgtgcaaggatctggagaaacaacatatgaccacaagaatacgttcacactatcatrtgatgggtctctacgccacaaatttctagattcgaatatcaaattcagtcatgtagaaaaacttggaaacaacccagtctcaaaaggtttactaatattc

SEQ ID NO: 11700 - DNA, 201 bp, Homo sapiens
catccgcacaggcatcagcccacttgctctcatcaaaggcatgacccgccccttgtcaactctgatcagcagcagccagtcctgtcagtacacactggacrctaagaggaagcatgtggcagaagccatctgcaaggagcaacacctcttcctgcctttctcctacaagaataagtatgggatggtagcacaagtgacaca

SEQ ID NO: 11701 - DNA, 201 bp, Homo sapiens
catctcttctgctgccttatcagcaagctataaagcagacactgttgctaaggttcagggtgtggagtttagccatcggctcaacacagacatcgctgggstggcttcagccattgacatgagcacaaactataattcagactcactgcatttcagcaatgtcttccgttctgtaatggccccgtttaccatgaccatcga

SEQ ID NO: 11702 - DNA, 201 bp, Homo sapiens
tattcgaaagtccataatggttcagaaatactgttttcctatttccaagacctagtgattacacttcctttcgagttaaggaaacataaactaatagatgyaatctcgatgtatagggaactgttgaaagatttgtgctacgtaatcttcaggaccttttacaattcattttccaactaatagaagataacattaaacagc

SEQ ID NO: 11703 - DNA, 201 bp, Homo sapiens
ctttcaaattcctggatacactgttccagttgtcaatgttgaagtgtctccattcaccatagagatgtcggcattcggctatgtgttcccaaaagcagtcrgcatgcctagtttctccatcctaggttctgacgtccgtgtgccttcatacacattaatcctgccatcattagagctgccagtccttcatgtccctagaaa

SEQ ID NO: 11704 - DNA, 201 bp, Homo sapiens
catctcctttcttcatcttcatctgtcattgatgcactgcagtacaaattagagggcaccacaagattgacaagaaaaaggggattgaagttagccacagytctgtctctgagcaacaaatttgtggagggtagtcataacagtactgtgagcttaaccacgaaaaatatggaagtgtcagtggcaacaaccacaaaagcc

SEQ ID NO: 11705 - DNA, 201 bp, Homo sapiens
ccccagattccagtttccggggaaacctgggatatacactagggaggaactttgcactatgttcataagggaggtagggacggtactgtcccaggtatatwcgaaagtccataatggttcagaaatactgttttcctatttccaagacctagtgattacacttcctttcgagttaaggaaacataaactaatagatgtaat

SEQ ID NO: 11706 - DNA, 201 bp, Homo sapiens
aaggcagagtttactgggaggcatgatgctcatttaaatggaaaggttattggaactttgaaaaattctcttttcttttcagcccagccatttgagatcasggcatccacaaacaatgaagggaatttgaaagttcgttttccattaaggttaacagggaagatagacttcctgaataactatgcactgtttctgagtccc

SEQ ID NO: 11707 - DNA, 201 bp, Homo sapiens
agtacctacttttggcaagctatacagtattctgaaaatccaatctcctcttttcacattagatgcaaatgctgacatagggaatggaaccacctcagcamacgaagcaggtatcgcagcttccatcactgccaaaggagagtccaaattagaagttctcaattttgattttcaagcaaatgcacaactctcaaaccctaa

SEQ ID NO: 11708 - DNA, 201 bp, Homo sapiens
aaagcctacaggacaccaaaataaccttaatcatcaattggttacaggaggctttaagttcagcatctttggctcacatgaaggccaaattccgagagacyctagaagatacacgagaccgaatgtatcaaatggacattcagcaggaacttcaacgatacctgtctctggtaggccaggtttatagcacacttgtcacct

SEQ ID NO: 11709 - DNA, 201 bp, Homo sapiens
acaagttgaaggagactattcagaagctaagcaatgtcctacaacaagttaagataaaagattactttgagaaattggttggatttattgatgatgctgtsaagaagcttaatgaattatcttttaaaacattcattgaagatgttaacaaattccttgacatgttgataaagaaattaaagtcatttgattaccaccagt

SEQ ID NO: 11710 - DNA, 201 bp, Homo sapiens
gtgatgggtctctacgccacaaatttctagattcgaatatcaaattcagtcatgtagaaaaacttggaaacaacccagtctcaaaaggtttactaatattygatgcatctagttcctggggaccacagatgtctgcttcagttcatttggactccaaaaagaaacagcatttgtttgtcaaagaagtcaagattgatgggc

SEQ ID NO: 11711 - DNA, 201 bp, Homo sapiens
tgagaaaatcaatgccttcagagccaaagtccatgagttaatcgagaggtatgaagtagaccaacaaatccaggttttaatggataaattagtagagttgrcccaccaatacaagttgaaggagactattcagaagctaagcaatgtcctacaacaagttaagataaaagattactttgagaaattggttggatttattga

SEQ ID NO: 11712 - DNA, 201 bp, Homo sapiens
cgtgcctgaatctcagttaactgtgtcccagttcacgcttccaaaaagtgtttcagatggcattgctgctttggatctaaatgcagtagccaacaagatcrcagactttgagttgcccaccatcatcgtgcctgagcagaccattgagattccctccattaagttctctgtacctgctggaattgtcattccttcctttca

SEQ ID NO: 11713 - DNA, 201 bp, Homo sapiens
aataaccttaatcatcaattggttacaggaggctttaagttcagcatctttggctcacatgaaggccaaattccgagagaccctagaagatacacgagacygaatgtatcaaatggacattcagcaggaacttcaacgatacctgtctctggtaggccaggtttatagcacacttgtcacctacatttctgattggtggac

SEQ ID NO: 11714 - DNA, 201 bp, Homo sapiens
aaagtatgataaaaaccaagatgttcactccattaacctcccattttttgagaccttgcaagaatattttgagaggaatcgacaaaccattatagttgtastggaaaacgtacagagaaacctgaagcacatcaatattgatcaatttgtaagaaaatacagagcagccctgggaaaactcccacagcaagctaatgatta

SEQ ID NO: 11715 - DNA, 201 bp, Homo sapiens
tgaactggtggcaaaaccctccgtgtctgtggagtttgtgacaaatatgggcatcatcattccggacttcgctaggagtggggtccagatgaacaccaacytcttccacgagtcgggtctggaggctcatgttgccctaaaagctgggaagctgaagtttatcattccttccccaaagagaccagtcaagctgctcagtgg

SEQ ID NO: 11716 - DNA, 201 bp, Homo sapiens
aaaggagcagttgaccacaagcttagcttggaaagcctcacctcttacttttccattgagtcatctaccaaaggagatgtcaagggttcggttctttctcsggaatattcaggaactattgctagtgaggccaacacttacttgaattccaagagcacacggtcttcagtgaagctgcagggcacttccaaaattgatgat

SEQ ID NO: 11717 - DNA, 201 bp, Homo sapiens
cacatgcagctcaaccgtacagttcctagaatatgaactaaatgttttgggaacacacaaaatcgaagatggtacgttagcctctaagactaaaggaacayttgcacaccgtgacttcagtgcagaatatgaagaagatggcaaatatgaaggacttcaggaatgggaaggaaaagcgcacctcaatatcaaaagcccagc

SEQ ID NO: 11718 - DNA, 201 bp, Homo sapiens
ctgcatttcagcaatgtcttccgttctgtaatggccccgtttaccatgaccatcgatgcacatacaaatggcaatgggaaactcgctctctggggagaacrtactgggcagctgtatagcaaattcctgttgaaagcagaacctctggcatttactttctctcatgattacaaaggctccacaagtcatcatctcgtgtct

SEQ ID NO: 11719 - DNA, 201 bp, Homo sapiens
gcacctagctggaaagttaaaacaacacattgaggctattgatgttagagtgcttttagatcaattgggaactacaatttcatttgaaagaataaatgacrttcttgagcatgtcaaacactttgttataaatcttattggggattttgaagtagctgagaaaatcaatgccttcagagccaaagtccatgagttaatcga

SEQ ID NO: 11720 - DNA, 201 bp, Homo sapiens
cttgtcagagggatcctaacactggccggctcaatggagagtccaacctgaggtttaactcctcctacctccaaggcaccaaccagataacaggaagatawgaagatggaaccctctccctcacctccacctctgatctgcaaagtggcatcattaaaaatactgcttccctaaagtatgagaactacgagctgactttaa

SEQ ID NO: 11721 - DNA, 201 bp, Homo sapiens
aggtcgagctttccaatgaccaagaaaaggcacaccttgacattgcaggatccttagaaggacacctaaggttcctcaaaaatatcatcctaccagtctakgacaagagcttatgggatttcctaaagctggatgtaaccaccagcattggtaggagacagcatcttcgtgtttcaactgcctttgtgtacaccaaaaacc

SEQ ID NO: 11722 - DNA, 201 bp, Homo sapiens
tttgccttttggtggcaaatcctccagagatctaaagatgttagagactgttaggacaccagccctccacttcaagtctgtgggattccatctgccatctygagagttccaagtccctacttttaccattcccaagttgtatcaactgcaagtgcctctcctgggtgttctagacctctccacgaatgtctacagcaactt

SEQ ID NO: 11723 - DNA, 201 bp, Homo sapiens
ggaatattcaggaactattgctagtgaggccaacacttacttgaattccaagagcacacggtcttcagtgaagctgcagggcacttccaaaattgatgatmtctggaaccttgaagtaaaagaaaattttgctggagaagccacactccaacgcatatattccctctgggagcacagtacgaaaaaccacttacagctaga

SEQ ID NO: 11724 - DNA, 201 bp, Homo sapiens
agacagaagaagccaagcaagtgttgtttctggataccgtgtatggaaactgctccactcactttaccgtcaagacgaggaagggcaatgtggcaacagawatatccactgaaagagacctggggcagtgtgatcgcttcaagcccatccgcacaggcatcagcccacttgctctcatcaaaggcatgacccgccccttgt

SEQ ID NO: 11725 - DNA, 201 bp, Homo sapiens
ttcacactatcatgtgatgggtctctacgccacaaatttctagattcgaatatcaaattcagtcatgtagaaaaacttggaaacaacccagtctcaaaagktttactaatattcgatgcatctagttcctggggaccacagatgtctgcttcagttcatttggactccaaaaagaaacagcatttgtttgtcaaagaagtc

SEQ ID NO: 11726 - DNA, 201 bp, Homo sapiens
agacagcatcttcgtgtttcaactgcctttgtgtacaccaaaaaccccaatggctattcattctccatccctgtaaaagttttggctgataaattcattaytcctgggctgaaactaaatgatctaaattcagttcttgtcatgcctacgttccatgtcccatttacagatcttcaggttccatcgtgcaaacttgacttc

SEQ ID NO: 11727 - DNA, 201 bp, Homo sapiens
atgagcacaaactataattcagactcactgcatttcagcaatgtcttccgttctgtaatggccccgtttaccatgaccatcgatgcacatacaaatggcartgggaaactcgctctctggggagaacatactgggcagctgtatagcaaattcctgttgaaagcagaacctctggcatttactttctctcatgattacaaa

SEQ ID NO: 11728 - DNA, 201 bp, Homo sapiens
agtcagcccagttccttccatgatttccctgaccttggccaggaagtggccctgaatgctaacactaagaaccagaagatcagatggaaaaatgaagtccrgattcattctgggtctttccagagccaggtcgagctttccaatgaccaagaaaaggcacaccttgacattgcaggatccttagaaggacacctaaggttc

SEQ ID NO: 11729 - DNA, 201 bp, Homo sapiens
atttacaattgttgcttttgtaaagtatgataaaaaccaagatgttcactccattaacctcccattttttgagaccttgcaagaatattttgagaggaatygacaaaccattatagttgtactggaaaacgtacagagaaacctgaagcacatcaatattgatcaatttgtaagaaaatacagagcagccctgggaaaact

SEQ ID NO: 11730 - DNA, 201 bp, Homo sapiens
aagttagccacagctctgtctctgagcaacaaatttgtggagggtagtcataacagtactgtgagcttaaccacgaaaaatatggaagtgtcagtggcaamaaccacaaaagcccaaattccaattttgagaatgaatttcaagcaagaacttaatggaaataccaagtcaaaacctactgtctcttcctccatggaattt

SEQ ID NO: 11731 - DNA, 201 bp, Homo sapiens
cttgctgaagaaaaccaagaactctgaggagtttgctgcagccatgtccaggtatgagctcaagctggccattccagaagggaagcaggttttcctttacycggagaaagatgaacctacttacatcctgaacatcaagaggggcatcatttctgccctcctggttcccccagagacagaagaagccaagcaagtgttgtt

SEQ ID NO: 11732 - DNA, 201 bp, Homo sapiens
aaaaaagtatagaattacagaaaatgatatacaaattgcattagatgatgccaaaatcaactttaatgaaaaactatctcaactgcagacatatatgatayaatttgatcagtatattaaagatagttatgatttacatgatttgaaaatagctattgctaatattattgatgaaatcattgaaaaattaaaaagtcttga

SEQ ID NO: 11733 - DNA, 201 bp, Homo sapiens
tgcatcctggattcaaaatgtggatactaagtaccaaatcagaatccagatacaagaaaaactgcagcagcttaagagacacatacagaatatagacatcyagcacctagctggaaagttaaaacaacacattgaggctattgatgttagagtgcttttagatcaattgggaactacaatttcatttgaaagaataaatga

SEQ ID NO: 11734 - DNA, 201 bp, Homo sapiens
tatcttagcatccttaccgatccagatggaaaagggaaagagaagattgcagagctttctgccactgctcaggaaataattaaaagccaggccattgcgaygaagaaaataatttctgattaccaccagcagtttagatataaactgcaagatttttcagaccaactctctgattactatgaaaaatttattgctgaatcc

SEQ ID NO: 11735 - DNA, 201 bp, Homo sapiens
agctgcagtggcccgttccagatatatatctcagggatctgaaggtggaggacattcctctagcgagaatcaccctgccagacttccgtttaccagaaatygcaattccagaattcataatcccaactctcaaccttaatgattttcaagttcctgaccttcacataccagaattccagcttccccacatctcacacacaa

SEQ ID NO: 11736 - DNA, 201 bp, Homo sapiens
ggagagattgagcagtattctgtcagcgcaacctatgagctccagagagaggacagagccttggtggataccctgaagtttgtaactcaagcagaaggtgygaagcagactgaggctaccatgacattcaaatataatcggcagagtatgaccttgtccagtgaagtccaaattccggattttgatgttgacctcggaaca

SEQ ID NO: 11737 - DNA, 201 bp, Homo sapiens
cttctgatagatgtggtcacctacctggtggccctgatccccgagccctcagcacagcagctgcgagagatcttcaacatggcgagggatcagcgcagccragccaccttgtatgcgctgagccacgcggtcaacaactatcataagacaaaccctacagggacccaggagctgctggacattgctaattacctgatggaa

SEQ ID NO: 11738 - DNA, 201 bp, Homo sapiens
tgaggtgtccagccccatcactttacaagccttggttcagtgtggacagcctcagtgctccactcacatcctccagtggctgaaacgtgtgcatgccaacmcccttctgatagatgtggtcacctacctggtggccctgatccccgagccctcagcacagcagctgcgagagatcttcaacatggcgagggatcagcgcag

SEQ ID NO: 11739 - DNA, 201 bp, Homo sapiens
ggaggtagggacggtactgtcccaggtatattcgaaagtccataatggttcagaaatactgttttcctatttccaagacctagtgattacacttcctttcragttaaggaaacataaactaatagatgtaatctcgatgtatagggaactgttgaaagatttgtgctacgtaatcttcaggaccttttacaattcattttc

SEQ ID NO: 11740 - DNA, 201 bp, Homo sapiens
aagtcagcccagttccttccatgatttccctgaccttggccaggaagtggccctgaatgctaacactaagaaccagaagatcagatggaaaaatgaagtcyggattcattctgggtctttccagagccaggtcgagctttccaatgaccaagaaaaggcacaccttgacattgcaggatccttagaaggacacctaaggtt

SEQ ID NO: 11741 - DNA, 201 bp, Homo sapiens
ggaattgtcattccttcctttcaagcactgactgcacgctttgaggtagactctcccgtgtataatgccacttggagtgccagtttgaaaaacaaagcagrttatgttgaaacagtcctggattccacatgcagctcaaccgtacagttcctagaatatgaactaaatgttttgggaacacacaaaatcgaagatggtacg

SEQ ID NO: 11742 - DNA, 201 bp, Homo sapiens
tgcaaggatctggagaaacaacatatgaccacaagaatacgttcacactatcatgtgatgggtctctacgccacaaatttctagattcgaatatcaaattsagtcatgtagaaaaacttggaaacaacccagtctcaaaaggtttactaatattcgatgcatctagttcctggggaccacagatgtctgcttcagttcatt

SEQ ID NO: 11743 - DNA, 201 bp, Homo sapiens
aggcacctggaaactcaagacccaatttaacaacaatgaatacagccaggacttggatgcttacaacactaaagataaaattggcgtggagcttactggaygaactctggctgacctaactctactagactccccaattaaagtgccacttttactcagtgagcccatcaatatcattgatgctttagagatgagagatgc

SEQ ID NO: 11744 - DNA, 201 bp, Homo sapiens
cacagagtccctcaaacagacatgactttccggcacgtgggttccaaattaatagttgcaatgagctcatggcttcagaaggcatctgggagtcttccttrtacccagactttgcaagaccacctcaatagcctgaaggagttcaacctccagaacatgggattgccagacttccacatcccagaaaacctcttcttaaaa

SEQ ID NO: 11745 - DNA, 201 bp, Homo sapiens; identical to SEQ ID NO: 11652

SEQ ID NO: 11746 - DNA, 201 bp, Homo sapiens; identical to SEQ ID NO: 11653

SEQ ID NO: 11747 - DNA, 201 bp, Homo sapiens; identical to SEQ ID NO: 11654

SEQ ID NO: 11748 - DNA, 201 bp, Homo sapiens; identical to SEQ ID NO: 11655

SEQ ID NO: 11749 - DNA, 201 bp, Homo sapiens; identical to SEQ ID NO: 11656

SEQ ID NO: 11750 - DNA, 201 bp, Homo sapiens; identical to SEQ ID NO: 11657

SEQ ID NO: 11751 - DNA, 201 bp, Homo sapiens; identical to SEQ ID NO: 11658

SEQ ID NO: 11752 - DNA, 201 bp, Homo sapiens; identical to SEQ ID NO: 11659

SEQ ID NO: 11753 - DNA, 201 bp, Homo sapiens; identical to SEQ ID NO: 11660

SEQ ID NO: 11754 - DNA, 201 bp, Homo sapiens; identical to SEQ ID NO: 11661

SEQ ID NO: 11755 - DNA, 201 bp, Homo sapiens; identical to SEQ ID NO: 11662

SEQ ID NO: 11756 - DNA, 201 bp, Homo sapiens; identical to SEQ ID NO: 11663

SEQ ID NO: 11757 - DNA, 201 bp, Homo sapiens; identical to SEQ ID NO: 11664

SEQ ID NO: 11758 - DNA, 201 bp, Homo sapiens; identical to SEQ ID NO: 11665

SEQ ID NO: 11759 - DNA, 201 bp, Homo sapiens
atcacggagttactgaaaaagctgcaatcaaccacagtcatgaacccctacatgaagcttgctccaggagaacttactatcatcctctaattttttaaaakaaatcttcatttattcttcttttccaattgaactttcacatagcacagaaaaaattcaaactgcctatattgataaaaccatacagtgagccagccttgc

SEQ ID NO: 11760 - DNA, 201 bp, Homo sapiens; identical to SEQ ID NO: 11668

SEQ ID NO: 11761 - DNA, 201 bp, Homo sapiens; identical to SEQ ID NO: 11667

SEQ ID NO: 11762 - DNA, 114 bp, Homo sapiens; identical to SEQ ID NO: 11671

SEQ ID NO: 11763 - DNA, 201 bp, Homo sapiens; identical to SEQ ID NO: 11670

SEQ ID NO: 11764 - DNA, 201 bp, Homo sapiens; identical to SEQ ID NO: 11672

SEQ ID NO: 11765 - DNA, 201 bp, Homo sapiens; identical to SEQ ID NO: 11669

SEQ ID NO: 11766 - DNA, 201 bp, Homo sapiens; identical to SEQ ID NO: 11673

SEQ ID NO: 11767 - DNA, 201 bp, Homo sapiens; identical to SEQ ID NO: 11674

SEQ ID NO: 11768 - DNA, 201 bp, Homo sapiens; identical to SEQ ID NO: 11675

SEQ ID NO: 11769 - DNA, 201 bp, Homo sapiens; identical to SEQ ID NO: 11676

SEQ ID NO: 11770 - DNA, 201 bp, Homo sapiens; identical to SEQ ID NO: 11677

SEQ ID NO: 11771 - DNA, 201 bp, Homo sapiens; identical to SEQ ID NO: 11678

SEQ ID NO: 11772 - DNA, 201 bp, Homo sapiens; identical to SEQ ID NO: 11679

SEQ ID NO: 11773 - DNA, 201 bp, Homo sapiens; identical to SEQ ID NO: 11680

SEQ ID NO: 11774 - DNA, 201 bp, Homo sapiens
ccgatctccatctgcgctaccagaaagacaagaaaggcatctccacctcagcagcctccccagccgtaggcaccgtgggcatggatatggatgaagatgaygacttttctaaatggaacttctactacagccctcagtcctctccagataaaaaactcaccatattcaaaactgagttgagggtccgggaatctgatgagg

SEQ ID NO: 11775 - DNA, 201 bp, Homo sapiens; identical to SEQ ID NO: 11682

SEQ ID NO: 11776 - DNA, 201 bp, Homo sapiens; identical to SEQ ID NO: 11683

SEQ ID NO: 11777 - DNA, 201 bp, Homo sapiens; identical to SEQ ID NO: 11684

SEQ ID NO: 11778 - DNA, 201 bp, Homo sapiens; identical to SEQ ID NO: 11685

SEQ ID NO: 11779 - DNA, 201 bp, Homo sapiens; identical to SEQ ID NO: 11688

SEQ ID NO: 11780 - DNA, 201 bp, Homo sapiens; identical to SEQ ID NO: 11686

SEQ ID NO: 11781 - DNA, 201 bp, Homo sapiens; identical to SEQ ID NO: 11687

SEQ ID NO: 11782 - DNA, 201 bp, Homo sapiens
aatggttcagaaatactgttttcctatttccaagacctagtgattacacttcctttcgagttaaggaaacataaactaatagatgtaatctcgatgtatasggaactgttgaaagatttatcaaaagaagcccaagaggtatttaaagccattcagtctctcaagaccacagaggtgctacgtaatcttcaggacctttta

SEQ ID NO: 11783 - DNA, 201 bp, Homo sapiens; identical to SEQ ID NO: 11689

SEQ ID NO: 11784 - DNA, 201 bp, Homo sapiens; identical to SEQ ID NO: 11691

SEQ ID NO: 11785 - DNA, 201 bp, Homo sapiens; identical to SEQ ID NO: 11692

SEQ ID NO: 11786 - DNA, 201 bp, Homo sapiens; identical to SEQ ID NO: 11693

SEQ ID NO: 11787 - DNA, 201 bp, Homo sapiens; identical to SEQ ID NO: 11694

SEQ ID NO: 11788 - DNA, 201 bp, Homo sapiens; identical to SEQ ID NO: 11695

SEQ ID NO: 11789 - DNA, 201 bp, Homo sapiens; identical to SEQ ID NO: 11696

SEQ ID NO: 11790 - DNA, 201 bp, Homo sapiens; identical to SEQ ID NO: 11698

SEQ ID NO: 11791 - DNA, 201 bp, Homo sapiens; identical to SEQ ID NO: 11697

SEQ ID NO: 11792 - DNA, 201 bp, Homo sapiens; identical to SEQ ID NO: 11699

SEQ ID NO: 11793 - DNA, 201 bp, Homo sapiens; identical to SEQ ID NO: 11700

SEQ ID NO: 11794 - DNA, 201 bp, Homo sapiens; identical to SEQ ID NO: 11701

SEQ ID NO: 11795 - DNA, 201 bp, Homo sapiens
tattcgaaagtccataatggttcagaaatactgttttcctatttccaagacctagtgattacacttcctttcgagttaaggaaacataaactaatagatgyaatctcgatgtatagggaactgttgaaagatttatcaaaagaagcccaagaggtatttaaagccattcagtctctcaagaccacagaggtgctacgtaat

SEQ ID NO: 11796 - DNA, 201 bp, Homo sapiens; identical to SEQ ID NO: 11703

SEQ ID NO: 11797 - DNA, 201 bp, Homo sapiens; identical to SEQ ID NO: 11704

SEQ ID NO: 11798 - DNA, 201 bp, Homo sapiens; identical to SEQ ID NO: 11705

SEQ ID NO: 11799 - DNA, 201 bp, Homo sapiens; identical to SEQ ID NO: 11706

SEQ ID NO: 11800 - DNA, 201 bp, Homo sapiens; identical to SEQ ID NO: 11707

SEQ ID NO: 11801 - DNA, 201 bp, Homo sapiens; identical to SEQ ID NO: 11708

SEQ ID NO: 11802 - DNA, 201 bp, Homo sapiens; identical to SEQ ID NO: 11709

SEQ ID NO: 11803 - DNA, 201 bp, Homo sapiens; identical to SEQ ID NO: 11710

SEQ ID NO: 11804 - DNA, 201 bp, Homo sapiens; identical to SEQ ID NO: 11711

SEQ ID NO: 11805 - DNA, 201 bp, Homo sapiens; identical to SEQ ID NO: 11712

SEQ ID NO: 11806 - DNA, 201 bp, Homo sapiens; identical to SEQ ID NO: 11713

SEQ ID NO: 11807 - DNA, 201 bp, Homo sapiens; identical to SEQ ID NO: 11714

SEQ ID NO: 11808 - DNA, 201 bp, Homo sapiens; identical to SEQ ID NO: 11715

SEQ ID NO: 11809 - DNA, 201 bp, Homo sapiens; identical to SEQ ID NO: 11716

SEQ ID NO: 11810 - DNA, 201 bp, Homo sapiens; identical to SEQ ID NO: 11717

SEQ ID NO: 11811 - DNA, 201 bp, Homo sapiens; identical to SEQ ID NO: 11718

SEQ ID NO: 11812 - DNA, 201 bp, Homo sapiens; identical to SEQ ID NO: 11719

SEQ ID NO: 11813 - DNA, 201 bp, Homo sapiens; identical to SEQ ID NO: 11720

SEQ ID NO: 11814 - DNA, 201 bp, Homo sapiens; identical to SEQ ID NO: 11724

SEQ ID NO: 11815 - DNA, 201 bp, Homo sapiens; identical to SEQ ID NO: 11723

SEQ ID NO: 11816 - DNA, 201 bp, Homo sapiens; identical to SEQ ID NO: 11722

SEQ ID NO: 11817 - DNA, 201 bp, Homo sapiens; identical to SEQ ID NO: 11721

SEQ ID NO: 11818 - DNA, 201 bp, Homo sapiens; identical to SEQ ID NO: 11725

SEQ ID NO: 11819 - DNA, 201 bp, Homo sapiens; identical to SEQ ID NO: 11726

SEQ ID NO: 11820 - DNA, 201 bp, Homo sapiens; identical to SEQ ID NO: 11727

SEQ ID NO: 11821 - DNA, 201 bp, Homo sapiens; identical to SEQ ID NO: 11728

SEQ ID NO: 11822 - DNA, 201 bp, Homo sapiens; identical to SEQ ID NO: 11730

SEQ ID NO: 11823 - DNA, 201 bp, Homo sapiens; identical to SEQ ID NO: 11731

SEQ ID NO: 11824 - DNA, 201 bp, Homo sapiens; identical to SEQ ID NO: 11729

SEQ ID NO: 11825 - DNA, 201 bp, Homo sapiens; identical to SEQ ID NO: 11732

SEQ ID NO: 11826 - DNA, 201 bp, Homo sapiens; identical to SEQ ID NO: 11733

SEQ ID NO: 11827 - DNA, 201 bp, Homo sapiens; identical to SEQ ID NO: 11734

SEQ ID NO: 11828 - DNA, 201 bp, Homo sapiens; identical to SEQ ID NO: 11735

SEQ ID NO: 11829 - DNA, 201 bp, Homo sapiens; identical to SEQ ID NO: 11736

SEQ ID NO: 11830 - DNA, 201 bp, Homo sapiens; identical to SEQ ID NO: 11737

SEQ ID NO: 11831 - DNA, 201 bp, Homo sapiens; identical to SEQ ID NO: 11738

SEQ ID NO: 11832 - DNA, 201 bp, Homo sapiens
ggaggtagggacggtactgtcccaggtatattcgaaagtccataatggttcagaaatactgttttcctatttccaagacctagtgattacacttcctttcragttaaggaaacataaactaatagatgtaatctcgatgtatagggaactgttgaaagatttatcaaaagaagcccaagaggtatttaaagccattcagtc

SEQ ID NO: 11833 - DNA, 201 bp, Homo sapiens; identical to SEQ ID NO: 11740

SEQ ID NO: 11834 - DNA, 201 bp, Homo sapiens; identical to SEQ ID NO: 11741

SEQ ID NO: 11835 - DNA, 201 bp, Homo sapiens; identical to SEQ ID NO: 11742

SEQ ID NO: 11836 - DNA, 201 bp, Homo sapiens; identical to SEQ ID NO: 11743

SEQ ID NO: 11837 - DNA, 201 bp, Homo sapiens; identical to SEQ ID NO: 11744

SEQ ID NO: 11838 - DNA, 201 bp, Homo sapiens; identical to SEQ ID NO: 11652

SEQ ID NO: 11839 - DNA, 201 bp, Homo sapiens; identical to SEQ ID NO: 11653

SEQ ID NO: 11840 - DNA, 201 bp, Homo sapiens; identical to SEQ ID NO: 11654

SEQ ID NO: 11841 - DNA, 201 bp, Homo sapiens; identical to SEQ ID NO: 11655

SEQ ID NO: 11842 - DNA, 201 bp, Homo sapiens; identical to SEQ ID NO: 11656

SEQ ID NO: 11843 - DNA, 201 bp, Homo sapiens; identical to SEQ ID NO: 11657

SEQ ID NO: 11844 - DNA, 201 bp, Homo sapiens; identical to SEQ ID NO: 11658

SEQ ID NO: 11845 - DNA, 201 bp, Homo sapiens; identical to SEQ ID NO: 11659

SEQ ID NO: 11846 - DNA, 201 bp, Homo sapiens; identical to SEQ ID NO: 11660

SEQ ID NO: 11847 - DNA, 201 bp, Homo sapiens; identical to SEQ ID NO: 11661

SEQ ID NO: 11848 - DNA, 201 bp, Homo sapiens; identical to SEQ ID NO: 11662

SEQ ID NO: 11849 - DNA, 201 bp, Homo sapiens; identical to SEQ ID NO: 11663

SEQ ID NO: 11850 - DNA, 201 bp, Homo sapiens; identical to SEQ ID NO: 11664

SEQ ID NO: 11851 - DNA, 201 bp, Homo sapiens; identical to SEQ ID NO: 11665

SEQ ID NO: 11852 - DNA, 201 bp, Homo sapiens; identical to SEQ ID NO: 11666

SEQ ID NO: 11853 - DNA, 201 bp, Homo sapiens; identical to SEQ ID NO: 11668

SEQ ID NO: 11854 - DNA, 201 bp, Homo sapiens; identical to SEQ ID NO: 11667

SEQ ID NO: 11855 - DNA, 114 bp, Homo sapiens; identical to SEQ ID NO: 11671

SEQ ID NO: 11856 - DNA, 201 bp, Homo sapiens; identical to SEQ ID NO: 11670

SEQ ID NO: 11857 - DNA, 201 bp, Homo sapiens; identical to SEQ ID NO: 11672

SEQ ID NO: 11858 - DNA, 201 bp, Homo sapiens; identical to SEQ ID NO: 11669

SEQ ID NO: 11859 - DNA, 201 bp, Homo sapiens; identical to SEQ ID NO: 11673

SEQ ID NO: 11860 - DNA, 201 bp, Homo sapiens; identical to SEQ ID NO: 11674

SEQ ID NO: 11861 - DNA, 201 bp, Homo sapiens; identical to SEQ ID NO: 11675

SEQ ID NO: 11862 - DNA, 201 bp, Homo sapiens; identical to SEQ ID NO: 11676

SEQ ID NO: 11863 - DNA, 201 bp, Homo sapiens; identical to SEQ ID NO: 11677

SEQ ID NO: 11864 - DNA, 201 bp, Homo sapiens; identical to SEQ ID NO: 11678

SEQ ID NO: 11865 - DNA, 201 bp, Homo sapiens; identical to SEQ ID NO: 11679

SEQ ID NO: 11866 - DNA, 201 bp, Homo sapiens; identical to SEQ ID NO: 11680

SEQ ID NO: 11867 - DNA, 201 bp, Homo sapiens; identical to SEQ ID NO: 11774

SEQ ID NO: 11868 - DNA, 201 bp, Homo sapiens; identical to SEQ ID NO: 11682

SEQ ID NO: 11869 - DNA, 201 bp, Homo sapiens; identical to SEQ ID NO: 11683

SEQ ID NO: 11870 - DNA, 201 bp, Homo sapiens; identical to SEQ ID NO: 11684

SEQ ID NO: 11871 - DNA, 201 bp, Homo sapiens; identical to SEQ ID NO: 11685

SEQ ID NO: 11872 - DNA, 201 bp, Homo sapiens; identical to SEQ ID NO: 11688

SEQ ID NO: 11873 - DNA, 201 bp, Homo sapiens; identical to SEQ ID NO: 11686

SEQ ID NO: 11874 - DNA, 201 bp, Homo sapiens; identical to SEQ ID NO: 11687

SEQ ID NO: 11875 - DNA, 201 bp, Homo sapiens; identical to SEQ ID NO: 11782

SEQ ID NO: 11876 - DNA, 201 bp, Homo sapiens; identical to SEQ ID NO: 11689

SEQ ID NO: 11877 - DNA, 201 bp, Homo sapiens; identical to SEQ ID NO: 11691

SEQ ID NO: 11878 - DNA, 201 bp, Homo sapiens; identical to SEQ ID NO: 11692

SEQ ID NO: 11879 - DNA, 201 bp, Homo sapiens; identical to SEQ ID NO: 11693

SEQ ID NO: 11880 - DNA, 201 bp, Homo sapiens; identical to SEQ ID NO: 11694

SEQ ID NO: 11881 - DNA, 201 bp, Homo sapiens; identical to SEQ ID NO: 11695

SEQ ID NO: 11882 - DNA, 201 bp, Homo sapiens; identical to SEQ ID NO: 11696

SEQ ID NO: 11883 - DNA, 201 bp, Homo sapiens; identical to SEQ ID NO: 11698

SEQ ID NO: 11884 - DNA, 201 bp, Homo sapiens; identical to SEQ ID NO: 11697

SEQ ID NO: 11885 - DNA, 201 bp, Homo sapiens; identical to SEQ ID NO: 11699

SEQ ID NO: 11886 - DNA, 201 bp, Homo sapiens; identical to SEQ ID NO: 11700

SEQ ID NO: 11887 - DNA, 201 bp, Homo sapiens; identical to SEQ ID NO: 11701

SEQ ID NO: 11888 - DNA, 201 bp, Homo sapiens; identical to SEQ ID NO: 11795

SEQ ID NO: 11889 - DNA, 201 bp, Homo sapiens; identical to SEQ ID NO: 11703

SEQ ID NO: 11890 - DNA, 201 bp, Homo sapiens; identical to SEQ ID NO: 11704

SEQ ID NO: 11891 - DNA, 201 bp, Homo sapiens; identical to SEQ ID NO: 11705

SEQ ID NO: 11892 - DNA, 201 bp, Homo sapiens; identical to SEQ ID NO: 11706

SEQ ID NO: 11893 - DNA, 201 bp, Homo sapiens; identical to SEQ ID NO: 11707

SEQ ID NO: 11894 - DNA, 201 bp, Homo sapiens; identical to SEQ ID NO: 11708

SEQ ID NO: 11895 - DNA, 201 bp, Homo sapiens; identical to SEQ ID NO: 11709

SEQ ID NO: 11896 - DNA, 201 bp, Homo sapiens; identical to SEQ ID NO: 11710

SEQ ID NO: 11897 - DNA, 201 bp, Homo sapiens; identical to SEQ ID NO: 11711

SEQ ID NO: 11898 - DNA, 201 bp, Homo sapiens; identical to SEQ ID NO: 11712

SEQ ID NO: 11899 - DNA, 201 bp, Homo sapiens; identical to SEQ ID NO: 11713

SEQ ID NO: 11900 - DNA, 201 bp, Homo sapiens; identical to SEQ ID NO: 11714

SEQ ID NO: 11901 - DNA, 201 bp, Homo sapiens; identical to SEQ ID NO: 11715

SEQ ID NO: 11902 - DNA, 201 bp, Homo sapiens; identical to SEQ ID NO: 11716

SEQ ID NO: 11903 - DNA, 201 bp, Homo sapiens; identical to SEQ ID NO: 11717

SEQ ID NO: 11904 - DNA, 201 bp, Homo sapiens; identical to SEQ ID NO: 11718

SEQ ID NO: 11905 - DNA, 201 bp, Homo sapiens; identical to SEQ ID NO: 11719

SEQ ID NO: 11906 - DNA, 201 bp, Homo sapiens; identical to SEQ ID NO: 11720

SEQ ID NO: 11907 - DNA, 201 bp, Homo sapiens; identical to SEQ ID NO: 11724

SEQ ID NO: 11908 - DNA, 201 bp, Homo sapiens; identical to SEQ ID NO: 11723

SEQ ID NO: 11909 - DNA, 201 bp, Homo sapiens; identical to SEQ ID NO: 11722

SEQ ID NO: 11910 - DNA, 201 bp, Homo sapiens; identical to SEQ ID NO: 11721

SEQ ID NO: 11911 - DNA, 201 bp, Homo sapiens; identical to SEQ ID NO: 11725

SEQ ID NO: 11912 - DNA, 201 bp, Homo sapiens; identical to SEQ ID NO: 11726

SEQ ID NO: 11913 - DNA, 201 bp, Homo sapiens; identical to SEQ ID NO: 11727

SEQ ID NO: 11914 - DNA, 201 bp, Homo sapiens; identical to SEQ ID NO: 11728

SEQ ID NO: 11915 - DNA, 201 bp, Homo sapiens; identical to SEQ ID NO: 11730

SEQ ID NO: 11916 - DNA, 201 bp, Homo sapiens; identical to SEQ ID NO: 11731

SEQ ID NO: 11917 - DNA, 201 bp, Homo sapiens; identical to SEQ ID NO: 11729

SEQ ID NO: 11918 - DNA, 201 bp, Homo sapiens; identical to SEQ ID NO: 11732

SEQ ID NO: 11919 - DNA, 201 bp, Homo sapiens; identical to SEQ ID NO: 11733

SEQ ID NO: 11920 - DNA, 201 bp, Homo sapiens; identical to SEQ ID NO: 11734

SEQ ID NO: 11921 - DNA, 201 bp, Homo sapiens; identical to SEQ ID NO: 11735

SEQ ID NO: 11922 - DNA, 201 bp, Homo sapiens; identical to SEQ ID NO: 11736

SEQ ID NO: 11923 - DNA, 201 bp, Homo sapiens; identical to SEQ ID NO: 11737

SEQ ID NO: 11924 - DNA, 201 bp, Homo sapiens; identical to SEQ ID NO: 11738

SEQ ID NO: 11925 - DNA, 201 bp, Homo sapiens; identical to SEQ ID NO: 11832

SEQ ID NO: 11926 - DNA, 201 bp, Homo sapiens; identical to SEQ ID NO: 11740

SEQ ID NO: 11927 - DNA, 201 bp, Homo sapiens; identical to SEQ ID NO: 11741

SEQ ID NO: 11928 - DNA, 201 bp, Homo sapiens; identical to SEQ ID NO: 11742

SEQ ID NO: 11929 - DNA, 201 bp, Homo sapiens; identical to SEQ ID NO: 11743

SEQ ID NO: 11930 - DNA, 201 bp, Homo sapiens; identical to SEQ ID NO: 11744

SEQ ID NO: 11931 - DNA, 201 bp, Homo sapiens
ccttccatgtgaatgcacaggaagctgagatgaaccctggcatttggcctcttgtagtcttggctaaggaaattctaacgcaaaaatagctcttgctttgrcttaggtgtgaagacccagacaggactgcagagggccccagagtggagatcccacatatttcaaaaacatgcttttccaaacccaggctattcggcaagg

SEQ ID NO: 11932 - DNA, 201 bp, Homo sapiens
gctgagatgaaccctggcatttggcctcttgtagtcttggctaaggaaattctaacgcaaaaatagctcttgctttgacttaggtgtgaagacccagacakgactgcagagggccccagagtggagatcccacatatttcaaaaacatgcttttccaaacccaggctattcggcaaggaagttagtttttaatctctccac

SEQ ID NO: 11933 - DNA, 201 bp, Homo sapiens
gaccgcctttggaggcagaagagcagttccacccaataactctaatgcagcggaagatgacctgcccacagtggagcttcagggcgtggtgccccggggcrtcaacctgcaagagtttcttaatgtcacgagcgttcacctgttcaaggagagatgggacactaacaaggtggaccaccacactgacaagtatgaaaacaa

SEQ ID NO: 11934 - DNA, 201 bp, Homo sapiens
cagaaggtgtcatgaaatcaaggtccaacgttgacatggactttgaagtggaaaatgctgtgctgggaaaagacttcaagctctccatcaccttccggaavaacagccacaaccgttacaccatcacagcttatctctcagccaacatcaccttctacaccggggtcccgaaggcagaattcaagaaggagacgttcgacg

SEQ ID NO: 11935 - DNA, 201 bp, Homo sapiens
cgaaccagtcgaaacccagaaacagacacgtacattctcttcaatccttggtgtgaagatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacact

SEQ ID NO: 11936 - DNA, 201 bp, Homo sapiens
agaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaagatgatgctgtgtatctggacaatgagaaagaaagagaagagta

SEQ ID NO: 11937 - DNA, 201 bp, Homo sapiens
gtttcttaatgtcacgagcgttcacctgttcaaggagagatgggacactaacaaggtggaccaccacactgacaagtatgaaaacaacaagctgattgtcygcagagggcagtctttctatgtgcagattgacttcagtcgtccatatgaccccagaagggatctcttcagggtggaatacgtcattggtcgctacccaca

SEQ ID NO: 11938 - DNA, 201 bp, Homo sapiens
aggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagct

SEQ ID NO: 11939 - DNA, 201 bp, Homo sapiens
tgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgca

SEQ ID NO: 11940 - DNA, 201 bp, Homo sapiens
gtcagaaacttccaggaccgcctttggaggcagaagagcagttccacccaataactctaatgcagcggaagatgacctgcccacagtggagcttcagggcktggtgccccggggcgtcaacctgcaagagtttcttaatgtcacgagcgttcacctgttcaaggagagatgggacactaacaaggtggaccaccacactga

SEQ ID NO: 11941 - DNA, 201 bp, Homo sapiens
aaccatccctgagatcatcatcaaggtccgtggcactcaggtagttggttctgacatgactgtgacaattcagtttaccaatcctttaaaagaaaccctgygaaatgtctgggtacacctggatggtcctggagtaacaagaccaatgaagaagatgttccgtgaaatccggcccaactccaccgtgcagtgggaagaagt

SEQ ID NO: 11942 - DNA, 201 bp, Homo sapiens
ctaaccatccctgagatcatcatcaaggtccgtggcactcaggtagttggttctgacatgactgtgacaattcagtttaccaatcctttaaaagaaacccygcgaaatgtctgggtacacctggatggtcctggagtaacaagaccaatgaagaagatgttccgtgaaatccggcccaactccaccgtgcagtgggaagaa

SEQ ID NO: 11943 - DNA, 201 bp, Homo sapiens
aatacctggcctcatttaaaacaagacttcagattccccactcagccttttgggaataatagcacatgatttgggctctagaattccagtcccctttctcrgggtcaggttctaccctccatgtgagaatatttttcccaggactagagcacaacataatttttatttttggcaaagccagaaaaagatctttcattttgc

SEQ ID NO: 11944 - DNA, 201 bp, Homo sapiens
acaaattggaggagatggcatgatggatattactgatacttacaaattccaagaaggtcaagaagaagagagattggccctagaaactgccctgatgtacrgagctaaaaagcccctcaacacagaaggtgtcatgaaatcaaggtccaacgttgacatggactttgaagtggaaaatgctgtgctgggaaaagacttcaa

SEQ ID NO: 11945 - DNA, 201 bp, Homo sapiens
tcatttacattacagctaagaaagatggcactcatgtggtggaaaatgtggatgccacccacattgggaaattaattgtgaccaaacaaattggaggagayggcatgatggatattactgatacttacaaattccaagaaggtcaagaagaagagagattggccctagaaactgccctgatgtacggagctaaaaagcccc

SEQ ID NO: 11946 - DNA, 201 bp, Homo sapiens
tatagaaggactgcagccactgattctctcttgtccttcacatcacccatgttgagacctcagcttggcactcaggtgctgaagggtaatatggactcagscttgcaaatagccagtgctagttctgacccaaccacagaggatgctgacatcatttgtattatgttccaaggctactacagagaaggctgcctgctatgt

SEQ ID NO: 11947 - DNA, 201 bp, Homo sapiens
agctctccatcaccttccggaacaacagccacaaccgttacaccatcacagcttatctctcagccaacatcaccttctacaccggggtcccgaaggcagarttcaagaaggagacgttcgacgtgacgctggagcccttgtccttcaagaaagaggcggtgctgatccaagccggcgagtacatgggtcagctgctggaac

SEQ ID NO: 11948 - DNA, 201 bp, Homo sapiens
agggccccagagtggagatcccacatatttcaaaaacatgcttttccaaacccaggctattcggcaaggaagttagtttttaatctctccaccttccaaaragtgctaagcattagctttaattaagctctcatagctcataagagtaacagtcatcatttatcatcacaaatggctacatctccaaatatcagtgggctc

SEQ ID NO: 11949 - DNA, 201 bp, Homo sapiens
gctgggaaaagacttcaagctctccatcaccttccggaacaacagccacaaccgttacaccatcacagcttatctctcagccaacatcaccttctacaccrgggtcccgaaggcagaattcaagaaggagacgttcgacgtgacgctggagcccttgtccttcaagaaagaggcggtgctgatccaagccggcgagtacat

SEQ ID NO: 11950 - DNA, 201 bp, Homo sapiens
gacatcaagaccagaagctggagctatggtcagtttgaagatggcatcctggacacttgcctgtatgtgatggacagagcacaaatggacctctctggaakagggaatcccatcaaagtcagccgtgtggggtctgcaatggtgaatgccaaagatgacgaaggtgtcctcgttggatcctgggacaatatctatgcctat

SEQ ID NO: 11951 - DNA, 201 bp, Homo sapiens
actagagcacaacataatttttatttttggcaaagccagaaaaagatctttcattttgcacctgcagccaagcaaatgcctgccaaattttagatttaccwtgttagaagaggtggccccatattaacaaattgcatttgtgggaaacttaaccacctacaaggagataagaaagcaggtgcaacactcaagtctattgaa

SEQ ID NO: 11952 - DNA, 201 bp, Homo sapiens
tataataagcccaacaagttgaagaagctggcggatctagtgaccagatatatagaaggactgcagccactgattctctcttgtccttcacatcacccatkttgagacctcagcttggcactcaggtgctgaagggtaatatggactcagccttgcaaatagccagtgctagttctgacccaaccacagaggatgctgaca

SEQ ID NO: 11953 - DNA, 201 bp, Homo sapiens
tctggaagagggaatcccatcaaagtcagccgtgtggggtctgcaatggtgaatgccaaagatgacgaaggtgtcctcgttggatcctgggacaatatctrtgcctatggcgtccccccatcggcctggactggaagcgttgacattctattggaataccggagctctgagaatccagtccggtatggccaatgctgggtt

SEQ ID NO: 11954 - DNA, 201 bp, Homo sapiens
aaagacttcaagctctccatcaccttccggaacaacagccacaaccgttacaccatcacagcttatctctcagccaacatcaccttctacaccggggtccygaaggcagaattcaagaaggagacgttcgacgtgacgctggagcccttgtccttcaagaaagaggcggtgctgatccaagccggcgagtacatgggtcag

SEQ ID NO: 11955 - DNA, 201 bp, Homo sapiens
actggaagcgttgacattctattggaataccggagctctgagaatccagtccggtatggccaatgctgggtttttgctggtgtctttaacacatttttacratgccttggaataccagcaagaattgttaccaattatttctctgcccatgataatgatgccaatttgcaaatggacatcttcctggaagaagatgggaac

SEQ ID NO: 11956 - DNA, 201 bp, Homo sapiens
ggattcagtgtggaactaccactgctggaatgaagcatggatgacaaggcctgaccttcctgttggatttggaggctggcaagctgtggacagcacccccyaggaaaatagcgatggcatgtatcggtgtggccccgcctcggttcaagccatcaagcacggccatgtctgcttccaatttgatgcaccttttgtttttgc

SEQ ID NO: 11957 - DNA, 201 bp, Homo sapiens
ccacagtggagcttcagggcgtggtgccccggggcgtcaacctgcaagagtttcttaatgtcacgagcgttcacctgttcaaggagagatgggacactaamaaggtggaccaccacactgacaagtatgaaaacaacaagctgattgtccgcagagggcagtctttctatgtgcagattgacttcagtcgtccatatgacc

SEQ ID NO: 11958 - DNA, 201 bp, Homo sapiens
tggaatgaagcatggatgacaaggcctgaccttcctgttggatttggaggctggcaagctgtggacagcaccccccaggaaaatagcgatggcatgtatcrgtgtggccccgcctcggttcaagccatcaagcacggccatgtctgcttccaatttgatgcaccttttgtttttgcagaggtcaacagcgacctcatttac

SEQ ID NO: 11959 - DNA, 201 bp, Homo sapiens
atcaaggtccgtggcactcaggtagttggttctgacatgactgtgacaattcagtttaccaatcctttaaaagaaaccctgcgaaatgtctgggtacaccyggatggtcctggagtaacaagaccaatgaagaagatgttccgtgaaatccggcccaactccaccgtgcagtgggaagaagtgtgccggccctgggtctct

SEQ ID NO: 11960 - DNA, 201 bp, Homo sapiens
acaaggagataagaaagcaggtgcaacactcaagtctattgaataatgtagttttgtgatgcattttatagaatgtgtcacactgtggcctgatcagcagragccaatatcccttactttaaccctttctgggatgcaatactaggaagtaaagtgaagaatttatctctttagttagtgattatatttcacccatctctc

SEQ ID NO: 11961 - DNA, 201 bp, Homo sapiens
attctaacgcaaaaatagctcttgctttgacttaggtgtgaagacccagacaggactgcagagggccccagagtggagatcccacatatttcaaaaacatrcttttccaaacccaggctattcggcaaggaagttagtttttaatctctccaccttccaaagagtgctaagcattagctttaattaagctctcatagctca

SEQ ID NO: 11962 - DNA, 169 bp, Homo sapiens
ctttcccgagtccgtttgaggaagtccccgaggcgcacagagcaagcccacgcgagggcacctctggasgggagcgcctgcaggaccttgtaaagtcaaaaatgtcagaaacttccaggaccgcctttggaggcagaagagcagttccacccaataactctaatgcagc

SEQ ID NO: 11963 - DNA, 201 bp, Homo sapiens
ggatgttctggccaagcaaaagtccaccgtgctaaccatccctgagatcatcatcaaggtccgtggcactcaggtagttggttctgacatgactgtgacarttcagtttaccaatcctttaaaagaaaccctgcgaaatgtctgggtacacctggatggtcctggagtaacaagaccaatgaagaagatgttccgtgaaat

SEQ ID NO: 11964 - DNA, 201 bp, Homo sapiens
gccaacatcaccttctacaccggggtcccgaaggcagaattcaagaaggagacgttcgacgtgacgctggagcccttgtccttcaagaaagaggcggtgcwgatccaagccggcgagtacatgggtcagctgctggaacaagcgtccctgcacttctttgtcacagctcgcatcaatgagaccagggatgttctggccaag

SEQ ID NO: 11965 - DNA, 201 bp, Homo sapiens
attctctcttgtccttcacatcacccatgttgagacctcagcttggcactcaggtgctgaagggtaatatggactcagccttgcaaatagccagtgctagytctgacccaaccacagaggatgctgacatcatttgtattatgttccaaggctactacagagaaggctgcctgctatgtatttgcaaggctgatttatggt

SEQ ID NO: 11966 - DNA, 201 bp, Homo sapiens
tgttctggccaagcaaaagtccaccgtgctaaccatccctgagatcatcatcaaggtccgtggcactcaggtagttggttctgacatgactgtgacaattsagtttaccaatcctttaaaagaaaccctgcgaaatgtctgggtacacctggatggtcctggagtaacaagaccaatgaagaagatgttccgtgaaatccg

SEQ ID NO: 11967 - DNA, 201 bp, Homo sapiens
tgttggatttggaggctggcaagctgtggacagcaccccccaggaaaatagcgatggcatgtatcggtgtggccccgcctcggttcaagccatcaagcacrgccatgtctgcttccaatttgatgcaccttttgtttttgcagaggtcaacagcgacctcatttacattacagctaagaaagatggcactcatgtggtgga

SEQ ID NO: 11968 - DNA, 201 bp, Homo sapiens
ataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattatta

SEQ ID NO: 11969 - DNA, 201 bp, Homo sapiens
ggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtcgctacccacaggagaacaagggaacctacatcccagtgcctat

SEQ ID NO: 11970 - DNA, 201 bp, Homo sapiens
ggtctgcaatggtgaatgccaaagatgacgaaggtgtcctcgttggatcctgggacaatatctatgcctatggcgtccccccatcggcctggactggaagsgttgacattctattggaataccggagctctgagaatccagtccggtatggccaatgctgggtttttgctggtgtctttaacacatttttacgatgccttg

SEQ ID NO: 11971 - DNA, 201 bp, Homo sapiens
tggcatttggcctcttgtagtcttggctaaggaaattctaacgcaaaaatagctcttgctttgacttaggtgtgaagacccagacaggactgcagagggcyccagagtggagatcccacatatttcaaaaacatgcttttccaaacccaggctattcggcaaggaagttagtttttaatctctccaccttccaaagagtgc

SEQ ID NO: 11972 - DNA, 201 bp, Homo sapiens
ttctattggaataccggagctctgagaatccagtccggtatggccaatgctgggtttttgctggtgtctttaacacatttttacgatgccttggaataccmgcaagaattgttaccaattatttctctgcccatgataatgatgccaatttgcaaatggacatcttcctggaagaagatgggaacgtgaattccaaactca

SEQ ID NO: 11973 - DNA, 201 bp, Homo sapiens
aacgttgacatggactttgaagtggaaaatgctgtgctgggaaaagacttcaagctctccatcaccttccggaacaacagccacaaccgttacaccatcayagcttatctctcagccaacatcaccttctacaccggggtcccgaaggcagaattcaagaaggagacgttcgacgtgacgctggagcccttgtccttcaag

SEQ ID NO: 11974 - DNA, 201 bp, Homo sapiens
caacagccacaaccgttacaccatcacagcttatctctcagccaacatcaccttctacaccggggtcccgaaggcagaattcaagaaggagacgttcgacrtgacgctggagcccttgtccttcaagaaagaggcggtgctgatccaagccggcgagtacatgggtcagctgctggaacaagcgtccctgcacttctttgt

SEQ ID NO: 11975 - DNA, 201 bp, Homo sapiens
tttaacacatttttacgatgccttggaataccagcaagaattgttaccaattatttctctgcccatgataatgatgccaatttgcaaatggacatcttccyggaagaagatgggaacgtgaattccaaactcaccaaggattcagtgtggaactaccactgctggaatgaagcatggatgacaaggcctgaccttcctgtt

SEQ ID NO: 11976 - DNA, 201 bp, Homo sapiens
gacatcaagaccagaagctggagctatggtcagtttgaagatggcatcctggacacttgcctgtatgtgatggacagagcacaaatggacctctctggaakagggaatcccatcaaagtcagccgtgtggggtctgcaatgggctttctcacttacgaagtgggtattgattctttgcaggatcctgtgtgcctggtcata

SEQ ID NO: 11977 - DNA, 201 bp, Homo sapiens; identical to SEQ ID NO: 11972

SEQ ID NO: 11978 - DNA, 201 bp, Homo sapiens; identical to SEQ ID NO: 11955

SEQ ID NO: 11979 - DNA, 141 bp, Homo sapiens
ggagcctcacctcaggggggctacagttttgcacagagcggccccactgttgacgccaacagaggccatggtctgagctccttagctgttcaggagagggmtggggactcaggaacctcagaagggcagagcagggcagag

SEQ ID NO: 11980 - DNA, 201 bp, Homo sapiens
ttaactgcagtttgggatggaggtggtgctcagcttttatataaagggggaagcaagtatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacact

SEQ ID NO: 11981 - DNA, 201 bp, Homo sapiens
agaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaagggatttctgacttcatggctgcctctgcctctaggagtcctac

SEQ ID NO: 11982 - DNA, 201 bp, Homo sapiens
ttcactgtgacacacctacatgtaccacctccatccatatttgctccagtgaatgccaaagatgacgaaggtgtcctcgttggatcctgggacaatatctrtgcctatggcgtccccccatcggcctggactggaagcgttgacattctattggaataccggagctctgagaatccagtccggtatggccaatgctgggtt

SEQ ID NO: 11983 - DNA, 201 bp, Homo sapiens
tttaacacatttttacgatgccttggaataccagcaagaattgttaccaattatttctctgcccatgataatgatgccaatttgcaaatggacatcttccyggaagaagatgggaacgtgaattccaaactcaccaaggattcagtgtgcaaggatctcaggagctattggcctcatacttacctccctccacaggctctg

SEQ ID NO: 11984 - DNA, 201 bp, Homo sapiens
taggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggaggtggtgctcagcttttatataaagggggaagcaagtatgatgctgtgtatctggacaatga

SEQ ID NO: 11985 - DNA, 201 bp, Homo sapiens
gaaatagcacatagatctcagttcatccccaggatctggcagcaactatgggcagagaatttcccccaaggagatgcagctgcttctgcaaaggctgccgytactgcagataaaggctcgttattcactgtgacacacctacatgtaccacctccatccatatttgctccagtgaatgccaaagatgacgaaggtgtcctc

SEQ ID NO: 11986 - DNA, 201 bp, Homo sapiens
tatttgctccagtgaatgccaaagatgacgaaggtgtcctcgttggatcctgggacaatatctatgcctatggcgtccccccatcggcctggactggaagsgttgacattctattggaataccggagctctgagaatccagtccggtatggccaatgctgggtttttgctggtgtctttaacacatttttacgatgccttg

SEQ ID NO: 11987 - DNA, 201 bp, Homo sapiens
gcatatgttcccgggagggataagccagacctgccaacctggaagaggaatttccgctctgccctcaaccgcaaagaagggttgcgtttagcagaggaccrgagcaaggaccctcacgacccacataaaatctacgagtttgtgaactcaggagttggggacttttcccagccagacacctctccggacaccaatggtgga

SEQ ID NO: 11988 - DNA, 181 bp, Homo sapiens
cacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgctatga

SEQ ID NO: 11989 - DNA, 201 bp, Homo sapiens
cgcagcctcgagtttgagagctacccggagctccaagacaggggtgggttccagctgcccgcacgccccgaccttccatcgtaggtaacgcggaagagccygggagagcgttggtggcgtccgagagcgaggagcgggaaagaggatgggtctgcacggagagtggaaaggcaggctgtgtactctggggaaagtggagca

SEQ ID NO: 11990 - DNA, 201 bp, Homo sapiens
gtcgatcaaaaagaaagccccagcgctctagagctcagctgacgggaaagggggtgcgcagcctcgagtttgagagctacccggagctccaagacaggggkgggttccagctgcccgcacgccccgaccttccatcgtaggtaacgcggaagagcccgggagagcgttggtggcgtccgagagcgaggagcgggaaagagg

SEQ ID NO: 11991 - DNA, 182 bp, Homo sapiens
cagcccagcgggccgtcccatcggcttttgggtctgttacccaaagaatgataaagttggttttatttcaagaagtcgatcraaaagaaagccccagcgctctagagctcagctgacgggaaagggggtgcgcagcctcgagtttgagagctacccggagctccaagacaggggtgggttcc

SEQ ID NO: 11992 - DNA, 201 bp, Homo sapiens
tttatttcaagaagtcgatcaaaaagaaagccccagcgctctagagctcagctgacgggaaagggggtgcgcagcctcgagtttgagagctacccggagcyccaagacaggggtgggttccagctgcccgcacgccccgaccttccatcgtaggtaacgcggaagagcccgggagagcgttggtggcgtccgagagcgagg

SEQ ID NO: 11993 - DNA, 201 bp, Homo sapiens
cgtgcctcagggccttggtagaaatggcccgggtagggggtgcctcctccctggagaatactgtggacctgcacatttccaacagccacccactctccctyacctccgaccagtacaaggcctacctgcaggacttggtggagggcatggatttccagggccctggggagacctgagccctcgctcctcatggtgtgcctc

SEQ ID NO: 11994 - DNA, 201 bp, Homo sapiens
ctctcgggaggatgggaggatgggaagaggaggtttcctgtttgtacccccgaaaatatgggtgaaggacctgtgccgtggcccgtgagaaggaggtctgrgtgcggaaactccaggccaggtgggtccgggggaggccggtcgcgcccaggaaatgccctatacgcgcaggccggaccatgggaaccccaaagccacgga

SEQ ID NO: 11995 - DNA, 201 bp, Homo sapiens; identical to SEQ ID NO: 11987

SEQ ID NO: 11996 - DNA, 177 bp, Homo sapiens
cacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgct

SEQ ID NO: 11997 - DNA, 201 bp, Homo sapiens; identical to SEQ ID NO: 11989

SEQ ID NO: 11998 - DNA, 201 bp, Homo sapiens; identical to SEQ ID NO: 11990

SEQ ID NO: 11999 - DNA, 182 bp, Homo sapiens; identical to SEQ ID NO: 11991

SEQ ID NO: 12000 - DNA, 201 bp, Homo sapiens; identical to SEQ ID NO: 11992

SEQ ID NO: 12001 - DNA, 201 bp, Homo sapiens; identical to SEQ ID NO: 11993

SEQ ID NO: 12002 - DNA, 201 bp, Homo sapiens; identical to SEQ ID NO: 11994

SEQ ID NO: 12003 - DNA, 201 bp, Homo sapiens; identical to SEQ ID NO: 11987

SEQ ID NO: 12004 - DNA, 181 bp, Homo sapiens; identical to SEQ ID NO: 11988

SEQ ID NO: 12005 - DNA, 201 bp, Homo sapiens
gtcgatcaaaaagaaagccccagcgctctagagctcagctgacgggaaagggggtgcgcagcctcgagtttgagagctacccggagctccaagacaggggkgggttccagctgcccgcacgccccgaccttccatcgtaggccggaccatgggaaccccaaagccacggatcctgccctggctggtgtcgcagctggacct

SEQ ID NO: 12006 - DNA, 201 bp, Homo sapiens
aagggcataggggcgggaacagcccagcgggccgtcccatcggcttttgggtctgttacccaaagaatgataaagttggttttatttcaagaagtcgatcraaaagaaagccccagcgctctagagctcagctgacgggaaagggggtgcgcagcctcgagtttgagagctacccggagctccaagacaggggtgggttcc

SEQ ID NO: 12007 - DNA, 201 bp, Homo sapiens
tttatttcaagaagtcgatcaaaaagaaagccccagcgctctagagctcagctgacgggaaagggggtgcgcagcctcgagtttgagagctacccggagcyccaagacaggggtgggttccagctgcccgcacgccccgaccttccatcgtaggccggaccatgggaaccccaaagccacggatcctgccctggctggtgt

SEQ ID NO: 12008 - DNA, 201 bp, Homo sapiens; identical to SEQ ID NO: 11993

SEQ ID NO: 12009 - DNA, 201 bp, Homo sapiens
tttttgggtttccggccagaggcatgctgggagcgtcacatgcaaattgagcgtgcacccagcgttccgccctttctacgctgggccggttatcgacccgkcccagtgcgcaggcgcgggaaagttgaactaataaagtttgtacgagttcagtggaggagaccgcaagttgagtggaggaggcggcggtggggccccgga

SEQ ID NO: 12010 - DNA, 201 bp, Homo sapiens
tgaagagctggggctccgggaagacacgctgagggtcctagctgccttccttaggcgtggtgaggctgccgggtctcctgttccaactccacctagaagcyctgcccaagaagagccaacagacttcctgagccgccttcgaagatgtcttccctgctcctcagcgtggagcacgtgcacagcttcacgccctggatccag

SEQ ID NO: 12011 - DNA, 201 bp, Homo sapiens
tgctccactttccccagagtacacagcctgcctttccactctccgtgcagacccatcctctttcccgctcctcgctctcggacgccaccaacgctctcccrggctcttccgcgttacctacgatggaaggtcggggcgtgcgggcagctggaacccacccctgtcttggagctccgggtagctctcaaactcgaggctgcg

SEQ ID NO: 12012 - DNA, 201 bp, Homo sapiens
cctctttcccgctcctcgctctcggacgccaccaacgctctcccgggctcttccgcgttacctacgatggaaggtcggggcgtgcgggcagctggaacccmcccctgtcttggagctccgggtagctctcaaactcgaggctgcgcaccccctttcccgtcagctgagctctagagcgctggggctttctttttgatcgac

SEQ ID NO: 12013 - DNA, 201 bp, Homo sapiens
ggaacccacccctgtcttggagctccgggtagctctcaaactcgaggctgcgcaccccctttcccgtcagctgagctctagagcgctggggctttcttttygatcgacttcttgaaataaaaccaactttatcattctttgggtaacagacccaaaagccgatgggacggcccgctgggctgttcccgcccctatgccctt

SEQ ID NO: 12014 - DNA, 201 bp, Homo sapiens
cctcgctctcggacgccaccaacgctctcccgggctcttccgcgttacctacgatggaaggtcggggcgtgcgggcagctggaacccacccctgtcttggrgctccgggtagctctcaaactcgaggctgcgcaccccctttcccgtcagctgagctctagagcgctggggctttctttttgatcgacttcttgaaataaa

SEQ ID NO: 12015 - DNA, 201 bp, Homo sapiens; identical to SEQ ID NO: 12009

SEQ ID NO: 12016 - DNA, 201 bp, Homo sapiens
tgaagagctggggctccgggaagacacgctgagggtcctagctgccttccttaggcgtggtgaggctgccgggtctcctgttccaactccacctagaagcyctgcccaagaagagccaacagacttcctgagccgccttcgaagatgtcttccctgctccctgggcgtggagcacgtgcacagcttcacgccctggatcca

SEQ ID NO: 12017 - DNA, 201 bp, Homo sapiens; identical to SEQ ID NO: 12011

SEQ ID NO: 12018 - DNA, 201 bp, Homo sapiens; identical to SEQ ID NO: 12012

SEQ ID NO: 12019 - DNA, 201 bp, Homo sapiens; identical to SEQ ID NO: 12013

SEQ ID NO: 12020 - DNA, 201 bp, Homo sapiens; identical to SEQ ID NO: 12014

SEQ ID NO: 12021 - DNA, 102 bp, Homo sapiens
agtcttcctattccactcagggctgtggggtggtggttgccctacctgtttttgccaaaaataaattgtttaaaacttttcttattaaaaacgttacaaart

SEQ ID NO: 12022 - DNA, 201 bp, Homo sapiens; identical to SEQ ID NO: 12009

SEQ ID NO: 12023 - DNA, 201 bp, Homo sapiens; identical to SEQ ID NO: 12011

SEQ ID NO: 12024 - DNA, 201 bp, Homo sapiens; identical to SEQ ID NO: 12012

SEQ ID NO: 12025 - DNA, 201 bp, Homo sapiens; identical to SEQ ID NO: 12013

SEQ ID NO: 12026 - DNA, 201 bp, Homo sapiens; identical to SEQ ID NO: 12014

SEQ ID NO: 12027 - DNA, 102 bp, Homo sapiens; identical to SEQ ID NO: 12021

SEQ ID NO: 12028 - DNA, 201 bp, Homo sapiens; identical to SEQ ID NO: 12009

SEQ ID NO: 12029 - DNA, 201 bp, Homo sapiens
tgaagagctggggctccgggaagacacgctgagggtcctagctgccttccttaggcgtggtgaggctgccgggtctcctgttccaactccacctagaagcyctgcccaagaagagccaacagacttcctgagccgccttcgaagatgtcttccctgctccctggggcgaggagcagccccctctgagtcccctcggccttg

SEQ ID NO: 12030 - DNA, 201 bp, Homo sapiens; identical to SEQ ID NO: 12011

SEQ ID NO: 12031 - DNA, 201 bp, Homo sapiens; identical to SEQ ID NO: 12012

SEQ ID NO: 12032 - DNA, 201 bp, Homo sapiens; identical to SEQ ID NO: 12013

SEQ ID NO: 12033 - DNA, 201 bp, Homo sapiens; identical to SEQ ID NO: 12014

SEQ ID NO: 12034 - DNA, 102 bp, Homo sapiens; identical to SEQ ID NO: 12021

SEQ ID NO: 12035 - DNA, 201 bp, Homo sapiens
gaggagacgggacacatctagggagggggcgagcctggaggacagtcgcacagggaggggcagaactcccgagccagggagggggtgcacagtcacctggmgggacagaggctggcggagggacgggaacccaggcggggcgagccgcgggagagtggagggcaggcgcctgggctgggggcggggaccaggcggggcagg

SEQ ID NO: 12036 - DNA, 201 bp, Homo sapiens
cctgagccggaatcgcagcgtgagcaggtggagccgcggtgggagcccgccgggtcgagctgagtaaggcggcgggctcggcgggggccatggagctgctmaagctgaaccggagcgtgcagggaaccggacccgggccgggggcttccctgtgccgcccgggggcgcctctcctcaacagcagcagtgtgggcaacctca

SEQ ID NO: 12037 - DNA, 201 bp, Homo sapiens
ctgattgttttagagactatggagcctggcacaggactgactctgggatgctcctagtttgacctcacagtgacccttcccaatcagcactgaaaataccrtcaggcctaatctcatacctctgaccaacaggctgttctgcactgaaaaggttcttcatccctttccagttaaggaccgtggccctgccctctccttcct

SEQ ID NO: 12038 - DNA, 201 bp, Homo sapiens
cttcctcctctcactggcagtcagcgacctcctgctggctgtggcttgcatgcccttcaccctcctgcccaatctcatgggcacattcatctttggcaccrtcatctgcaaggcggtttcctacctcatgggggtgtctgtgagtgtgtccacgctaagcctcgtggccatcgcactggagcggtacagcgccatctgccg

SEQ ID NO: 12039 - DNA, 201 bp, Homo sapiens
tgcctctcacacacatagattaatggcactgattgttttagagactatggagcctggcacaggactgactctgggatgctcctagtttgacctcacagtgmcccttcccaatcagcactgaaaataccatcaggcctaatctcatacctctgaccaacaggctgttctgcactgaaaaggttcttcatccctttccagtta

SEQ ID NO: 12040 - DNA, 201 bp, Homo sapiens
tgattgtagccacgtggctgctgtccggactactcatggtgccctaccccgtgtacactgtcgtgcaaccagtggggcctcgtgtgctgcagtgcgtgcaycgctggcccagtgcgcgggtccgccagacctggtccgtactgctgcttctgctcttgttcttcatcccgggtgtggttatggccgtggcctacgggctta

SEQ ID NO: 12041 - DNA, 201 bp, Homo sapiens
gctaaagctgaaccggagcgtgcagggaaccggacccgggccgggggcttccctgtgccgcccgggggcgcctctcctcaacagcagcagtgtgggcaacytcagctgcgagccccctcgcattcgcggagccgggacacgagaattggagctggccattagaatcactctttacgcagtgatcttcctgatgagcgttgg

SEQ ID NO: 12042 - DNA, 201 bp, Homo sapiens
gccggcctgagactggcgcggttggcgaagacagcgatggctgctacgtgcaacttccacgttcccggcctgccctggagctgacggcgctgacggctccwgggccgggatccggctcccggcccacccaggccaagctgctggctaagaagcgcgtggtgcgaatgttgctggtgatcgttgtgcttttttttctgtgtt

SEQ ID NO: 12043 - DNA, 201 bp, Homo sapiens
gcacagggaggggcagaactcccgagccagggagggggtgcacagtcacctggcgggacagaggctggcggagggacgggaacccaggcggggcgagccgmgggagagtggagggcaggcgcctgggctgggggcggggaccaggcggggcagggggcagggagaggagggcggcgggagcctgagccggaatcgcagcgt

SEQ ID NO: 12044 - DNA, 201 bp, Homo sapiens
gttggcgaagacagcgatggctgctacgtgcaacttccacgttcccggcctgccctggagctgacggcgctgacggctcctgggccgggatccggctcccrgcccacccaggccaagctgctggctaagaagcgcgtggtgcgaatgttgctggtgatcgttgtgcttttttttctgtgttggttgccagtttatagtgcc

SEQ ID NO: 12045 - DNA, 168 bp, Homo sapiens
caatcagcactgaaaataccatcaggcctaatctcatacctctgaccaacaggctgttctgcactgaaaaggttcttcatccctttccagttaaggaccgwggccctgccctctccttccttacccaaactgttcaagaaataataaattgtttggcttcctcctgaa

SEQ ID NO: 12046 - DNA, 201 bp, Homo sapiens
gatgaggaccctcccactccctccattgcttcgctgtccaggcttagctacaccaccatcagcacactgggccctggctgaggagtagaggggccgtgggkgttgaggcagggcaaatgacatgcactgacccttccagacatagaaaacacaaaccacaactgacacaggaaaccaacacccaaagcatggactaacccc

SEQ ID NO: 12047 - DNA, 201 bp, Homo sapiens
agctacaccaccatcagcacactgggccctggctgaggagtagaggggccgtgggggttgaggcagggcaaatgacatgcactgacccttccagacatagraaacacaaaccacaactgacacaggaaaccaacacccaaagcatggactaaccccaacgcacaggaaaaggtagcttacctgacacaagaggaataagaa

SEQ ID NO: 12048 - DNA, 201 bp, Homo sapiens
attcgcggagccgggacacgagaattggagctggccattagaatcactctttacgcagtgatcttcctgatgagcgttggaggaaatatgctcatcatcgkggtcctgggactgagccgccgcctgaggactgtcaccaatgccttcctcctctcactggcagtcagcgacctcctgctggctgtggcttgcatgcccttc

SEQ ID NO: 12049 - DNA, 201 bp, Homo sapiens
tagctacaccaccatcagcacactgggccctggctgaggagtagaggggccgtgggggttgaggcagggcaaatgacatgcactgacccttccagacatasaaaacacaaaccacaactgacacaggaaaccaacacccaaagcatggactaaccccaacgcacaggaaaaggtagcttacctgacacaagaggaataaga

SEQ ID NO: 12050 - DNA, 201 bp, Homo sapiens
cagtgacagcgacagccaaagcagggtccgaaaccaaggcgggctgccaggggctgttcaccagaacgggcgttgccggcctgagactggcgcggttggcraagacagcgatggctgctacgtgcaacttccacgttcccggcctgccctggagctgacggcgctgacggctcctgggccgggatccggctcccggcccac

SEQ ID NO: 12051 - DNA, 201 bp, Homo sapiens
gcgcctgggctgggggcggggaccaggcggggcagggggcagggagaggagggcggcgggagcctgagccggaatcgcagcgtgagcaggtggagccgcgktgggagcccgccgggtcgagctgagtaaggcggcgggctcggcgggggccatggagctgctaaagctgaaccggagcgtgcagggaaccggacccgggcc

SEQ ID NO: 12052 - DNA, 201 bp, Homo sapiens
ggcttcgctttgacggcgacagtgacagcgacagccaaagcagggtccgaaaccaaggcgggctgccaggtggggctggaccacgtgagcaaaatctgggmgaggcggagctttggagggcgacggggcctgctggagtgggtgggactgaaatgaaggtgagggtgagaaggaagctggaaatggagttgagctgggagc

SEQ ID NO: 12053 - DNA, 201 bp, Homo sapiens; identical to SEQ ID NO: 12036

SEQ ID NO: 12054 - DNA, 201 bp, Homo sapiens; identical to SEQ ID NO: 12037

SEQ ID NO: 12055 - DNA, 201 bp, Homo sapiens; identical to SEQ ID NO: 12038

SEQ ID NO: 12056 - DNA, 201 bp, Homo sapiens; identical to SEQ ID NO: 12039

SEQ ID NO: 12057 - DNA, 201 bp, Homo sapiens; identical to SEQ ID NO: 12040

SEQ ID NO: 12058 - DNA, 201 bp, Homo sapiens; identical to SEQ ID NO: 12041

SEQ ID NO: 12059 - DNA, 201 bp, Homo sapiens; identical to SEQ ID NO: 12042

SEQ ID NO: 12060 - DNA, 201 bp, Homo sapiens; identical to SEQ ID NO: 12044

SEQ ID NO: 12061 - DNA, 201 bp, Homo sapiens; identical to SEQ ID NO: 12043

SEQ ID NO: 12062 - DNA, 166 bp, Homo sapiens
caatcagcactgaaaataccatcaggcctaatctcatacctctgaccaacaggctgttctgcactgaaaaggttcttcatccctttccagttaaggaccgwggccctgccctctccttccttacccaaactgttcaagaaataataaattgtttggcttcctcctg

SEQ ID NO: 12063 - DNA, 201 bp, Homo sapiens; identical to SEQ ID NO: 12048

SEQ ID NO: 12064 - DNA, 201 bp, Homo sapiens; identical to SEQ ID NO: 12049

SEQ ID NO: 12065 - DNA, 201 bp, Homo sapiens; identical to SEQ ID NO: 12051

SEQ ID NO: 12066 - DNA, 201 bp, Homo sapiens; identical to SEQ ID NO: 12035

SEQ ID NO: 12067 - DNA, 201 bp, Homo sapiens; identical to SEQ ID NO: 12046

SEQ ID NO: 12068 - DNA, 201 bp, Homo sapiens; identical to SEQ ID NO: 12047

SEQ ID NO: 12069 - DNA, 201 bp, Homo sapiens
agactggggggactcgcctttttctctgaccgcccaccctttgtgctcaggggctgttcaccagaacgggcgttgccggcctgagactggcgcggttggcraagacagcgatggctgctacgtgcaacttccacgttcccggcctgccctggagctgacggcgctgacggctcctgggccgggatccggctcccggcccac

SEQ ID NO: 12070 - DNA, 201 bp, Homo sapiens
ttggtactaaaaaagattttgaggatttatacactcctgtgaatggatctatagtgattgtcagagcagggaaaatcacctttgcagaaaaggttgcaaaygctgaaagcttaaatgcaattggtgtgttgatatacatggaccagactaaatttcccattgttaacgcagaactttcattctttggacatgctcatctgg

SEQ ID NO: 12071 - DNA, 189 bp, Homo sapiens
cagtgcgcccatcgcgcggctcctcggggcacctgctgccttggcgccttttcccttggccttcgcctcgcccgcagcgccctccgcakagggccccgcccgctgcgcgcgcatccccgccccccgggcgatctgtcagagcacctcgcgagcgtacgtgcctcaggaagtgacgcacagcccccctgg

SEQ ID NO: 12072 - DNA, 186 bp, Homo sapiens
atgagttctgtcatgattcactattctagaacttgcatgacctttactgtgttagctctttgaatgttcttgaaattttagactttctttgtaaacaaatratatgtccttatcattgtataaaagctgttatgtgcaacagtgtggagattccttgtctgatttaataaaatacttaaacactga

SEQ ID NO: 12073 - DNA, 166 bp, Homo sapiens
cagtgcgcccatcgcgcggctcctcggggcacctgctgccttggcgccttttcccttggccttcgyctcgcccgcagcgccctccgcatagggccccgcccgctgcgcgcgcatccccgccccccgggcgatctgtcagagcacctcgcgagcgtacgtgcctcag

SEQ ID NO: 12074 - DNA, 201 bp, Homo sapiens
cggggcacctgctgccttggcgccttttcccttggccttcgcctcgcccgcagcgccctccgcatagggccccgcccgctgcgcgcgcatccccgcccccsgggcgatctgtcagagcacctcgcgagcgtacgtgcctcaggaagtgacgcacagcccccctgggggccgggggcggggccaggctataaaccgccggtt

SEQ ID NO: 12075 - DNA, 201 bp, Homo sapiens
  misc_feature (1)...(201): n = A,T,C or G, or insertion/deletion polymorphism (see Tables 1-2)
gagggaggagccaggagaggacttccctgcagcacgtcgcttatattgggatgacctgaagagaaagttgtcggagaaactggacagcacagacttcaccngcaccatcaagctgctgaatgaaaattcatatgtccctcgtgaggctggatctcaaaaagatgaaaatcttgcgttgtatgttgaaaatcaatttcgtga

SEQ ID NO: 12076 - DNA, 201 bp, Homo sapiens
ctagtgacaagctcctggtcttgagatgtcttctcgttaaggagatgggccttttggaggtaaaggataaaatgaatgagttctgtcatgattcactattytagaacttgcatgacctttactgtgttagctctttgaatgttcttgaaattttagactttctttgtaaacaaatgatatgtccttatcattgtataaaag

SEQ ID NO: 12077 - DNA, 201 bp, Homo sapiens
ctttgagtgatcctccaacttcatttgatgctaaataggagataccaggttgaaagaccttctccaaatgagatctaagcctttccataaggaatgtagcwggtttcctcattcctgaaagaaacagttaactttcagaagagatgggcttgttttcttgccaatgaggtctgaaatggaggtccttctgctggataaaat

SEQ ID NO: 12078 - DNA, 201 bp, Homo sapiens
gtcattaagcatgtaaaatgaaattactacaaaatttgaaatttagcttgggtttttgttacctttatggtttctccaggtcctctacttaatgagatagyagcatacatttataatgtttgctattgacaagtcattttaactttatcacattatttgcatgttacctcctataaacttagtgcggacaagttttaatcc

SEQ ID NO: 12079 - DNA, 201 bp, Homo sapiens
agaatataattatcggaagcagtgccttccataattatgacagttatactgtcggttttttttaaataaaagcagcatctgctaataaaacccaacagatmctggaagttttgcatttatggtcaacacttaagggttttagaaaacagccgtcagccaaatgtaattgaataaagttgaagctaagatttagagatgaat

SEQ ID NO: 12080 - DNA, 201 bp, Homo sapiens
attttcttcatgcaatgacatcttcaaagcttgaagatcgttagtatctaacatgtatcccaactcctataattccctatcttttagttttagttgcagamacattttgtggtcattaagcatgtaaaatgaaattactacaaaatttgaaatttagcttgggtttttgttacctttatggtttctccaggtcctctactt

SEQ ID NO: 12081 - DNA, 201 bp, Homo sapiens
gacaagtcattttaactttatcacattatttgcatgttacctcctataaacttagtgcggacaagttttaatccagaattgaccttttgacttaaagcagrgggactttgtatagaaggtttgggggctgtggggaaggagagtcccctgaaggtctgacacgtctgcctacccattcgtggtgatcaattaaatgtaggt

SEQ ID NO: 12082 - DNA, 201 bp, Homo sapiens
tttgggggctgtggggaaggagagtcccctgaaggtctgacacgtctgcctacccattcgtggtgatcaattaaatgtaggtatgaataagttcgaagctycgtgagtgaaccatcattataaacgtgatgatcagctgtttgtcatagggcagttggaaacggcctcctagggaaaagttcatagggtctcttcaggttc

SEQ ID NO: 12083 - DNA, 201 bp, Homo sapiens
caattaaatgtaggtatgaataagttcgaagctccgtgagtgaaccatcattataaacgtgatgatcagctgtttgtcatagggcagttggaaacggcctyctagggaaaagttcatagggtctcttcaggttcttagtgtcacttacctagatttacagcctcacttgaatgtgtcactactcacagtctctttaatctt

SEQ ID NO: 12084 - DNA, 201 bp, Homo sapiens
ctctggtgacgtttgggacattgacaatgagttttaaatgtgatacccatagcttccatgagaacagcagggtagtctggtttctagacttgtgctgatcrtgctaaattttcagtagggctacaaaacctgatgttaaaattccatcccatcatcttggtactactagatgtctttaggcagcagcttttaatacagggt

SEQ ID NO: 12085 - DNA, 201 bp, Homo sapiens
atgatcgtgtcatgagagtggagtatcacttcctctctccctacgtatctccaaaagagtctcctttccgacatgtcttctggggctccggctctcacacrctgccagctttactggagaacttgaaactgcgtaaacaaaataacggtgcttttaatgaaacgctgttcagaaaccagttggctctagctacttggacta

SEQ ID NO: 12086 - DNA, 201 bp, Homo sapiens
ttgcagaaaaggttgcaaatgctgaaagcttaaatgcaattggtgtgttgatatacatggaccagactaaatttcccattgttaacgcagaactttcattmtttggacatgctcatctggggacaggtgacccttacacacctggattcccttccttcaatcacactcagtttccaccatctcggtcatcaggattgccta

SEQ ID NO: 12087 - DNA, 201 bp, Homo sapiens
gacaatgagttttaaatgtgatacccatagcttccatgagaacagcagggtagtctggtttctagacttgtgctgatcgtgctaaattttcagtagggctrcaaaacctgatgttaaaattccatcccatcatcttggtactactagatgtctttaggcagcagcttttaatacagggtagataacctgtacttcaagtta

SEQ ID NO: 12088 - DNA, 201 bp, Homo sapiens; identical to SEQ ID NO: 12070

SEQ ID NO: 12089 - DNA, 201 bp, Homo sapiens; identical to SEQ ID NO: 12079

SEQ ID NO: 12090 - DNA, 201 bp, Homo sapiens
attttcttcatgcaatgacatcttcaaagcttgaagatcgttagtatctaacatgtatcccaactcctataattccctatcttttagttttagttgcagamacattttgtggtcattaagcattgggtgggtaaattcaaccactgtaaaatgaaattactacaaaatttgaaatttagcttgggtttttgttacctttat

SEQ ID NO: 12091 - DNA, 201 bp, Homo sapiens; identical to SEQ ID NO: 12081

SEQ ID NO: 12092 - DNA, 201 bp, Homo sapiens; identical to SEQ ID NO: 12082

SEQ ID NO: 12093 - DNA, 201 bp, Homo sapiens; identical to SEQ ID NO: 12083

SEQ ID NO: 12094 - DNA, 186 bp, Homo sapiens; identical to SEQ ID NO: 12072

SEQ ID NO: 12095 - DNA, 201 bp, Homo sapiens; identical to SEQ ID NO: 12084

SEQ ID NO: 12096 - DNA, 201 bp, Homo sapiens; identical to SEQ ID NO: 12085

SEQ ID NO: 12097 - DNA, 201 bp, Homo sapiens; identical to SEQ ID NO: 12075
  misc_feature (1)...(201): n = A,T,C or G, or insertion/deletion polymorphism (see Tables 1-2)

SEQ ID NO: 12098 - DNA, 201 bp, Homo sapiens; identical to SEQ ID NO: 12086

SEQ ID NO: 12099 - DNA, 201 bp, Homo sapiens; identical to SEQ ID NO: 12076

SEQ ID NO: 12100 - DNA, 201 bp, Homo sapiens; identical to SEQ ID NO: 12087

SEQ ID NO: 12101 - DNA, 201 bp, Homo sapiens
aattcaaccactgtaaaatgaaattactacaaaatttgaaatttagcttgggtttttgttacctttatggtttctccaggtcctctacttaatgagatagyagcatacatttataatgtttgctattgacaagtcattttaactttatcacattatttgcatgttacctcctataaacttagtgcggacaagttttaatcc

SEQ ID NO: 12102 - DNA, 201 bp, Homo sapiens; identical to SEQ ID NO: 12077

SEQ ID NO: 12103 - DNA, 201 bp, Homo sapiens; identical to SEQ ID NO: 12070

SEQ ID NO: 12104 - DNA, 189 bp, Homo sapiens; identical to SEQ ID NO: 12071

SEQ ID NO: 12105 - DNA, 186 bp, Homo sapiens; identical to SEQ ID NO: 12072

SEQ ID NO: 12106 - DNA, 166 bp, Homo sapiens; identical to SEQ ID NO: 12073

SEQ ID NO: 12107 - DNA, 201 bp, Homo sapiens; identical to SEQ ID NO: 12074

SEQ ID NO: 12108 - DNA, 201 bp, Homo sapiens; identical to SEQ ID NO: 12075
  misc_feature (1)...(201): n = A,T,C or G, or insertion/deletion polymorphism (see Tables 1-2)

SEQ ID NO: 12109 - DNA, 201 bp, Homo sapiens; identical to SEQ ID NO: 12076

SEQ ID NO: 12110 - DNA, 201 bp, Homo sapiens; identical to SEQ ID NO: 12077

SEQ ID NO: 12111 - DNA, 201 bp, Homo sapiens; identical to SEQ ID NO: 12101

SEQ ID NO: 12112 - DNA, 201 bp, Homo sapiens; identical to SEQ ID NO: 12079

SEQ ID NO: 12113 - DNA, 201 bp, Homo sapiens; identical to SEQ ID NO: 12090

SEQ ID NO: 12114 - DNA, 201 bp, Homo sapiens; identical to SEQ ID NO: 12081

SEQ ID NO: 12115 - DNA, 201 bp, Homo sapiens; identical to SEQ ID NO: 12082

SEQ ID NO: 12116 - DNA, 201 bp, Homo sapiens; identical to SEQ ID NO: 12083

SEQ ID NO: 12117 - DNA, 201 bp, Homo sapiens; identical to SEQ ID NO: 12084

SEQ ID NO: 12118 - DNA, 201 bp, Homo sapiens; identical to SEQ ID NO: 12085

SEQ ID NO: 12119 - DNA, 201 bp, Homo sapiens; identical to SEQ ID NO: 12086

SEQ ID NO: 12120 - DNA, 201 bp, Homo sapiens; identical to SEQ ID NO: 12087

SEQ ID NO: 12121 - DNA, 201 bp, Homo sapiens
ctggcaggatgccaggccaaggtggagcaagcggtggagacagagccggagcccgagctgcgccagcagaccgagtggcagagcggccagcgctgggaacyggcactgggtcgcttttgggattacctgcgctgggtgcagacactgtctgagcaggtgcaggaggagctgctcagctcccaggtcacccaggaactgagg

SEQ ID NO: 12122 - DNA, 201 bp, Homo sapiens
ggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcggccagagcaccgaggagctgcgggtgcgcctcgcctcccacctgcgcaagctgcg

SEQ ID NO: 12123 - DNA, 201 bp, Homo sapiens
catgctcggccagagcaccgaggagctgcgggtgcgcctcgcctcccacctgcgcaagctgcgtaagcggctcctccgcgatgccgatgacctgcagaagygcctggcagtgtaccaggccggggcccgcgagggcgccgagcgcggcctcagcgccatccgcgagcgcctggggcccctggtggaacagggccgcgtgcg

SEQ ID NO: 12124 - DNA, 201 bp, Homo sapiens
gcgcggccgcctggtgcagtaccgcggcgaggtgcaggccatgctcggccagagcaccgaggagctgcgggtgcgcctcgcctcccacctgcgcaagctgygtaagcggctcctccgcgatgccgatgacctgcagaagcgcctggcagtgtaccaggccggggcccgcgagggcgccgagcgcggcctcagcgccatccg

SEQ ID NO: 12125 - DNA, 201 bp, Homo sapiens
aagcaggctgatactacacagtatgtccccatgctagaaaggaaagaggtttctaaatattccgacatccagagatcactctatgatcgtccagcctcatrtaagaagaaatctatgttagactcagaagtcaaaaacctcctttcagatgataactcagaaggccttactttattggatttgttgagcttcacctatcaa

SEQ ID NO: 12126 - DNA, 201 bp, Homo sapiens
ccacggtgaaagacagtggagattacgaatgtgctgcccgccaggctaccagggaggtcaaagaaatgaagaaagtcactatttctgtccatgagaaaggkttcattgaaatcaaacccaccttcagccagttggaagctgtcaacctgcatgaagtcaaacattttgttgtagaggtgcgggcctacccacctcccagga

SEQ ID NO: 12127 - DNA, 201 bp, Homo sapiens
tattgagtggatgatatgcaaagatattaagaaatgtaataatgaaacttcctggactattttggccaacaatgtctcaaacatcatcacggagatccacycccgagacaggagtaccgtggagggccgtgtgactttcgccaaagtggaggagaccatcgccgtgcgatgcctggctaagaatctccttggagctgagaa

SEQ ID NO: 12128 - DNA, 201 bp, Homo sapiens
tctctgagatgctttggggagagtgaagtgagctggcagtaccccatgtctgaagaagagagctccgatgtggaaatcagaaatgaagaaaacaacagcgrcctttttgtgacggtcttggaagtgagcagtgcctcggcggcccacacagggttgtacacttgctattacaaccacactcagacagaagagaatgagctt

SEQ ID NO: 12129 - DNA, 201 bp, Homo sapiens
aaaatgaaaaggttgtgcagctgaattcatccttttctctgagatgctttggggagagtgaagtgagctggcagtaccccatgtctgaagaagagagctcygatgtggaaatcagaaatgaagaaaacaacagcggcctttttgtgacggtcttggaagtgagcagtgcctcggcggcccacacagggttgtacacttgct

SEQ ID NO: 12130 - DNA, 201 bp, Homo sapiens
gaaccctgctgatgaaagcacacggagctatgttattttatcttttgaaaacaatggtgactacatggacatgaagcaggctgatactacacagtatgtcyccatgctagaaaggaaagaggtttctaaatattccgacatccagagatcactctatgatcgtccagcctcatataagaagaaatctatgttagactcaga

SEQ ID NO: 12131 - DNA, 201 bp, Homo sapiens
ctttattggatttgttgagcttcacctatcaagttgcccgaggaatggagtttttggcttcaaaaaattgtgtccaccgtgatctggctgctcgcaacgtyctcctggcacaaggaaaaattgtgaagatctgtgactttggcctggccagagacatcatgcatgattcgaactatgtgtcgaaaggcagtacctttctgc

SEQ ID NO: 12132 - DNA, 201 bp, Homo sapiens
cctacgacagcagacagggctttaatgggaccttcactgtagggccctatatctgtgaggccaccgtcaaaggaaagaagttccagaccatcccatttaaygtttatgctttaaaagcaacatcagagctggatctagaaatggaagctcttaaaaccgtgtataagtcaggggaaacgattgtggtcacctgtgctgttt

SEQ ID NO: 12133 - DNA, 201 bp, Homo sapiens
taaaacaatccttactaagtaggtgatgagtttgacagtttttgacatttatattaaataacatgtttctctataaagtatggtaatagctttagtgaatyaaatttagttgagcatagagaacaaagtaaaagtagtgttgtccaggaagtcagaatttttaactgtactgaataggttccccaatccatcgtattaaaa

SEQ ID NO: 12134 - DNA, 201 bp, Homo sapiens
ggtgaactttgtgcttcaaggacattggtgagagtccaacagacacaatttatactgcgacagaacttcagcattgtaattatgtaaataactctaaccamggctgtgtttagattgtattaactatcttctttggacttctgaagagaccactcaatccatccatgtacttccctcttgaaacctgatgtcagctgctgt

SEQ ID NO: 12135 - DNA, 201 bp, Homo sapiens
tgttggtgattgtgatcatctcacttattgtcctggttgtcatttggaaacagaaaccgaggtatgaaattcgctggagggtcattgaatcaatcagcccrgatggacatgaatatatttatgtggacccgatgcagctgccttatgactcaagatgggagtttccaagagatggactagtgcttggtcgggtcttggggt

SEQ ID NO: 12136 - DNA, 201 bp, Homo sapiens
cctacccacctcccaggatatcctggctgaaaaacaatctgactctgattgaaaatctcactgagatcaccactgatgtggaaaagattcaggaaataagstatcgaagcaaattaaagctgatccgtgctaaggaagaagacagtggccattatactattgtagctcaaaatgaagatgctgtgaagagctatacttttg

SEQ ID NO: 12137 - DNA, 201 bp, Homo sapiens
attgtagctcaaaatgaagatgctgtgaagagctatacttttgaactgttaactcaagttccttcatccattctggacttggtcgatgatcaccatggctyaactgggggacagacggtgaggtgcacagctgaaggcacgccgcttcctgatattgagtggatgatatgcaaagatattaagaaatgtaataatgaaact

SEQ ID NO: 12138 - DNA, 201 bp, Homo sapiens
ctccctggctgttctgatcggccagttttcggaaacactgacttaggtttcaggaagttgccatgggaaacaaataatttgaactttggaacagggttggmattcaaccacgcaggaagcctactatttaaatccttggcttcaggttagtgacatttaatgccatctagctagcaattgcgaccttaatttaactttcca

SEQ ID NO: 12139 - DNA, 143 bp, Homo sapiens
cctacgacagcagacagggctttaatgggaccttcactgtagggccctatatctgtgaggccaccgtcaaaggaaagaagttccagaccatcccatttaaygtttatgctttaaaaggtacttgtatcatctccttccttctt

SEQ ID NO: 12140 - DNA, 201 bp, Homo sapiens; identical to SEQ ID NO: 12128

SEQ ID NO: 12141 - DNA, 201 bp, Homo sapiens; identical to SEQ ID NO: 12129

SEQ ID NO: 12142 - DNA, 201 bp, Homo sapiens
attaaatttctggatttgggttgtgacccagggtgcattaacttaaaagattcactaaagcagcacatagcactgggaactctggctccgaaaaactttgytatatatatcaaggatgttctggctttacattttatttattagctgtaaatacatgtgtggatgtgtaaatggagcttgtacatattggaaaggtcattg

SEQ ID NO: 12143 - DNA, 201 bp, Homo sapiens
ctgggtaggtgttgaaaatgagcctgtaatcctcagctgacacataatttgaatggtgcagaaaaaaaaaaagataccgtaattttattattagattctcyaaatgattttcatcaatttaaaatcattcaatatctgacagttactcttcagttttaggcttaccttggtcatgcttcagttgtacttccagtgcgtctc

SEQ ID NO: 12144 - DNA, 201 bp, Homo sapiens
ctgtgaaagtatgtgatatctgaacacatactagaaagctctgcatgtgtgttgtccttcagcataattcggaagggaaaacagtcgatcaagggatgtaytggaacatgtcggagtagaaattgttcctgatgtgccagaacttcgaccctttctctgagagagatgatcgtgcctataaatagtaggaccaatgttgtg

SEQ ID NO: 12145 - DNA, 201 bp, Homo sapiens
gcttgtacatattggaaaggtcattgtggctatctgcatttataaatgtgtggtgctaactgtatgtgtctttatcagtgatggtctcacagagccaactyactcttatgaaatgggctttaacaaaacaagaaagaaacgtacttaactgtgtgaagaaatggaatcagcttttaataaaattgacaacattttattacc

SEQ ID NO: 12146 - DNA, 201 bp, Homo sapiens
ttgtacatattggaaaggtcattgtggctatctgcatttataaatgtgtggtgctaactgtatgtgtctttatcagtgatggtctcacagagccaactcamtcttatgaaatgggctttaacaaaacaagaaagaaacgtacttaactgtgtgaagaaatggaatcagcttttaataaaattgacaacattttattaccac

SEQ ID NO: 12147 - DNA, 201 bp, Homo sapiens
ttacacagaggtagatattggagaactactcatgttgaagctcaaatggaagagtgattcatactttagctggtcagactggtggagcagtcccggcttcrccattcagaagatcagagtaaaagcaggagagactcagaaaaaggtgatcttctgttctagggagaaagtgtctcatttgcagaaaggaaaggcacctgc

SEQ ID NO: 12148 - DNA, 201 bp, Homo sapiens
  misc_feature (1)...(201): n = A,T,C or G, or insertion/deletion polymorphism (see Tables 1-2)
gagaaccagactccaatgtcattgtggtggactggctgtcacgggctcaggagcattacccagtgtccgcgggctacaccaaactggtgggacaggatgtngcccggtttatcaactggatggaggaggagtttaactaccctctggacaatgtccatctcttgggatacagccttggagcccatgctgctggcattgcag

SEQ ID NO: 12149 - DNA, 201 bp, Homo sapiens
aaacccataccaatcaggcctttgagatttctctgtatggcaccgtggccgagagtgagaacatcccattcactctgcctgaagtttccacaaataagacmtactccttcctaatttacacagaggtagatattggagaactactcatgttgaagctcaaatggaagagtgattcatactttagctggtcagactggtgga

SEQ ID NO: 12150 - DNA, 201 bp, Homo sapiens
aaagattcatttttctgggactgagagtgaaacccataccaatcaggcctttgagatttctctgtatggcaccgtggccgagagtgagaacatcccattcrctctgcctgaagtttccacaaataagacatactccttcctaatttacacagaggtagatattggagaactactcatgttgaagctcaaatggaagagtga

SEQ ID NO: 12151 - DNA, 201 bp, Homo sapiens
accaagtaaagattcatttttctgggactgagagtgaaacccataccaatcaggcctttgagatttctctgtatggcaccgtggccgagagtgagaacatyccattcactctgcctgaagtttccacaaataagacatactccttcctaatttacacagaggtagatattggagaactactcatgttgaagctcaaatgga

SEQ ID NO: 12152 - DNA, 201 bp, Homo sapiens
gagcaaagccctgctcgtgctgactctggccgtgtggctccagagtctgaccgcctcccgcggaggggtggccgccgccgaccaaagaagagattttatcracatcgaaagtaaatttgccctaaggacccctgaagacacagctgaggacacttgccacctcattcccggagtagcagagtccgtggctacctgtcattt

SEQ ID NO: 12153 - DNA, 201 bp, Homo sapiens
actggctgtcacgggctcaggagcattacccagtgtccgcgggctacaccaaactggtgggacaggatgtggcccggtttatcaactggatggaggaggartttaactaccctctggacaatgtccatctcttgggatacagccttggagcccatgctgctggcattgcaggaagtctgaccaataagaaagtcaacagaa

SEQ ID NO: 12154 - DNA, 201 bp, Homo sapiens
ggagaagctatccgcgtgattgcagagagaggacttggagatgtggaccagctagtgaagtgctcccacgagcgctccattcatctcttcatcgactctckgttgaatgaagaaaatccaagtaaggcctacaggtgcagttccaaggaagcctttgagaaagggctctgcttgagttgtagaaagaaccgctgcaacaat

SEQ ID NO: 12155 - DNA, 201 bp, Homo sapiens
gccctacaaagtcttccattaccaagtaaagattcatttttctgggactgagagtgaaacccataccaatcaggcctttgagatttctctgtatggcaccrtggccgagagtgagaacatcccattcactctgcctgaagtttccacaaataagacatactccttcctaatttacacagaggtagatattggagaactact

SEQ ID NO: 12156 - DNA, 201 bp, Homo sapiens
gagaggacttggagatgtggaccagctagtgaagtgctcccacgagcgctccattcatctcttcatcgactctctgttgaatgaagaaaatccaagtaagrcctacaggtgcagttccaaggaagcctttgagaaagggctctgcttgagttgtagaaagaaccgctgcaacaatctgggctatgagatcaataaagtcag

SEQ ID NO: 12157 - DNA, 201 bp, Homo sapiens
ccaagtaaggcctacaggtgcagttccaaggaagcctttgagaaagggctctgcttgagttgtagaaagaaccgctgcaacaatctgggctatgagatcartaaagtcagagccaaaagaagcagcaaaatgtacctgaagactcgttctcagatgccctacaaagtcttccattaccaagtaaagattcatttttctggg

SEQ ID NO: 12158 - DNA, 201 bp, Homo sapiens
tgtttttaacaactaatcaagagtgagtgaacaactatttataaactagatctcctatttttcagaatgctcttctacgtataaatatgaaatgataaagrtgtcaaatatctcagaggctatagctgggaacccgactgtgaaagtatgtgatatctgaacacatactagaaagctctgcatgtgtgttgtccttcagca

SEQ ID NO: 12159 - DNA, 201 bp, Homo sapiens
aaggtgatcttctgttctagggagaaagtgtctcatttgcagaaaggaaaggcacctgcggtatttgtgaaatgccatgacaagtctctgaataagaagtsaggctgaaactgggcaaatctacagaacaaagaacggcatgtgaattctgtgaagaatgaagtggaggaagtaacttttacaaaacatacccagtgtttg

SEQ ID NO: 12160 - DNA, 201 bp, Homo sapiens
ctagggagaaagtgtctcatttgcagaaaggaaaggcacctgcggtatttgtgaaatgccatgacaagtctctgaataagaagtcaggctgaaactgggcraatctacagaacaaagaacggcatgtgaattctgtgaagaatgaagtggaggaagtaacttttacaaaacatacccagtgtttggggtgtttcaaaagtg

SEQ ID NO: 12161 - DNA, 201 bp, Homo sapiens
tgagccgtggaggggaaattgagggctttcgccttagcgcccactgctcctgtgacagcagggataacacactgcaagtggacatcaacgggttcactacmggccgccgaggtgacctggccaccattcatggcatgaaccggcctttcctgcttctcatggccaccccgctggagagggcccagcatctgcaaagctccc

SEQ ID NO: 12162 - DNA, 201 bp, Homo sapiens
tcgaggccctcctaccttttgccgggagacccccagcccctgcaggggcggggcctccccaccacaccagccctgttcgcgctctcggcagtgccgggggrcgccgcctcccccatgccgccctccgggctgcggctgctgctgctgctgctaccgctgctgtggctactggtgctgacgcctggccggccggccgcggga

SEQ ID NO: 12163 - DNA, 201 bp, Homo sapiens
caagttcaagcagagtacacacagcatatatatgttcttcaacacatcagagctccgagaagcggtacctgaacccgtgttgctctcccgggcagagctgygtctgctgaggctcaagttaaaagtggagcagcacgtggagctgtaccagaaatacagcaacaattcctggcgatacctcagcaaccggctgctggcacc

SEQ ID NO: 12164 - DNA, 201 bp, Homo sapiens
gcagtgccggggggcgccgcctcccccatgccgccctccgggctgcggctgctgctgctgctgctaccgctgctgtggctactggtgctgacgcctggccsgccggccgcgggactatccacctgcaagactatcgacatggagctggtgaagcggaagcgcatcgaggccatccgcggccagatcctgtccaagctgcgg

SEQ ID NO: 12165 - DNA, 201 bp, Homo sapiens
ggccatccgcggccagatcctgtccaagctgcggctcgccagccccccgagccagggggaggtgccgcccggcccgctgcccgaggccgtgctcgccctgyacaacagcacccgcgaccgggtggccggggagagtgcagaaccggagcccgagcctgaggccgactactacgccaaggaggtcacccgcgtgctaatggt

SEQ ID NO: 12166 - DNA, 201 bp, Homo sapiens
cggctgctggcacccagcgactcgccagagtggttatcttttgatgtcaccggagttgtgcggcagtggttgagccgtggaggggaaattgagggctttcrccttagcgcccactgctcctgtgacagcagggataacacactgcaagtggacatcaacgggttcactaccggccgccgaggtgacctggccaccattcat

SEQ ID NO: 12167 - DNA, 201 bp, Homo sapiens
caggggcggggcctccccaccacaccagccctgttcgcgctctcggcagtgccggggggcgccgcctcccccatgccgccctccgggctgcggctgctgcygctgctgctaccgctgctgtggctactggtgctgacgcctggccggccggccgcgggactatccacctgcaagactatcgacatggagctggtgaagcgg

SEQ ID NO: 12168 - DNA, 201 bp, Homo sapiens
aacacactgcaagtggacatcaacgggttcactaccggccgccgaggtgacctggccaccattcatggcatgaaccggcctttcctgcttctcatggccaycccgctggagagggcccagcatctgcaaagctcccggcaccgccgagccctggacaccaactattgcttcagctccacggagaagaactgctgcgtgcgg

SEQ ID NO: 12169 - DNA, 201 bp, Homo sapiens
ccggctgctggcacccagcgactcgccagagtggttatcttttgatgtcaccggagttgtgcggcagtggttgagccgtggaggggaaattgagggctttygccttagcgcccactgctcctgtgacagcagggataacacactgcaagtggacatcaacgggttcactaccggccgccgaggtgacctggccaccattca

SEQ ID NO: 12170 - DNA, 201 bp, Homo sapiens; identical to SEQ ID NO: 12161

SEQ ID NO: 12171 - DNA, 201 bp, Homo sapiens; identical to SEQ ID NO: 12162

SEQ ID NO: 12172 - DNA, 201 bp, Homo sapiens; identical to SEQ ID NO: 12163

SEQ ID NO: 12173 - DNA, 201 bp, Homo sapiens; identical to SEQ ID NO: 12164

SEQ ID NO: 12174 - DNA, 201 bp, Homo sapiens; identical to SEQ ID NO: 12165

SEQ ID NO: 12175 - DNA, 201 bp, Homo sapiens; identical to SEQ ID NO: 12166

SEQ ID NO: 12176 - DNA, 201 bp, Homo sapiens; identical to SEQ ID NO: 12167

SEQ ID NO: 12177 - DNA, 201 bp, Homo sapiens; identical to SEQ ID NO: 12168

SEQ ID NO: 12178 - DNA, 201 bp, Homo sapiens; identical to SEQ ID NO: 12169

SEQ ID NO: 12179 - DNA, 201 bp, Homo sapiens
gcagtgccggggggcgccgcctcccccatgccgccctccgggctgcggctgctgccgctgctgctaccgctgctgtggctactggtgctgacgcctggccsgccggccgcgggactatccacctgcaagactatcgacatggagctggtgaagcggaagcgcatcgaggccatccgcggccagatcctgtccaagctgcgg

SEQ ID NO: 12180 - DNA, 201 bp, Homo sapiens
caagttcaagcagagtacacacagcatatatatgttcttcaacacatcagagctccgagaagcggtacctgaacccgtgttgctctcccgggcagagctgygtctgctgaggaggctcaagttaaaagtggagcagcacgtggagctgtaccagaaatacagcaacaattcctggcgatacctcagcaaccggctgctggc

SEQ ID NO: 12181 - DNA, 201 bp, Homo sapiens; identical to SEQ ID NO: 12165

SEQ ID NO: 12182 - DNA, 201 bp, Homo sapiens
caggggcggggcctccccaccacaccagccctgttcgcgctctcggcagtgccggggggcgccgcctcccccatgccgccctccgggctgcggctgctgcygctgctgctaccgctgctgtggctactggtgctgacgcctggcccgccggccgcgggactatccacctgcaagactatcgacatggagctggtgaagcgg

SEQ ID NO: 12183 - DNA, 201 bp, Homo sapiens
tcgaggccctcctaccttttgccgggagacccccagcccctgcaggggcggggcctccccaccacaccagccctgttcgcgctctcggcagtgccgggggrcgccgcctcccccatgccgccctccgggctgcggctgctgccgctgctgctaccgctgctgtggctactggtgctgacgcctggcccgccggccgcggga

SEQ ID NO: 12184 - DNA, 201 bp, Homo sapiens; identical to SEQ ID NO: 12161

SEQ ID NO: 12185 - DNA, 201 bp, Homo sapiens; identical to SEQ ID NO: 12168

SEQ ID NO: 12186 - DNA, 201 bp, Homo sapiens; identical to SEQ ID NO: 12169

SEQ ID NO: 12187 - DNA, 201 bp, Homo sapiens; identical to SEQ ID NO: 12166

SEQ ID NO: 12188 - DNA, 201 bp, Homo sapiens
ctctgcgccggagtggctgcagctcacccctcagctccccttggggcccagctgggagccgagatagaagctcctgtcgccgctgggcttctcgcctcccrcagagggccacacagagaccgggatggccacctccatgggcctgctgctgctgctgctgctgctcctgacccagcccggggcggggacgggagctgacac

SEQ ID NO: 12189 - DNA, 201 bp, Homo sapiens
cctgacggcgaggatgagcaagttctggattgggctccagcgagagaagggcaagtgcctggaccctagtctgccgctgaagggcttcagctgggtgggcrggggggaggacacgccttactctaactggcacaaggagctccggaactcgtgcatctccaagcgctgtgtgtctctgctgctggacctgtcccagccgct

SEQ ID NO: 12190 - DNA, 201 bp, Homo sapiens
gttctttgcatagatttggcttaagcttgaattagatccctgcaaaggcttgctctgtgatgtcagatgtaattgtaaatgtcagtaatcacttcatgaaygctaaatgagaatgtaagtatttttaaatgtgtgtatttcaaatttgtttgactaattctggaattacaagatttctatgcaggatttaccttcatcctg

SEQ ID NO: 12191 - DNA, 201 bp, Homo sapiens
ccccagtgggtcctcaggcgtctggagggagcccagcatccatcacgccacagctgcctctggcccccaggagcctgcaggtggggactcctccgtggccrcacaaaacaacgatggcactgacgggcaaaagctgcttttattctacatcctaggcaccgtggtggccatcctactcctgctggccctggctctggggct

SEQ ID NO: 12192 - DNA, 201 bp, Homo sapiens
ctcaggcgtctggagggagcccagcatccatcacgccacagctgcctctggcccccaggagcctgcaggtggggactcctccgtggccacacaaaacaacratggcactgacgggcaaaagctgcttttattctacatcctaggcaccgtggtggccatcctactcctgctggccctggctctggggctactggtctatcg

SEQ ID NO: 12193 - DNA, 201 bp, Homo sapiens
tgggttccagagcgagctgagagcagggccatggagaaccagtacagtccgacacctgggacagactgctgaaagtgaggtggccctagagacactagagwcaccagccaccatcctcagagctttgaactccccattccaaaggggcacccacatttttttgaaagactggactggaatcttagcaaacaattgtaagtc

SEQ ID NO: 12194 - DNA, 201 bp, Homo sapiens
gggcacccccaaggctacacccaccacaagtagaccttcgctgtcatctgacgcccccatcacatctgccccactcaagatgctggcccccagtgggtccycaggcgtctggagggagcccagcatccatcacgccacagctgcctctggcccccaggagcctgcaggtggggactcctccgtggccacacaaaacaacga

SEQ ID NO: 12195 - DNA, 201 bp, Homo sapiens
gcgtgccacggtggggatttcgtgactctataatgattgttactccccctcccttttcaaattccaatgtgaccaattccggatcagggtgtgaggaggcyggggctaaggggctcccctgaatatcttctctgctcacttccaccatctaagaggaaaaggtgagttgctcatgctgattaggattgaaatgatttgttt

SEQ ID NO: 12196 - DNA, 201 bp, Homo sapiens
atggggtctcttgcaccatggggcctgtgtctctgggaccaccatctgggccccccgatgaggaggacaaaggagagaaagaagggagcaccgtgccccgygctgcaacagccagtcccacaaggggccccgagggcacccccaaggctacacccaccacaagtagaccttcgctgtcatctgacgcccccatcacatctg

SEQ ID NO: 12197 - DNA, 201 bp, Homo sapiens
ctgggaggcctcatgtctcctgtgggctttttaccaccactgtgcaggagaacagacagaggaaatgtgtctccctccaaggccccaaagcctcagagaargggtgtttctggttttgccttagcaatgcatcggtctctgaggtgacactctggagcggttgaagggccacaaggtgcagggttaatactcttgccagtt

SEQ ID NO: 12198 - DNA, 201 bp, Homo sapiens
agctccggaactcgtgcatctccaagcgctgtgtgtctctgctgctggacctgtcccagccgctccttcccagccgcctccccaagtggtctgagggcccstgtgggagcccaggctcccccggaagtaacattgagggcttcgtgtgcaagttcagcttcaaaggcatgtgccggcctctggccctggggggcccaggtc

SEQ ID NO: 12199 - DNA, 201 bp, Homo sapiens
agaggaaatgtgtctccctccaaggccccaaagcctcagagaaagggtgtttctggttttgccttagcaatgcatcggtctctgaggtgacactctggagyggttgaagggccacaaggtgcagggttaatactcttgccagttttgaaatatagatgctatggttcagattgtttttaatagaaaactaaaggggcaggg

SEQ ID NO: 12200 - DNA, 201 bp, Homo sapiens
tgaaggcagcaggagtcagagaactattcattgcaggaagccccaacatccggtgagaaataagaagtacaacagtacaggatgcgccttgggtcaggggracgtggaaagccctcagcctttgtgtccttctctgcgccggagtggctgcagctcacccctcagctccccttggggcccagctgggagccgagatagaag

SEQ ID NO: 12201 - DNA, 201 bp, Homo sapiens
atgcggcagacagttactcctgggttccagagcgagctgagagcagggccatggagaaccagtacagtccgacacctgggacagactgctgaaagtgaggkggccctagagacactagagtcaccagccaccatcctcagagctttgaactccccattccaaaggggcacccacatttttttgaaagactggactggaatc

SEQ ID NO: 12202 - DNA, 201 bp, Homo sapiens
tctgcggctgccgaccaggattccggctgctggatgacctggtgacctgtgcctctcgaaacccttgcagctccagcccatgtcgtgggggggccacgtgygtcctgggaccccatgggaaaaactacacgtgccgctgcccccaagggtaccagctggactcgagtcagctggactgtgtggacgtggatgaatgccagg

SEQ ID NO: 12203 - DNA, 201 bp, Homo sapiens; identical to SEQ ID NO: 12189

SEQ ID NO: 12204 - DNA, 201 bp, Homo sapiens; identical to SEQ ID NO: 12191

SEQ ID NO: 12205 - DNA, 201 bp, Homo sapiens; identical to SEQ ID NO: 12192

SEQ ID NO: 12206 - DNA, 201 bp, Homo sapiens; identical to SEQ ID NO: 12193

SEQ ID NO: 12207 - DNA, 201 bp, Homo sapiens; identical to SEQ ID NO: 12194

SEQ ID NO: 12208 - DNA, 201 bp, Homo sapiens; identical to SEQ ID NO: 12196

SEQ ID NO: 12209 - DNA, 201 bp, Homo sapiens; identical to SEQ ID NO: 12198

SEQ ID NO: 12210 - DNA, 201 bp, Homo sapiens; identical to SEQ ID NO: 12200

SEQ ID NO: 12211 - DNA, 201 bp, Homo sapiens; identical to SEQ ID NO: 12188

SEQ ID NO: 12212 - DNA, 201 bp, Homo sapiens; identical to SEQ ID NO: 12190

SEQ ID NO: 12213 - DNA, 171 bp, Homo sapiens
gggacaggcagatacagcccatttgatggtctcagtgactccacaccccacagggacttcccagacatgcygccatgcccacctctcagccacagggaccccacggagcccgtgtctgtttgctctaaacccaccagtgagaagtccccttgggaaacctgcttgggaaac

SEQ ID NO: 12214 - DNA, 201 bp, Homo sapiens; identical to SEQ ID NO: 12195

SEQ ID NO: 12215 - DNA, 201 bp, Homo sapiens; identical to SEQ ID NO: 12197

SEQ ID NO: 12216 - DNA, 201 bp, Homo sapiens; identical to SEQ ID NO: 12199

SEQ ID NO: 12217 - DNA, 201 bp, Homo sapiens; identical to SEQ ID NO: 12201

SEQ ID NO: 12218 - DNA, 201 bp, Homo sapiens; identical to SEQ ID NO: 12202

SEQ ID NO: 12219 - DNA, 201 bp, Homo sapiens
tggtctacactttcctgctgggcttcctgctgcccgtgctggccattggcctgtgctacctgctcatcgtgggcaagatgcgcgccgtggccctgcgcgckggctggcagcagcgcaggcgctcggagaagaaaatcaccaggctggtgctgatggtcgtggtcgtctttgtgctctgctggatgcctttctacgtggtgc

SEQ ID NO: 12220 - DNA, 201 bp, Homo sapiens
gtggtctacactttcctgctgggcttcctgctgcccgtgctggccattggcctgtgctacctgctcatcgtgggcaagatgcgcgccgtggccctgcgcgmtggctggcagcagcgcaggcgctcggagaagaaaatcaccaggctggtgctgatggtcgtggtcgtctttgtgctctgctggatgcctttctacgtggtg

SEQ ID NO: 12221 - DNA, 201 bp, Homo sapiens
cttgatgccaccgtcaaccacgtgtcccttatccttagctatgccaacagctgcgccaaccccattctctatggcttcctctccgacaacttccgccgatycttccagcgggttctctgcctgcgctgctgcctcctggaaggtgctggaggtgctgaggaggagcccctggactactatgccactgctctcaagagcaaa

SEQ ID NO: 12222 - DNA, 201 bp, Homo sapiens
tctacgtggtgcagctgctgaacctcttcgtgaccagccttgatgccaccgtcaaccacgtgtcccttatccttagctatgccaacagctgcgccaacccyattctctatggcttcctctccgacaacttccgccgattcttccagcgggttctctgcctgcgctgctgcctcctggaaggtgctggaggtgctgaggagg

SEQ ID NO: 12223 - DNA, 201 bp, Homo sapiens
tcgtctttgtgctctgctggatgcctttctacgtggtgcagctgctgaacctcttcgtgaccagccttgatgccaccgtcaaccacgtgtcccttatcctyagctatgccaacagctgcgccaaccccattctctatggcttcctctccgacaacttccgccgattcttccagcgggttctctgcctgcgctgctgcctcc

SEQ ID NO: 12224 - DNA, 201 bp, Homo sapiens
atccagtgcatctacgcgctggtgtgcctggtggggctggtgggcaacgccctggtcatcttcgtgatccttcgctacgccaagatgaagacggctaccamcatctacctgctcaacctggccgtagccgacgagctcttcatgctgagcgtgcccttcgtggcctcgtcggccgccctgcgccactggcccttcggctcc

SEQ ID NO: 12225 - DNA, 201 bp, Homo sapiens
caggcgctcggagaagaaaatcaccaggctggtgctgatggtcgtggtcgtctttgtgctctgctggatgcctttctacgtggtgcagctgctgaacctcktcgtgaccagccttgatgccaccgtcaaccacgtgtcccttatccttagctatgccaacagctgcgccaaccccattctctatggcttcctctccgacaa

SEQ ID NO: 12226 - DNA, 124 bp, Homo sapiens
atgcgcgccgtggccctgcgcgckggctggcagcagcgcaggcgctcggagaagaaaatcaccaggctgccttgatgccaccgtcaaccacgtgtcccttatccttagctatgccaacagctgc

SEQ ID NO: 12227 - DNA, 123 bp, Homo sapiens
atgcgcgccgtggccctgcgcgmtggctggcagcagcgcaggcgctcggagaagaaaatcaccaggctgccttgatgccaccgtcaaccacgtgtcccttatccttagctatgccaacagctg

SEQ ID NO: 12228 - DNA, 201 bp, Homo sapiens; identical to SEQ ID NO: 12221

SEQ ID NO: 12229 - DNA, 201 bp, Homo sapiens
gcagcgcaggcgctcggagaagaaaatcaccaggctgccttgatgccaccgtcaaccacgtgtcccttatccttagctatgccaacagctgcgccaacccyattctctatggcttcctctccgacaacttccgccgattcttccagcgggttctctgcctgcgctgctgcctcctggaaggtgctggaggtgctgaggagg

SEQ ID NO: 12230 - DNA, 201 bp, Homo sapiens
cgccgtggccctgcgcgctggctggcagcagcgcaggcgctcggagaagaaaatcaccaggctgccttgatgccaccgtcaaccacgtgtcccttatcctyagctatgccaacagctgcgccaaccccattctctatggcttcctctccgacaacttccgccgattcttccagcgggttctctgcctgcgctgctgcctcc

SEQ ID NO: 12231 - DNA, 201 bp, Homo sapiens; identical to SEQ ID NO: 12219

SEQ ID NO: 12232 - DNA, 201 bp, Homo sapiens; identical to SEQ ID NO: 12220

SEQ ID NO: 12233 - DNA, 201 bp, Homo sapiens; identical to SEQ ID NO: 12221

SEQ ID NO: 12234 - DNA, 201 bp, Homo sapiens; identical to SEQ ID NO: 12222

SEQ ID NO: 12235 - DNA, 201 bp, Homo sapiens; identical to SEQ ID NO: 12223

SEQ ID NO: 12236 - DNA, 201 bp, Homo sapiens; identical to SEQ ID NO: 12224

SEQ ID NO: 12237 - DNA, 201 bp, Homo sapiens; identical to SEQ ID NO: 12225

SEQ ID NO: 12238 - DNA, 201 bp, Homo sapiens
cttgatgccaccgtcaaccacgtgtcccttatcctcagctatgccaacagctgcgccaaccctattctctatggcttcctctccgacaacttccgccgatycttccagcgggttctctgcctgcgctgctgcctcctggaaggtgctggaggtgctgaggaggagcccctggactactatgccactgctctcaagagcaaa

SEQ ID NO: 12239 - DNA, 201 bp, Homo sapiens; identical to SEQ ID NO: 12224

SEQ ID NO: 12240 - DNA, 201 bp, Homo sapiens
tctacgtggtgcagctgctgaacctcgtcgtgaccagccttgatgccaccgtcaaccacgtgtcccttatcctcagctatgccaacagctgcgccaacccyattctctatggcttcctctccgacaacttccgccgatccttccagcgggttctctgcctgcgctgctgcctcctggaaggtgctggaggtgctgaggagg

SEQ ID NO: 12241 - DNA, 201 bp, Homo sapiens
tcgtctttgtgctctgctggatgcctttctacgtggtgcagctgctgaacctcgtcgtgaccagccttgatgccaccgtcaaccacgtgtcccttatcctyagctatgccaacagctgcgccaaccctattctctatggcttcctctccgacaacttccgccgatccttccagcgggttctctgcctgcgctgctgcctcc

SEQ ID NO: 12242 - DNA, 201 bp, Homo sapiens
caggcgctcggagaagaaaatcaccaggctggtgctgatggtcgtggtcgtctttgtgctctgctggatgcctttctacgtggtgcagctgctgaacctcktcgtgaccagccttgatgccaccgtcaaccacgtgtcccttatcctcagctatgccaacagctgcgccaaccctattctctatggcttcctctccgacaa

SEQ ID NO: 12243 - DNA, 201 bp, Homo sapiens; identical to SEQ ID NO: 12219

SEQ ID NO: 12244 - DNA, 201 bp, Homo sapiens; identical to SEQ ID NO: 12220

SEQ ID NO: 12245 - DNA, 201 bp, Homo sapiens
cctcttccctgggcctgtttctcgctgtccctgtcttttatccttctcatctgcctcttttttgctcaccctgtttctcactgccctcccctccgcctttytcacccctctgtccttttgagctcttttttgctctgtctcttcatttgccttttgcactctcaaactctttcatcttcccattcgctgtctgtatttctc

SEQ ID NO: 12246 - DNA, 201 bp, Homo sapiens
caccctgtttctcactgccctcccctccgcctttctcacccctctgtccttttgagctcttttttgctctgtctcttcatttgccttttgcactctcaaamtctttcatcttcccattcgctgtctgtatttctccataactatatctttcttcctctgtctccgcccacccacatttttctctttccctttctctctttg

SEQ ID NO: 12247 - DNA, 201 bp, Homo sapiens
acatgagcctcctggagaaccacacccgccaagcagacgaggactacagccacgacctcatgctgctccgcctgacagagcctgctgataccatcacagaygctgtgaaggtcgtggagttgcccaccgaggaacccgaagtggggagcacctgtttggcttccggctggggcagcatcgaaccagagaatttctcatttc

SEQ ID NO: 12248 - DNA, 201 bp, Homo sapiens
ctgtttggcttccggctggggcagcatcgaaccagagaatttctcatttccagatgatctccagtgtgtggacctcaaaatcctgcctaatgatgagtgcraaaaagcccacgtccagaaggtgacagacttcatgctgtgtgtcggacacctggaaggtggcaaagacacctgtgtgggtgattcagggggcccgctgat

SEQ ID NO: 12249 - DNA, 201 bp, Homo sapiens
agcatcgaaccagagaatttctcatttccagatgatctccagtgtgtggacctcaaaatcctgcctaatgatgagtgcaaaaaagcccacgtccagaaggwgacagacttcatgctgtgtgtcggacacctggaaggtggcaaagacacctgtgtgggtgattcagggggcccgctgatgtgtgatggtgtgctccaaggt

SEQ ID NO: 12250 - DNA, 201 bp, Homo sapiens
ccctcccccatgctcccctgccccatccccttttccccttcccgtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacc

SEQ ID NO: 12251 - DNA, 201 bp, Homo sapiens
ccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaatttctcatttccagatgatctccagtgtgtggacctcaa

SEQ ID NO: 12252 - DNA, 201 bp, Homo sapiens
ttcttcctctgtctccgcccacccacatttttctctttccctttctctctttggggaccctcccccatgctcccctgccccatccccttttccccttcccrtcttctcatccctccattcccatctttccccagcaattaccagctctggctgggtcgccacaacttgtttgacgacgaaaacacagcccagtttgttcat

SEQ ID NO: 12253 - DNA, 201 bp, Homo sapiens; identical to SEQ ID NO: 12249

SEQ ID NO: 12254 - DNA, 201 bp, Homo sapiens; identical to SEQ ID NO: 12251

SEQ ID NO: 12255 - DNA, 201 bp, Homo sapiens
catttcagcactttccagtgtgggggcatcctggtgcaccgccagtgggtgctcacagctgctcattgcatcagcgacaattaccagctctggctgggtcrccacaacttgtttgacgacgaaaacacagcccagtttgttcatgtcagtgagagcttcccacaccctggcttcaacatgagcctcctggagaaccacacc

SEQ ID NO: 12256 - DNA, 201 bp, Homo sapiens; identical to SEQ ID NO: 12247

SEQ ID NO: 12257 - DNA, 201 bp, Homo sapiens; identical to SEQ ID NO: 12248

SEQ ID NO: 12258 - DNA, 201 bp, Homo sapiens
tgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctgg

SEQ ID NO: 12259 - DNA, 201 bp, Homo sapiens
tgaatctcttaaaatcagtgcacaacggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggacca

SEQ ID NO: 12260 - DNA, 201 bp, Homo sapiens
acggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgt

SEQ ID NO: 12261 - DNA, 201 bp, Homo sapiens
gacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccg

SEQ ID NO: 12262 - DNA, 201 bp, Homo sapiens
agagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacc

SEQ ID NO: 12263 - DNA, 201 bp, Homo sapiens
agacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtccc

SEQ ID NO: 12264 - DNA, 201 bp, Homo sapiens
ccgcattgaagagggcgtcccgcagttcctggtcctcatctcgtctggaaagtctgacgatgaggtggacgacccggcggtggagctcaagcagtttggcrtggcccctttcacgatcgccaggaacgcagaccaggaggagctggtgaagatctcgctgagccccgaatatgtgttctcggtgagcaccttccgggagct

SEQ ID NO: 12265 - DNA, 201 bp, Homo sapiens
gaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattccctggatacc

SEQ ID NO: 12266 - DNA, 201 bp, Homo sapiens
tgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcgtggcccctttcacga

SEQ ID NO: 12267 - DNA, 201 bp, Homo sapiens
cagctgagttccgagccgccccattgcaaggcatgctgcctggcttgctggcacctctcaggaccctctctggaacccctgaagttcactcaaacaaaagrgatatcatctttcttttggatggatcagccaacgttggaaaaaccaatttcccttatgtgcgcgactttgtaatgaacctagttaacagccttgatattg

SEQ ID NO: 12268 - DNA, 201 bp, Homo sapiens
ctgaggaacatcctggtcagctctgcgggaagcaggataacagaaggtgtgccccagctgctgatcgtcctcacggccgacaggtctggggatgatgtgcrgaacccctccgtggtcgtgaagaggggtggggctgtgcccattggcattggcatcgggaacgctgacatcacagagatgcagaccatctccttcatcccg

SEQ ID NO: 12269 - DNA, 201 bp, Homo sapiens
ccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggcctgagccccccggtccttatttttatga

SEQ ID NO: 12270 - DNA, 201 bp, Homo sapiens
ggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctg

SEQ ID NO: 12271 - DNA, 201 bp, Homo sapiens
agaggcctgagccccccggtccttatttttatgacctcaccgtcacctcagcccatgatcagtccctggttctgaagcagaacctcacggtcacggaccgygtcattggaggcctgctcgctgggcagacataccatgtggctgtggtctgctacctgaggtctcaggtcagagccacctaccacggaagtttcagtacaa

SEQ ID NO: 12272 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaagttcactcaaacaaaagggatatcatctttcttttggatggatcagccaacgttggaaaaaccaatttcccttatgtg

SEQ ID NO: 12273 - DNA, 201 bp, Homo sapiens
agatgaaatcagccagcctgcccaggagctgaagagaagcagcataatggcctttgccattgggaacaagggtgccgatcaggctgagctggaagagatckctttcgactcctccctggtgttcatcccagctgagttccgagccgccccattgcaaggcatgctgcctggcttgctggcacctctcaggaccctctctgg

SEQ ID NO: 12274 - DNA, 201 bp, Homo sapiens
tgctgatcacaggtggtaagtccctagatgaaatcagccagcctgcccaggagctgaagagaagcagcataatggcctttgccattgggaacaagggtgcygatcaggctgagctggaagagatcgctttcgactcctccctggtgttcatcccagctgagttccgagccgccccattgcaaggcatgctgcctggcttgc

SEQ ID NO: 12275 - DNA, 201 bp, Homo sapiens
actgggagaggcctgagccccccggtccttatttttatgacctcaccgtcacctcagcccatgatcagtccctggttctgaagcagaacctcacggtcacrgaccgcgtcattggaggcctgctcgctgggcagacataccatgtggctgtggtctgctacctgaggtctcaggtcagagccacctaccacggaagtttca

SEQ ID NO: 12276 - DNA, 201 bp, Homo sapiens
ggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggt

SEQ ID NO: 12277 - DNA, 201 bp, Homo sapiens
cagaacctcacggtcacggaccgcgtcattggaggcctgctcgctgggcagacataccatgtggctgtggtctgctacctgaggtctcaggtcagagccayctaccacggaagtttcagtacaaagaaatctcagcccccacctccacagccagcaaggtcagcttctagttcaaccatcaatctaatggtgagcacagaa

SEQ ID NO: 12278 - DNA, 201 bp, Homo sapiens
cagccatctgtgaagccagccgctgcaaagccggcccctgcgaaacctgtggctgccaagcctgtggccacaaagacggccactgttagacccccagtggyggtgaagccagcaacggcagcgaagcctgtagcagcaaagccagcagctgtaagaccccccgctgctgctgctgcaaaaccagtggcgaccaagcctgag

SEQ ID NO: 12279 - DNA, 201 bp, Homo sapiens
ttaagcgtgtgaggaacggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgc

SEQ ID NO: 12280 - DNA, 201 bp, Homo sapiens
agtggacaagtccaccgagctcaacgaggagcctttgatgcgcttcgggaggctgttgccatccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttc

SEQ ID NO: 12281 - DNA, 201 bp, Homo sapiens
acaagattaagaaccttcaggtggctctgacatccaaacagcagagtctggagactgccatgtcgtttgtggccaggaacacatttaagcgtgtgaggaayggattcctaatgaggaaagtggctgttttcttcagcaacacacccacaagagcatccccacagctcagagaggctgtgctcaagctctcagatgcgggga

SEQ ID NO: 12282 - DNA, 201 bp, Homo sapiens
agcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcaacgaggagcctttgatgcgcttcgggaggctgt

SEQ ID NO: 12283 - DNA, 201 bp, Homo sapiens
atgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtg

SEQ ID NO: 12284 - DNA, 201 bp, Homo sapiens
acaccttcgccagtgagccaaacgacgtcttcttcaaattagtggacaagtccaccgagctcaacgaggagcctttgatgcgcttcgggaggctgttgccrtccttcgtcagcagtgaaaatgctttttacttgtccccagatatcaggaaacagtgtgattggttccaaggggaccaacccacaaagaaccttgtgaagt

SEQ ID NO: 12285 - DNA, 201 bp, Homo sapiens
gaggaatcgggaaccggggccctcgtggggagacgggagatgacgggagagacggagttggcagtgaaggacgcagaggcaaaaaaggagaaagaggattycctggatacccaggaccaaagggtaacccaggtgaacctgggctaaatggaacaacaggacccaaaggcatcagaggccgaaggggaaattcgggacctc

SEQ ID NO: 12286 - DNA, 201 bp, Homo sapiens
tcacggtcacggaccgcgtcattggaggcctgctcgctgggcagacataccatgtggctgtggtctgctacctgaggtctcaggtcagagccacctaccayggaagtttcagtacaaagaaatctcagcccccacctccacagccagcaaggtcagcttctagttcaaccatcaatctaatggtgagcacagaaccattgg

SEQ ID NO: 12287 - DNA, 201 bp, Homo sapiens
ggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtgga

SEQ ID NO: 12288 - DNA, 201 bp, Homo sapiens
  misc_feature (1)...(201): n = A,T,C or G, or insertion/deletion polymorphism (see Tables 1-2)
gccgctgcaaagccggcccctgcgaaacctgtggctgccaagcctgtggccacaaagacggccactgttagacccccagtggcggtgaagccagcaacggnagcgaagcctgtagcagcaaagccagcagctgtaagaccccccgctgctgctgctgcaaaaccagtggcgaccaagcctgaggtccctaggccacaggca

SEQ ID NO: 12289 - DNA, 201 bp, Homo sapiens
gagcggcagggagcgatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggaca

SEQ ID NO: 12290 - DNA, 201 bp, Homo sapiens
tgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggcccca

SEQ ID NO: 12291 - DNA, 201 bp, Homo sapiens
aaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttc

SEQ ID NO: 12292 - DNA, 201 bp, Homo sapiens
cagccgctgcaaagccggcccctgcgaaacctgtggctgccaagcctgtggccacaaagacggccactgttagacccccagtggcggtgaagccagcaacrgcagcgaagcctgtagcagcaaagccagcagctgtaagaccccccgctgctgctgctgcaaaaccagtggcgaccaagcctgaggtccctaggccacagg

SEQ ID NO: 12293 - DNA, 201 bp, Homo sapiens
cacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatc

SEQ ID NO: 12294 - DNA, 201 bp, Homo sapiens
cctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtc

SEQ ID NO: 12295 - DNA, 201 bp, Homo sapiens
tcccgcagttcctggtcctcatctcgtctggaaagtctgacgatgaggtggacgacccggcggtggagctcaagcagtttggcgtggcccctttcacgatygccaggaacgcagaccaggaggagctggtgaagatctcgctgagccccgaatatgtgttctcggtgagcaccttccgggagctgcccagcctggagcaga

SEQ ID NO: 12296 - DNA, 201 bp, Homo sapiens
tggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggag

SEQ ID NO: 12297 - DNA, 201 bp, Homo sapiens
acaccggggccgccctggagtttgtcctgaggaacatcctggtcagctctgcgggaagcaggataacagaaggtgtgccccagctgctgatcgtcctcacrgccgacaggtctggggatgatgtgcggaacccctccgtggtcgtgaagaggggtggggctgtgcccattggcattggcatcgggaacgctgacatcacag

SEQ ID NO: 12298 - DNA, 201 bp, Homo sapiens
tgccaccaagccagccaccactaagcccatggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacggaccgcgtcat

SEQ ID NO: 12299 - DNA, 201 bp, Homo sapiens
agatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggcttccctctgttgaaagagtttgtcc

SEQ ID NO: 12300 - DNA, 201 bp, Homo sapiens
ttggatggatcagccaacgttggaaaaaccaatttcccttatgtgcgcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcag

SEQ ID NO: 12301 - DNA, 201 bp, Homo sapiens
aaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggag

SEQ ID NO: 12302 - DNA, 201 bp, Homo sapiens
gatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcgg

SEQ ID NO: 12303 - DNA, 201 bp, Homo sapiens
gagatgacgggagagacggagttggcagtgaaggacgcagaggcaaaaaaggagaaagaggattccctggatacccaggaccaaagggtaacccaggtgarcctgggctaaatggaacaacaggacccaaaggcatcagaggccgaaggggaaattcgggacctccagggatagttggacagaagggagaccctggctacc

SEQ ID NO: 12304 - DNA, 201 bp, Homo sapiens
ttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttgtgtgtgctggagggaggggatttaattttaattttaaaatg

SEQ ID NO: 12305 - DNA, 201 bp, Homo sapiens
ctgggcattggcaggaaggtgaacatcaaggaggtatacaccttcgccagtgagccaaacgacgtcttcttcaaattagtggacaagtccaccgagctcamcgaggagcctttgatgcgcttcgggaggctgttgccatccttcgtcagcagtgaaaatgctttttacttgtccccagatatcaggaaacagtgtgattgg

SEQ ID NO: 12306 - DNA, 201 bp, Homo sapiens
ctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccgg

SEQ ID NO: 12307 - DNA, 201 bp, Homo sapiens
accctctctggaacccctgaagttcactcaaacaaaagggatatcatctttcttttggatggatcagccaacgttggaaaaaccaatttcccttatgtgcrcgactttgtaatgaacctagttaacagccttgatattggaaatgacaatattcgtgttggtttagtgcaatttagtgacactcctgtaacggagttctct

SEQ ID NO: 12308 - DNA, 201 bp, Homo sapiens
ctatgtgcaccgttgggaccaatgccttaattaaagaatttaaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgt

SEQ ID NO: 12309 - DNA, 201 bp, Homo sapiens
tcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcatacctggtcagac

SEQ ID NO: 12310 - DNA, 201 bp, Homo sapiens
tcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatg

SEQ ID NO: 12311 - DNA, 201 bp, Homo sapiens
ggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctgg

SEQ ID NO: 12312 - DNA, 201 bp, Homo sapiens
tggacaagattaagaaccttcaggtggctctgacatccaaacagcagagtctggagactgccatgtcgtttgtggccaggaacacatttaagcgtgtgagraacggattcctaatgaggaaagtggctgttttcttcagcaacacacccacaagagcatccccacagctcagagaggctgtgctcaagctctcagatgcgg

SEQ ID NO: 12313 - DNA, 201 bp, Homo sapiens
acacagtttatgaagatggcgactccatccaagtggggcttgtccagtacaactctgaccccactgacgaattcttcctgaaggacttctctaccaagagrcagattattgacgccatcaacaaagtggtctacaaagggggaagacacgccaacactaaggtgggccttgagcacctgcgggtaaaccactttgtgcctg

SEQ ID NO: 12314 - DNA, 201 bp, Homo sapiens
cagtttccaggaagtgcttcgttttgtgtctgaaatagtggacacagtttatgaagatggcgactccatccaagtggggcttgtccagtacaactctgacyccactgacgaattcttcctgaaggacttctctaccaagaggcagattattgacgccatcaacaaagtggtctacaaagggggaagacacgccaacactaa

SEQ ID NO: 12315 - DNA, 201 bp, Homo sapiens
acaaagcctgtgactattataaatcagccatctgtgaagccagccgctgcaaagccggcccctgcgaaacctgtggctgccaagcctgtggccacaaagayggccactgttagacccccagtggcggtgaagccagcaacggcagcgaagcctgtagcagcaaagccagcagctgtaagaccccccgctgctgctgctgca

SEQ ID NO: 12316 - DNA, 201 bp, Homo sapiens; identical to SEQ ID NO: 12258

SEQ ID NO: 12317 - DNA, 201 bp, Homo sapiens; identical to SEQ ID NO: 12259

SEQ ID NO: 12318 - DNA, 201 bp, Homo sapiens; identical to SEQ ID NO: 12262

SEQ ID NO: 12319 - DNA, 201 bp, Homo sapiens; identical to SEQ ID NO: 12264

SEQ ID NO: 12320 - DNA, 201 bp, Homo sapiens; identical to SEQ ID NO: 12265

SEQ ID NO: 12321 - DNA, 201 bp, Homo sapiens; identical to SEQ ID NO: 12266

SEQ ID NO: 12322 - DNA, 201 bp, Homo sapiens; identical to SEQ ID NO: 12268

SEQ ID NO: 12323 - DNA, 201 bp, Homo sapiens; identical to SEQ ID NO: 12267

SEQ ID NO: 12324 - DNA, 201 bp, Homo sapiens; identical to SEQ ID NO: 12269

SEQ ID NO: 12325 - DNA, 201 bp, Homo sapiens
ggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccttgctgttacgggcccctggagt

SEQ ID NO: 12326 - DNA, 201 bp, Homo sapiens; identical to SEQ ID NO: 12272

SEQ ID NO: 12327 - DNA, 201 bp, Homo sapiens; identical to SEQ ID NO: 12271

SEQ ID NO: 12328 - DNA, 201 bp, Homo sapiens; identical to SEQ ID NO: 12273

SEQ ID NO: 12329 - DNA, 201 bp, Homo sapiens; identical to SEQ ID NO: 12275

SEQ ID NO: 12330 - DNA, 201 bp, Homo sapiens; identical to SEQ ID NO: 12274

SEQ ID NO: 12331 - DNA, 201 bp, Homo sapiens; identical to SEQ ID NO: 12276

SEQ ID NO: 12332 - DNA, 201 bp, Homo sapiens; identical to SEQ ID NO: 12277

SEQ ID NO: 12333 - DNA, 201 bp, Homo sapiens; identical to SEQ ID NO: 12278

SEQ ID NO: 12334 - DNA, 201 bp, Homo sapiens; identical to SEQ ID NO: 12279

SEQ ID NO: 12335 - DNA, 201 bp, Homo sapiens; identical to SEQ ID NO: 12280

SEQ ID NO: 12336 - DNA, 201 bp, Homo sapiens; identical to SEQ ID NO: 12281

SEQ ID NO: 12337 - DNA, 201 bp, Homo sapiens; identical to SEQ ID NO: 12282

SEQ ID NO: 12338 - DNA, 201 bp, Homo sapiens; identical to SEQ ID NO: 12283

SEQ ID NO: 12339 - DNA, 201 bp, Homo sapiens; identical to SEQ ID NO: 12284

SEQ ID NO: 12340 - DNA, 201 bp, Homo sapiens; identical to SEQ ID NO: 12285

SEQ ID NO: 12341 - DNA, 201 bp, Homo sapiens; identical to SEQ ID NO: 12286

SEQ ID NO: 12342 - DNA, 201 bp, Homo sapiens; identical to SEQ ID NO: 12287

SEQ ID NO: 12343 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12344 - DNA, 201 bp, Homo sapiens; identical to SEQ ID NO: 12290

SEQ ID NO: 12345 - DNA, 201 bp, Homo sapiens; identical to SEQ ID NO: 12289

SEQ ID NO: 12346 - DNA, 201 bp, Homo sapiens; identical to SEQ ID NO: 12291

SEQ ID NO: 12347 - DNA, 201 bp, Homo sapiens; identical to SEQ ID NO: 12292

SEQ ID NO: 12348 - DNA, 201 bp, Homo sapiens; identical to SEQ ID NO: 12293

SEQ ID NO: 12349 - DNA, 201 bp, Homo sapiens; identical to SEQ ID NO: 12294

SEQ ID NO: 12350 - DNA, 201 bp, Homo sapiens; identical to SEQ ID NO: 12295

SEQ ID NO: 12351 - DNA, 201 bp, Homo sapiens; identical to SEQ ID NO: 12296

SEQ ID NO: 12352 - DNA, 201 bp, Homo sapiens; identical to SEQ ID NO: 12297

SEQ ID NO: 12353 - DNA, 201 bp, Homo sapiens; identical to SEQ ID NO: 12298

SEQ ID NO: 12354 - DNA, 201 bp, Homo sapiens; identical to SEQ ID NO: 12299

SEQ ID NO: 12355 - DNA, 201 bp, Homo sapiens; identical to SEQ ID NO: 12300

SEQ ID NO: 12356 - DNA, 201 bp, Homo sapiens; identical to SEQ ID NO: 12301

SEQ ID NO: 12357 - DNA, 201 bp, Homo sapiens; identical to SEQ ID NO: 12302

SEQ ID NO: 12358 - DNA, 201 bp, Homo sapiens
attcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaa

SEQ ID NO: 12359 - DNA, 201 bp, Homo sapiens; identical to SEQ ID NO: 12303

SEQ ID NO: 12360 - DNA, 201 bp, Homo sapiens; identical to SEQ ID NO: 12305

SEQ ID NO: 12361 - DNA, 201 bp, Homo sapiens; identical to SEQ ID NO: 12306

SEQ ID NO: 12362 - DNA, 201 bp, Homo sapiens
ttctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatt

SEQ ID NO: 12363 - DNA, 201 bp, Homo sapiens; identical to SEQ ID NO: 12307

SEQ ID NO: 12364 - DNA, 201 bp, Homo sapiens; identical to SEQ ID NO: 12309

SEQ ID NO: 12365 - DNA, 201 bp, Homo sapiens; identical to SEQ ID NO: 12310

SEQ ID NO: 12366 - DNA, 201 bp, Homo sapiens; identical to SEQ ID NO: 12312

SEQ ID NO: 12367 - DNA, 201 bp, Homo sapiens; identical to SEQ ID NO: 12311

SEQ ID NO: 12368 - DNA, 201 bp, Homo sapiens; identical to SEQ ID NO: 12313

SEQ ID NO: 12369 - DNA, 201 bp, Homo sapiens; identical to SEQ ID NO: 12314

SEQ ID NO: 12370 - DNA, 201 bp, Homo sapiens; identical to SEQ ID NO: 12315

SEQ ID NO: 12371 - DNA, 201 bp, Homo sapiens; identical to SEQ ID NO: 12258

SEQ ID NO: 12372 - DNA, 201 bp, Homo sapiens; identical to SEQ ID NO: 12259

SEQ ID NO: 12373 - DNA, 201 bp, Homo sapiens; identical to SEQ ID NO: 12262

SEQ ID NO: 12374 - DNA, 201 bp, Homo sapiens; identical to SEQ ID NO: 12264

SEQ ID NO: 12375 - DNA, 201 bp, Homo sapiens; identical to SEQ ID NO: 12265

SEQ ID NO: 12376 - DNA, 201 bp, Homo sapiens; identical to SEQ ID NO: 12266

SEQ ID NO: 12377 - DNA, 201 bp, Homo sapiens; identical to SEQ ID NO: 12268

SEQ ID NO: 12378 - DNA, 201 bp, Homo sapiens; identical to SEQ ID NO: 12269

SEQ ID NO: 12379 - DNA, 201 bp, Homo sapiens; identical to SEQ ID NO: 12325

SEQ ID NO: 12380 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaagagagcaagcgagacattctgttcctctttgacggctcagccaatcttgtgggccagttccctgttgtccgtgacttt

SEQ ID NO: 12381 - DNA, 201 bp, Homo sapiens; identical to SEQ ID NO: 12271

SEQ ID NO: 12382 - DNA, 201 bp, Homo sapiens; identical to SEQ ID NO: 12273

SEQ ID NO: 12383 - DNA, 201 bp, Homo sapiens; identical to SEQ ID NO: 12275

SEQ ID NO: 12384 - DNA, 201 bp, Homo sapiens; identical to SEQ ID NO: 12274

SEQ ID NO: 12385 - DNA, 201 bp, Homo sapiens; identical to SEQ ID NO: 12276

SEQ ID NO: 12386 - DNA, 201 bp, Homo sapiens; identical to SEQ ID NO: 12277

SEQ ID NO: 12387 - DNA, 201 bp, Homo sapiens; identical to SEQ ID NO: 12278

SEQ ID NO: 12388 - DNA, 201 bp, Homo sapiens; identical to SEQ ID NO: 12279

SEQ ID NO: 12389 - DNA, 201 bp, Homo sapiens; identical to SEQ ID NO: 12280

SEQ ID NO: 12390 - DNA, 201 bp, Homo sapiens; identical to SEQ ID NO: 12281

SEQ ID NO: 12391 - DNA, 201 bp, Homo sapiens; identical to SEQ ID NO: 12282

SEQ ID NO: 12392 - DNA, 201 bp, Homo sapiens; identical to SEQ ID NO: 12283

SEQ ID NO: 12393 - DNA, 201 bp, Homo sapiens; identical to SEQ ID NO: 12284

SEQ ID NO: 12394 - DNA, 201 bp, Homo sapiens; identical to SEQ ID NO: 12285

SEQ ID NO: 12395 - DNA, 201 bp, Homo sapiens; identical to SEQ ID NO: 12286

SEQ ID NO: 12396 - DNA, 201 bp, Homo sapiens; identical to SEQ ID NO: 12287

SEQ ID NO: 12397 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12398 - DNA, 201 bp, Homo sapiens; identical to SEQ ID NO: 12290

SEQ ID NO: 12399 - DNA, 201 bp, Homo sapiens; identical to SEQ ID NO: 12289

SEQ ID NO: 12400 - DNA, 201 bp, Homo sapiens; identical to SEQ ID NO: 12291

SEQ ID NO: 12401 - DNA, 201 bp, Homo sapiens; identical to SEQ ID NO: 12292

SEQ ID NO: 12402 - DNA, 201 bp, Homo sapiens; identical to SEQ ID NO: 12293

SEQ ID NO: 12403 - DNA, 201 bp, Homo sapiens; identical to SEQ ID NO: 12294

SEQ ID NO: 12404 - DNA, 201 bp, Homo sapiens; identical to SEQ ID NO: 12296

SEQ ID NO: 12405 - DNA, 201 bp, Homo sapiens; identical to SEQ ID NO: 12295

SEQ ID NO: 12406 - DNA, 201 bp, Homo sapiens; identical to SEQ ID NO: 12298

SEQ ID NO: 12407 - DNA, 201 bp, Homo sapiens; identical to SEQ ID NO: 12297

SEQ ID NO: 12408 - DNA, 201 bp, Homo sapiens; identical to SEQ ID NO: 12299

SEQ ID NO: 12409 - DNA, 201 bp, Homo sapiens; identical to SEQ ID NO: 12301

SEQ ID NO: 12410 - DNA, 201 bp, Homo sapiens; identical to SEQ ID NO: 12302

SEQ ID NO: 12411 - DNA, 201 bp, Homo sapiens; identical to SEQ ID NO: 12358

SEQ ID NO: 12412 - DNA, 201 bp, Homo sapiens; identical to SEQ ID NO: 12303

SEQ ID NO: 12413 - DNA, 201 bp, Homo sapiens; identical to SEQ ID NO: 12305

SEQ ID NO: 12414 - DNA, 201 bp, Homo sapiens; identical to SEQ ID NO: 12306

SEQ ID NO: 12415 - DNA, 201 bp, Homo sapiens; identical to SEQ ID NO: 12362

SEQ ID NO: 12416 - DNA, 201 bp, Homo sapiens; identical to SEQ ID NO: 12309

SEQ ID NO: 12417 - DNA, 201 bp, Homo sapiens; identical to SEQ ID NO: 12310

SEQ ID NO: 12418 - DNA, 201 bp, Homo sapiens; identical to SEQ ID NO: 12312

SEQ ID NO: 12419 - DNA, 201 bp, Homo sapiens; identical to SEQ ID NO: 12311

SEQ ID NO: 12420 - DNA, 201 bp, Homo sapiens; identical to SEQ ID NO: 12313

SEQ ID NO: 12421 - DNA, 201 bp, Homo sapiens; identical to SEQ ID NO: 12314

SEQ ID NO: 12422 - DNA, 201 bp, Homo sapiens; identical to SEQ ID NO: 12315

SEQ ID NO: 12423 - DNA, 201 bp, Homo sapiens; identical to SEQ ID NO: 12259

SEQ ID NO: 12424 - DNA, 201 bp, Homo sapiens; identical to SEQ ID NO: 12260

SEQ ID NO: 12425 - DNA, 201 bp, Homo sapiens; identical to SEQ ID NO: 12261

SEQ ID NO: 12426 - DNA, 201 bp, Homo sapiens; identical to SEQ ID NO: 12262

SEQ ID NO: 12427 - DNA, 201 bp, Homo sapiens; identical to SEQ ID NO: 12263

SEQ ID NO: 12428 - DNA, 201 bp, Homo sapiens; identical to SEQ ID NO: 12264

SEQ ID NO: 12429 - DNA, 201 bp, Homo sapiens; identical to SEQ ID NO: 12265

SEQ ID NO: 12430 - DNA, 201 bp, Homo sapiens; identical to SEQ ID NO: 12266

SEQ ID NO: 12431 - DNA, 201 bp, Homo sapiens; identical to SEQ ID NO: 12267

SEQ ID NO: 12432 - DNA, 201 bp, Homo sapiens; identical to SEQ ID NO: 12268

SEQ ID NO: 12433 - DNA, 201 bp, Homo sapiens; identical to SEQ ID NO: 12269

SEQ ID NO: 12434 - DNA, 201 bp, Homo sapiens; identical to SEQ ID NO: 12270

SEQ ID NO: 12435 - DNA, 201 bp, Homo sapiens; identical to SEQ ID NO: 12271

SEQ ID NO: 12436 - DNA, 201 bp, Homo sapiens; identical to SEQ ID NO: 12272

SEQ ID NO: 12437 - DNA, 201 bp, Homo sapiens; identical to SEQ ID NO: 12273

SEQ ID NO: 12438 - DNA, 201 bp, Homo sapiens; identical to SEQ ID NO: 12274

SEQ ID NO: 12439 - DNA, 201 bp, Homo sapiens; identical to SEQ ID NO: 12275

SEQ ID NO: 12440 - DNA, 201 bp, Homo sapiens; identical to SEQ ID NO: 12276

SEQ ID NO: 12441 - DNA, 201 bp, Homo sapiens; identical to SEQ ID NO: 12277

SEQ ID NO: 12442 - DNA, 201 bp, Homo sapiens; identical to SEQ ID NO: 12278

SEQ ID NO: 12443 - DNA, 201 bp, Homo sapiens; identical to SEQ ID NO: 12279

SEQ ID NO: 12444 - DNA, 201 bp, Homo sapiens; identical to SEQ ID NO: 12280

SEQ ID NO: 12445 - DNA, 201 bp, Homo sapiens; identical to SEQ ID NO: 12281

SEQ ID NO: 12446 - DNA, 201 bp, Homo sapiens; identical to SEQ ID NO: 12282

SEQ ID NO: 12447 - DNA, 201 bp, Homo sapiens; identical to SEQ ID NO: 12283

SEQ ID NO: 12448 - DNA, 201 bp, Homo sapiens; identical to SEQ ID NO: 12284

SEQ ID NO: 12449 - DNA, 201 bp, Homo sapiens; identical to SEQ ID NO: 12285

SEQ ID NO: 12450 - DNA, 201 bp, Homo sapiens; identical to SEQ ID NO: 12286

SEQ ID NO: 12451 - DNA, 201 bp, Homo sapiens; identical to SEQ ID NO: 12287

SEQ ID NO: 12452 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12453 - DNA, 201 bp, Homo sapiens; identical to SEQ ID NO: 12289

SEQ ID NO: 12454 - DNA, 201 bp, Homo sapiens; identical to SEQ ID NO: 12291

SEQ ID NO: 12455 - DNA, 201 bp, Homo sapiens; identical to SEQ ID NO: 12292

SEQ ID NO: 12456 - DNA, 201 bp, Homo sapiens; identical to SEQ ID NO: 12294

SEQ ID NO: 12457 - DNA, 201 bp, Homo sapiens; identical to SEQ ID NO: 12295

SEQ ID NO: 12458 - DNA, 201 bp, Homo sapiens; identical to SEQ ID NO: 12296

SEQ ID NO: 12459 - DNA, 201 bp, Homo sapiens; identical to SEQ ID NO: 12297

SEQ ID NO: 12460 - DNA, 201 bp, Homo sapiens; identical to SEQ ID NO: 12298

SEQ ID NO: 12461 - DNA, 201 bp, Homo sapiens; identical to SEQ ID NO: 12299

SEQ ID NO: 12462 - DNA, 201 bp, Homo sapiens; identical to SEQ ID NO: 12300

SEQ ID NO: 12463 - DNA, 201 bp, Homo sapiens; identical to SEQ ID NO: 12301

SEQ ID NO: 12464 - DNA, 201 bp, Homo sapiens; identical to SEQ ID NO: 12302

SEQ ID NO: 12465 - DNA, 201 bp, Homo sapiens; identical to SEQ ID NO: 12358

SEQ ID NO: 12466 - DNA, 201 bp, Homo sapiens; identical to SEQ ID NO: 12303

SEQ ID NO: 12467 - DNA, 201 bp, Homo sapiens; identical to SEQ ID NO: 12304

SEQ ID NO: 12468 - DNA, 201 bp, Homo sapiens; identical to SEQ ID NO: 12305

SEQ ID NO: 12469 - DNA, 201 bp, Homo sapiens; identical to SEQ ID NO: 12362

SEQ ID NO: 12470 - DNA, 201 bp, Homo sapiens; identical to SEQ ID NO: 12306

SEQ ID NO: 12471 - DNA, 201 bp, Homo sapiens; identical to SEQ ID NO: 12307

SEQ ID NO: 12472 - DNA, 201 bp, Homo sapiens; identical to SEQ ID NO: 12308

SEQ ID NO: 12473 - DNA, 201 bp, Homo sapiens; identical to SEQ ID NO: 12309

SEQ ID NO: 12474 - DNA, 201 bp, Homo sapiens; identical to SEQ ID NO: 12310

SEQ ID NO: 12475 - DNA, 201 bp, Homo sapiens; identical to SEQ ID NO: 12311

SEQ ID NO: 12476 - DNA, 201 bp, Homo sapiens; identical to SEQ ID NO: 12312

SEQ ID NO: 12477 - DNA, 201 bp, Homo sapiens; identical to SEQ ID NO: 12313

SEQ ID NO: 12478 - DNA, 201 bp, Homo sapiens; identical to SEQ ID NO: 12314

SEQ ID NO: 12479 - DNA, 201 bp, Homo sapiens; identical to SEQ ID NO: 12315

SEQ ID NO: 12480 - DNA, 201 bp, Homo sapiens; identical to SEQ ID NO: 12258

SEQ ID NO: 12481 - DNA, 201 bp, Homo sapiens; identical to SEQ ID NO: 12259

SEQ ID NO: 12482 - DNA, 201 bp, Homo sapiens; identical to SEQ ID NO: 12260

SEQ ID NO: 12483 - DNA, 201 bp, Homo sapiens; identical to SEQ ID NO: 12261

SEQ ID NO: 12484 - DNA, 201 bp, Homo sapiens; identical to SEQ ID NO: 12262

SEQ ID NO: 12485 - DNA, 201 bp, Homo sapiens; identical to SEQ ID NO: 12263

SEQ ID NO: 12486 - DNA, 201 bp, Homo sapiens; identical to SEQ ID NO: 12264

SEQ ID NO: 12487 - DNA, 201 bp, Homo sapiens; identical to SEQ ID NO: 12265

SEQ ID NO: 12488 - DNA, 201 bp, Homo sapiens; identical to SEQ ID NO: 12266

SEQ ID NO: 12489 - DNA, 201 bp, Homo sapiens; identical to SEQ ID NO: 12267

SEQ ID NO: 12490 - DNA, 201 bp, Homo sapiens; identical to SEQ ID NO: 12268

SEQ ID NO: 12491 - DNA, 201 bp, Homo sapiens; identical to SEQ ID NO: 12269

SEQ ID NO: 12492 - DNA, 201 bp, Homo sapiens; identical to SEQ ID NO: 12270

SEQ ID NO: 12493 - DNA, 201 bp, Homo sapiens; identical to SEQ ID NO: 12271

SEQ ID NO: 12494 - DNA, 201 bp, Homo sapiens; identical to SEQ ID NO: 12272

SEQ ID NO: 12495 - DNA, 201 bp, Homo sapiens; identical to SEQ ID NO: 12273

SEQ ID NO: 12496 - DNA, 201 bp, Homo sapiens; identical to SEQ ID NO: 12274

SEQ ID NO: 12497 - DNA, 201 bp, Homo sapiens; identical to SEQ ID NO: 12275

SEQ ID NO: 12498 - DNA, 201 bp, Homo sapiens; identical to SEQ ID NO: 12276

SEQ ID NO: 12499 - DNA, 201 bp, Homo sapiens; identical to SEQ ID NO: 12277

SEQ ID NO: 12500 - DNA, 201 bp, Homo sapiens; identical to SEQ ID NO: 12278

SEQ ID NO: 12501 - DNA, 201 bp, Homo sapiens; identical to SEQ ID NO: 12279

SEQ ID NO: 12502 - DNA, 201 bp, Homo sapiens; identical to SEQ ID NO: 12280

SEQ ID NO: 12503 - DNA, 201 bp, Homo sapiens; identical to SEQ ID NO: 12281

SEQ ID NO: 12504 - DNA, 201 bp, Homo sapiens; identical to SEQ ID NO: 12282

SEQ ID NO: 12505 - DNA, 201 bp, Homo sapiens; identical to SEQ ID NO: 12283

SEQ ID NO: 12506 - DNA, 201 bp, Homo sapiens; identical to SEQ ID NO: 12284

SEQ ID NO: 12507 - DNA, 201 bp, Homo sapiens; identical to SEQ ID NO: 12285

SEQ ID NO: 12508 - DNA, 201 bp, Homo sapiens; identical to SEQ ID NO: 12286

SEQ ID NO: 12509 - DNA, 201 bp, Homo sapiens
ggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagcacaagactctgctgacattattttccttattgatggatcaaa

SEQ ID NO: 12510 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12511 - DNA, 201 bp, Homo sapiens; identical to SEQ ID NO: 12289

SEQ ID NO: 12512 - DNA, 201 bp, Homo sapiens; identical to SEQ ID NO: 12290

SEQ ID NO: 12513 - DNA, 201 bp, Homo sapiens; identical to SEQ ID NO: 12291

SEQ ID NO: 12514 - DNA, 201 bp, Homo sapiens; identical to SEQ ID NO: 12292

SEQ ID NO: 12515 - DNA, 201 bp, Homo sapiens; identical to SEQ ID NO: 12293

SEQ ID NO: 12516 - DNA, 201 bp, Homo sapiens; identical to SEQ ID NO: 12294

SEQ ID NO: 12517 - DNA, 201 bp, Homo sapiens; identical to SEQ ID NO: 12295

SEQ ID NO: 12518 - DNA, 201 bp, Homo sapiens; identical to SEQ ID NO: 12296

SEQ ID NO: 12519 - DNA, 201 bp, Homo sapiens; identical to SEQ ID NO: 12297

SEQ ID NO: 12520 - DNA, 201 bp, Homo sapiens; identical to SEQ ID NO: 12298

SEQ ID NO: 12521 - DNA, 201 bp, Homo sapiens; identical to SEQ ID NO: 12299

SEQ ID NO: 12522 - DNA, 201 bp, Homo sapiens; identical to SEQ ID NO: 12300

SEQ ID NO: 12523 - DNA, 201 bp, Homo sapiens; identical to SEQ ID NO: 12301

SEQ ID NO: 12524 - DNA, 201 bp, Homo sapiens; identical to SEQ ID NO: 12302

SEQ ID NO: 12525 - DNA, 201 bp, Homo sapiens; identical to SEQ ID NO: 12358

SEQ ID NO: 12526 - DNA, 201 bp, Homo sapiens; identical to SEQ ID NO: 12303

SEQ ID NO: 12527 - DNA, 201 bp, Homo sapiens; identical to SEQ ID NO: 12304

SEQ ID NO: 12528 - DNA, 201 bp, Homo sapiens; identical to SEQ ID NO: 12305

SEQ ID NO: 12529 - DNA, 201 bp, Homo sapiens; identical to SEQ ID NO: 12362

SEQ ID NO: 12530 - DNA, 201 bp, Homo sapiens; identical to SEQ ID NO: 12306

SEQ ID NO: 12531 - DNA, 201 bp, Homo sapiens; identical to SEQ ID NO: 12307

SEQ ID NO: 12532 - DNA, 201 bp, Homo sapiens; identical to SEQ ID NO: 12308

SEQ ID NO: 12533 - DNA, 201 bp, Homo sapiens; identical to SEQ ID NO: 12309

SEQ ID NO: 12534 - DNA, 201 bp, Homo sapiens; identical to SEQ ID NO: 12310

SEQ ID NO: 12535 - DNA, 201 bp, Homo sapiens; identical to SEQ ID NO: 12311

SEQ ID NO: 12536 - DNA, 201 bp, Homo sapiens; identical to SEQ ID NO: 12312

SEQ ID NO: 12537 - DNA, 201 bp, Homo sapiens; identical to SEQ ID NO: 12313

SEQ ID NO: 12538 - DNA, 201 bp, Homo sapiens; identical to SEQ ID NO: 12314

SEQ ID NO: 12539 - DNA, 201 bp, Homo sapiens; identical to SEQ ID NO: 12315

SEQ ID NO: 12540 - DNA, 201 bp, Homo sapiens; identical to SEQ ID NO: 12258

SEQ ID NO: 12541 - DNA, 201 bp, Homo sapiens; identical to SEQ ID NO: 12259

SEQ ID NO: 12542 - DNA, 201 bp, Homo sapiens; identical to SEQ ID NO: 12260

SEQ ID NO: 12543 - DNA, 201 bp, Homo sapiens; identical to SEQ ID NO: 12261

SEQ ID NO: 12544 - DNA, 201 bp, Homo sapiens; identical to SEQ ID NO: 12262

SEQ ID NO: 12545 - DNA, 201 bp, Homo sapiens; identical to SEQ ID NO: 12263

SEQ ID NO: 12546 - DNA, 201 bp, Homo sapiens; identical to SEQ ID NO: 12264

SEQ ID NO: 12547 - DNA, 201 bp, Homo sapiens; identical to SEQ ID NO: 12265

SEQ ID NO: 12548 - DNA, 201 bp, Homo sapiens; identical to SEQ ID NO: 12266

SEQ ID NO: 12549 - DNA, 201 bp, Homo sapiens; identical to SEQ ID NO: 12267

SEQ ID NO: 12550 - DNA, 201 bp, Homo sapiens; identical to SEQ ID NO: 12268

SEQ ID NO: 12551 - DNA, 201 bp, Homo sapiens; identical to SEQ ID NO: 12269

SEQ ID NO: 12552 - DNA, 201 bp, Homo sapiens; identical to SEQ ID NO: 12270

SEQ ID NO: 12553 - DNA, 201 bp, Homo sapiens; identical to SEQ ID NO: 12271

SEQ ID NO: 12554 - DNA, 201 bp, Homo sapiens; identical to SEQ ID NO: 12272

SEQ ID NO: 12555 - DNA, 201 bp, Homo sapiens; identical to SEQ ID NO: 12273

SEQ ID NO: 12556 - DNA, 201 bp, Homo sapiens; identical to SEQ ID NO: 12274

SEQ ID NO: 12557 - DNA, 201 bp, Homo sapiens; identical to SEQ ID NO: 12275

SEQ ID NO: 12558 - DNA, 201 bp, Homo sapiens; identical to SEQ ID NO: 12276

SEQ ID NO: 12559 - DNA, 201 bp, Homo sapiens; identical to SEQ ID NO: 12277

SEQ ID NO: 12560 - DNA, 201 bp, Homo sapiens; identical to SEQ ID NO: 12278

SEQ ID NO: 12561 - DNA, 201 bp, Homo sapiens; identical to SEQ ID NO: 12279

SEQ ID NO: 12562 - DNA, 201 bp, Homo sapiens; identical to SEQ ID NO: 12280

SEQ ID NO: 12563 - DNA, 201 bp, Homo sapiens; identical to SEQ ID NO: 12281

SEQ ID NO: 12564 - DNA, 201 bp, Homo sapiens; identical to SEQ ID NO: 12282

SEQ ID NO: 12565 - DNA, 201 bp, Homo sapiens; identical to SEQ ID NO: 12283

SEQ ID NO: 12566 - DNA, 201 bp, Homo sapiens; identical to SEQ ID NO: 12284

SEQ ID NO: 12567 - DNA, 201 bp, Homo sapiens; identical to SEQ ID NO: 12285

SEQ ID NO: 12568 - DNA, 201 bp, Homo sapiens; identical to SEQ ID NO: 12286

SEQ ID NO: 12569 - DNA, 201 bp, Homo sapiens; identical to SEQ ID NO: 12287

SEQ ID NO: 12570 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12571 - DNA, 201 bp, Homo sapiens; identical to SEQ ID NO: 12289

SEQ ID NO: 12572 - DNA, 201 bp, Homo sapiens; identical to SEQ ID NO: 12290

SEQ ID NO: 12573 - DNA, 201 bp, Homo sapiens; identical to SEQ ID NO: 12291

SEQ ID NO: 12574 - DNA, 201 bp, Homo sapiens; identical to SEQ ID NO: 12292

SEQ ID NO: 12575 - DNA, 201 bp, Homo sapiens; identical to SEQ ID NO: 12293

SEQ ID NO: 12576 - DNA, 201 bp, Homo sapiens; identical to SEQ ID NO: 12294

SEQ ID NO: 12577 - DNA, 201 bp, Homo sapiens; identical to SEQ ID NO: 12295

SEQ ID NO: 12578 - DNA, 201 bp, Homo sapiens; identical to SEQ ID NO: 12296

SEQ ID NO: 12579 - DNA, 201 bp, Homo sapiens; identical to SEQ ID NO: 12297

SEQ ID NO: 12580 - DNA, 201 bp, Homo sapiens; identical to SEQ ID NO: 12298

SEQ ID NO: 12581 - DNA, 201 bp, Homo sapiens; identical to SEQ ID NO: 12299

SEQ ID NO: 12582 - DNA, 201 bp, Homo sapiens; identical to SEQ ID NO: 12300

SEQ ID NO: 12583 - DNA, 201 bp, Homo sapiens; identical to SEQ ID NO: 12301

SEQ ID NO: 12584 - DNA, 201 bp, Homo sapiens; identical to SEQ ID NO: 12302

SEQ ID NO: 12585 - DNA, 201 bp, Homo sapiens; identical to SEQ ID NO: 12358

SEQ ID NO: 12586 - DNA, 201 bp, Homo sapiens; identical to SEQ ID NO: 12303

SEQ ID NO: 12587 - DNA, 201 bp, Homo sapiens; identical to SEQ ID NO: 12304

SEQ ID NO: 12588 - DNA, 201 bp, Homo sapiens; identical to SEQ ID NO: 12305

SEQ ID NO: 12589 - DNA, 201 bp, Homo sapiens; identical to SEQ ID NO: 12362

SEQ ID NO: 12590 - DNA, 201 bp, Homo sapiens; identical to SEQ ID NO: 12306

SEQ ID NO: 12591 - DNA, 201 bp, Homo sapiens; identical to SEQ ID NO: 12307

SEQ ID NO: 12592 - DNA, 201 bp, Homo sapiens; identical to SEQ ID NO: 12308

SEQ ID NO: 12593 - DNA, 201 bp, Homo sapiens; identical to SEQ ID NO: 12309

SEQ ID NO: 12594 - DNA, 201 bp, Homo sapiens; identical to SEQ ID NO: 12310

SEQ ID NO: 12595 - DNA, 201 bp, Homo sapiens; identical to SEQ ID NO: 12311

SEQ ID NO: 12596 - DNA, 201 bp, Homo sapiens; identical to SEQ ID NO: 12312

SEQ ID NO: 12597 - DNA, 201 bp, Homo sapiens; identical to SEQ ID NO: 12313

SEQ ID NO: 12598 - DNA, 201 bp, Homo sapiens; identical to SEQ ID NO: 12314

SEQ ID NO: 12599 - DNA, 201 bp, Homo sapiens; identical to SEQ ID NO: 12315

SEQ ID NO: 12600 - DNA, 201 bp, Homo sapiens; identical to SEQ ID NO: 12258

SEQ ID NO: 12601 - DNA, 201 bp, Homo sapiens; identical to SEQ ID NO: 12259

SEQ ID NO: 12602 - DNA, 201 bp, Homo sapiens; identical to SEQ ID NO: 12260

SEQ ID NO: 12603 - DNA, 201 bp, Homo sapiens; identical to SEQ ID NO: 12261

SEQ ID NO: 12604 - DNA, 201 bp, Homo sapiens; identical to SEQ ID NO: 12262

SEQ ID NO: 12605 - DNA, 201 bp, Homo sapiens; identical to SEQ ID NO: 12263

SEQ ID NO: 12606 - DNA, 201 bp, Homo sapiens; identical to SEQ ID NO: 12264

SEQ ID NO: 12607 - DNA, 201 bp, Homo sapiens; identical to SEQ ID NO: 12265

SEQ ID NO: 12608 - DNA, 201 bp, Homo sapiens; identical to SEQ ID NO: 12266

SEQ ID NO: 12609 - DNA, 201 bp, Homo sapiens; identical to SEQ ID NO: 12268

SEQ ID NO: 12610 - DNA, 201 bp, Homo sapiens; identical to SEQ ID NO: 12269

SEQ ID NO: 12611 - DNA, 201 bp, Homo sapiens; identical to SEQ ID NO: 12270

SEQ ID NO: 12612 - DNA, 201 bp, Homo sapiens; identical to SEQ ID NO: 12271

SEQ ID NO: 12613 - DNA, 201 bp, Homo sapiens; identical to SEQ ID NO: 12380

SEQ ID NO: 12614 - DNA, 201 bp, Homo sapiens; identical to SEQ ID NO: 12273

SEQ ID NO: 12615 - DNA, 201 bp, Homo sapiens; identical to SEQ ID NO: 12274

SEQ ID NO: 12616 - DNA, 201 bp, Homo sapiens; identical to SEQ ID NO: 12275

SEQ ID NO: 12617 - DNA, 201 bp, Homo sapiens; identical to SEQ ID NO: 12276

SEQ ID NO: 12618 - DNA, 201 bp, Homo sapiens; identical to SEQ ID NO: 12277

SEQ ID NO: 12619 - DNA, 201 bp, Homo sapiens; identical to SEQ ID NO: 12278

SEQ ID NO: 12620 - DNA, 201 bp, Homo sapiens; identical to SEQ ID NO: 12279

SEQ ID NO: 12621 - DNA, 201 bp, Homo sapiens; identical to SEQ ID NO: 12280

SEQ ID NO: 12622 - DNA, 201 bp, Homo sapiens; identical to SEQ ID NO: 12281

SEQ ID NO: 12623 - DNA, 201 bp, Homo sapiens; identical to SEQ ID NO: 12282

SEQ ID NO: 12624 - DNA, 201 bp, Homo sapiens; identical to SEQ ID NO: 12283

SEQ ID NO: 12625 - DNA, 201 bp, Homo sapiens; identical to SEQ ID NO: 12284

SEQ ID NO: 12626 - DNA, 201 bp, Homo sapiens; identical to SEQ ID NO: 12285

SEQ ID NO: 12627 - DNA, 201 bp, Homo sapiens; identical to SEQ ID NO: 12286

SEQ ID NO: 12628 - DNA, 201 bp, Homo sapiens; identical to SEQ ID NO: 12287

SEQ ID NO: 12629 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12630 - DNA, 201 bp, Homo sapiens; identical to SEQ ID NO: 12289

SEQ ID NO: 12631 - DNA, 201 bp, Homo sapiens; identical to SEQ ID NO: 12290

SEQ ID NO: 12632 - DNA, 201 bp, Homo sapiens; identical to SEQ ID NO: 12291

SEQ ID NO: 12633 - DNA, 201 bp, Homo sapiens; identical to SEQ ID NO: 12292

SEQ ID NO: 12634 - DNA, 201 bp, Homo sapiens; identical to SEQ ID NO: 12293

SEQ ID NO: 12635 - DNA, 201 bp, Homo sapiens; identical to SEQ ID NO: 12294

SEQ ID NO: 12636 - DNA, 201 bp, Homo sapiens; identical to SEQ ID NO: 12295

SEQ ID NO: 12637 - DNA, 201 bp, Homo sapiens; identical to SEQ ID NO: 12296

SEQ ID NO: 12638 - DNA, 201 bp, Homo sapiens; identical to SEQ ID NO: 12297

SEQ ID NO: 12639 - DNA, 201 bp, Homo sapiens; identical to SEQ ID NO: 12298

SEQ ID NO: 12640 - DNA, 201 bp, Homo sapiens; identical to SEQ ID NO: 12299

SEQ ID NO: 12641 - DNA, 201 bp, Homo sapiens; identical to SEQ ID NO: 12301

SEQ ID NO: 12642 - DNA, 201 bp, Homo sapiens; identical to SEQ ID NO: 12302

SEQ ID NO: 12643 - DNA, 201 bp, Homo sapiens; identical to SEQ ID NO: 12358

SEQ ID NO: 12644 - DNA, 201 bp, Homo sapiens; identical to SEQ ID NO: 12303

SEQ ID NO: 12645 - DNA, 201 bp, Homo sapiens; identical to SEQ ID NO: 12304

SEQ ID NO: 12646 - DNA, 201 bp, Homo sapiens; identical to SEQ ID NO: 12305

SEQ ID NO: 12647 - DNA, 201 bp, Homo sapiens; identical to SEQ ID NO: 12362

SEQ ID NO: 12648 - DNA, 201 bp, Homo sapiens; identical to SEQ ID NO: 12306

SEQ ID NO: 12649 - DNA, 201 bp, Homo sapiens; identical to SEQ ID NO: 12308

SEQ ID NO: 12650 - DNA, 201 bp, Homo sapiens; identical to SEQ ID NO: 12309

SEQ ID NO: 12651 - DNA, 201 bp, Homo sapiens; identical to SEQ ID NO: 12310

SEQ ID NO: 12652 - DNA, 201 bp, Homo sapiens; identical to SEQ ID NO: 12311

SEQ ID NO: 12653 - DNA, 201 bp, Homo sapiens; identical to SEQ ID NO: 12312

SEQ ID NO: 12654 - DNA, 201 bp, Homo sapiens; identical to SEQ ID NO: 12313

SEQ ID NO: 12655 - DNA, 201 bp, Homo sapiens; identical to SEQ ID NO: 12314

SEQ ID NO: 12656 - DNA, 201 bp, Homo sapiens; identical to SEQ ID NO: 12315

SEQ ID NO: 12657 - DNA, 201 bp, Homo sapiens; identical to SEQ ID NO: 12258

SEQ ID NO: 12658 - DNA, 201 bp, Homo sapiens; identical to SEQ ID NO: 12259

SEQ ID NO: 12659 - DNA, 201 bp, Homo sapiens; identical to SEQ ID NO: 12262

SEQ ID NO: 12660 - DNA, 201 bp, Homo sapiens; identical to SEQ ID NO: 12264

SEQ ID NO: 12661 - DNA, 201 bp, Homo sapiens; identical to SEQ ID NO: 12265

SEQ ID NO: 12662 - DNA, 201 bp, Homo sapiens; identical to SEQ ID NO: 12266

SEQ ID NO: 12663 - DNA, 201 bp, Homo sapiens; identical to SEQ ID NO: 12268

SEQ ID NO: 12664 - DNA, 201 bp, Homo sapiens; identical to SEQ ID NO: 12267

SEQ ID NO: 12665 - DNA, 201 bp, Homo sapiens; identical to SEQ ID NO: 12269

SEQ ID NO: 12666 - DNA, 201 bp, Homo sapiens; identical to SEQ ID NO: 12325

SEQ ID NO: 12667 - DNA, 201 bp, Homo sapiens; identical to SEQ ID NO: 12272

SEQ ID NO: 12668 - DNA, 201 bp, Homo sapiens; identical to SEQ ID NO: 12271

SEQ ID NO: 12669 - DNA, 201 bp, Homo sapiens; identical to SEQ ID NO: 12273

SEQ ID NO: 12670 - DNA, 201 bp, Homo sapiens; identical to SEQ ID NO: 12275

SEQ ID NO: 12671 - DNA, 201 bp, Homo sapiens; identical to SEQ ID NO: 12274

SEQ ID NO: 12672 - DNA, 201 bp, Homo sapiens; identical to SEQ ID NO: 12276

SEQ ID NO: 12673 - DNA, 201 bp, Homo sapiens; identical to SEQ ID NO: 12277

SEQ ID NO: 12674 - DNA, 201 bp, Homo sapiens; identical to SEQ ID NO: 12278

SEQ ID NO: 12675 - DNA, 201 bp, Homo sapiens; identical to SEQ ID NO: 12279

SEQ ID NO: 12676 - DNA, 201 bp, Homo sapiens; identical to SEQ ID NO: 12280

SEQ ID NO: 12677 - DNA, 201 bp, Homo sapiens; identical to SEQ ID NO: 12281

SEQ ID NO: 12678 - DNA, 201 bp, Homo sapiens; identical to SEQ ID NO: 12282

SEQ ID NO: 12679 - DNA, 201 bp, Homo sapiens; identical to SEQ ID NO: 12283

SEQ ID NO: 12680 - DNA, 201 bp, Homo sapiens; identical to SEQ ID NO: 12284

SEQ ID NO: 12681 - DNA, 201 bp, Homo sapiens; identical to SEQ ID NO: 12285

SEQ ID NO: 12682 - DNA, 201 bp, Homo sapiens; identical to SEQ ID NO: 12286

SEQ ID NO: 12683 - DNA, 201 bp, Homo sapiens; identical to SEQ ID NO: 12509

SEQ ID NO: 12684 - DNA, 201 bp, Homo sapiens; identical to SEQ ID NO: 12288
  misc_feature (1)...(201): n = A,T,C or G, or insertion/deletion polymorphism (see Tables 1-2)

SEQ ID NO: 12685 - DNA, 201 bp, Homo sapiens; identical to SEQ ID NO: 12290

SEQ ID NO: 12686 - DNA, 201 bp, Homo sapiens; identical to SEQ ID NO: 12289

SEQ ID NO: 12687 - DNA, 201 bp, Homo sapiens; identical to SEQ ID NO: 12291

SEQ ID NO: 12688 - DNA, 201 bp, Homo sapiens; identical to SEQ ID NO: 12292

SEQ ID NO: 12689 - DNA, 201 bp, Homo sapiens; identical to SEQ ID NO: 12293

SEQ ID NO: 12690 - DNA, 201 bp, Homo sapiens; identical to SEQ ID NO: 12294

SEQ ID NO: 12691 - DNA, 201 bp, Homo sapiens; identical to SEQ ID NO: 12295

SEQ ID NO: 12692 - DNA, 201 bp, Homo sapiens; identical to SEQ ID NO: 12296

SEQ ID NO: 12693 - DNA, 201 bp, Homo sapiens; identical to SEQ ID NO: 12297

SEQ ID NO: 12694 - DNA, 201 bp, Homo sapiens; identical to SEQ ID NO: 12298

SEQ ID NO: 12695 - DNA, 201 bp, Homo sapiens; identical to SEQ ID NO: 12299

SEQ ID NO: 12696 - DNA, 201 bp, Homo sapiens; identical to SEQ ID NO: 12300

SEQ ID NO: 12697 - DNA, 201 bp, Homo sapiens; identical to SEQ ID NO: 12301

SEQ ID NO: 12698 - DNA, 201 bp, Homo sapiens; identical to SEQ ID NO: 12302

SEQ ID NO: 12699 - DNA, 201 bp, Homo sapiens; identical to SEQ ID NO: 12358

SEQ ID NO: 12700 - DNA, 201 bp, Homo sapiens; identical to SEQ ID NO: 12303

SEQ ID NO: 12701 - DNA, 201 bp, Homo sapiens; identical to SEQ ID NO: 12305

SEQ ID NO: 12702 - DNA, 201 bp, Homo sapiens; identical to SEQ ID NO: 12306

SEQ ID NO: 12703 - DNA, 201 bp, Homo sapiens; identical to SEQ ID NO: 12362

SEQ ID NO: 12704 - DNA, 201 bp, Homo sapiens; identical to SEQ ID NO: 12307

SEQ ID NO: 12705 - DNA, 201 bp, Homo sapiens; identical to SEQ ID NO: 12309

SEQ ID NO: 12706 - DNA, 201 bp, Homo sapiens; identical to SEQ ID NO: 12310

SEQ ID NO: 12707 - DNA, 201 bp, Homo sapiens; identical to SEQ ID NO: 12312

SEQ ID NO: 12708 - DNA, 201 bp, Homo sapiens; identical to SEQ ID NO: 12311

SEQ ID NO: 12709 - DNA, 201 bp, Homo sapiens; identical to SEQ ID NO: 12313

SEQ ID NO: 12710 - DNA, 201 bp, Homo sapiens; identical to SEQ ID NO: 12314

SEQ ID NO: 12711 - DNA, 201 bp, Homo sapiens; identical to SEQ ID NO: 12315

SEQ ID NO: 12712 - DNA, 201 bp, Homo sapiens
agcagatgaccctgaagatagagggtgaccacggggcccgggtggtactggtggccgtggacaagggcgtgttcgtgctgaataagaagaacaaactgacrcagagtaagatctgggacgtggtggagaaggcagacatcggctgcaccccgggcagtgggaaggattacgccggtgtcttctccgacgcagggctgacct

SEQ ID NO: 12713 - DNA, 201 bp, Homo sapiens
acatatccatgatgactggctttgctccagacacagatgacctgaagcagctggccaatggtgttgacagatacatctccaagtatgagctggacaaagcyttctccgataggaacaccctcatcatctacctggacaaggtctcacactctgaggatgactgtctagctttcaaagttcaccaatactttaatgtagagc

SEQ ID NO: 12714 - DNA, 201 bp, Homo sapiens
cacagcaggtcttctccactgagtttgaggtgaaggagtacgtgctgcccagtttcgaggtcatagtggagcctacagagaaattctactacatctataaygagaagggcctggaggtcaccatcaccgccaggttcctctacgggaagaaagtggagggaactgcctttgtcatcttcgggatccaggatggcgaacaga

SEQ ID NO: 12715 - DNA, 201 bp, Homo sapiens
tcatcttcgggatccaggatggcgaacagaggatttccctgcctgaatccctcaagcgcattccgattgaggatggctcgggggaggttgtgctgagccgraaggtactgctggacggggtgcagaacccccgagcagaagacctggtggggaagtctttgtacgtgtctgccaccgtcatcttgcactcaggcagtgaca

SEQ ID NO: 12716 - DNA, 201 bp, Homo sapiens
aggctaccaggaccatgcaggctctgccctacagcaccgtgggcaactccaacaattacctgcatctctcagtgctacgtacagagctcagacccggggasaccctcaacgtcaacttcctcctgcgaatggaccgcgcccacgaggccaagatccgctactacacctacctgatcatgaacaagggcaggctgttgaagg

SEQ ID NO: 12717 - DNA, 134 bp, Homo sapiens
actcctccccatcctctccctctgtccctctgtscctctgaccctgcactgtcccagcaccatgggacccacctcaggtcccagcctgctgctcctgctactaacccacctccccctggctctggggagtccca

SEQ ID NO: 12718 - DNA, 201 bp, Homo sapiens
agaaacactacctcatgtggggtctctcctccgatttctggggagagaagcccaacctcagctacatcatcgggaaggacacttgggtggagcactggccygaggaggacgaatgccaagacgaagagaaccagaaacaatgccaggacctcggcgccttcaccgagagcatggttgtctttgggtgccccaactgaccac

SEQ ID NO: 12719 - DNA, 201 bp, Homo sapiens
tctgcagcctggccaccaccaagaggcgtcaccagcagaccgtaaccatcccccccaagtcctcgttgtccgttccatatgtcatcgtgccgctaaagacyggcctgcaggaagtggaagtcaaggctgccgtctaccatcatttcatcagtgacggtgtcaggaagtccctgaaggtcgtgccggaaggaatcagaatga

SEQ ID NO: 12720 - DNA, 201 bp, Homo sapiens
tcctccgatttctggggagagaagcccaacctcagctacatcatcgggaaggacacttgggtggagcactggcccgaggaggacgaatgccaagacgaagrgaaccagaaacaatgccaggacctcggcgccttcaccgagagcatggttgtctttgggtgccccaactgaccacacccccattcccccactccagataaa

SEQ ID NO: 12721 - DNA, 201 bp, Homo sapiens
accgctgggaggaccctggtaagcagctctacaacgtggaggccacatcctatgccctcttggccctactgcagctaaaagactttgactttgtgcctccmgtcgtgcgttggctcaatgaacagagatactacggtggtggctatggctctacccaggcaagccaccttcatggtgttccaagccttggctcaataccaa

SEQ ID NO: 12722 - DNA, 201 bp, Homo sapiens
caactgaccacacccccattcccccactccagataaagcttcagttatatctcacgtgtctggagttctttgccaagagggagaggctgaaatccccagcygcctcacctgcagctcagctccatcctacttgaaacctcacctgttcccaccgcattttctcctggcgttcgcctgctagtgtgctgacttctttagcca

SEQ ID NO: 12723 - DNA, 201 bp, Homo sapiens
ccaagatccgctactacacctacctgatcatgaacaagggcaggctgttgaaggcgggacgccaggtgcgagagcccggccaggacctggtggtgctgccmctgtccatcaccaccgacttcatcccttccttccgcctggtggcgtactacacgctgatcggtgccagcggccagagggaggtggtggccgactccgtgt

SEQ ID NO: 12724 - DNA, 201 bp, Homo sapiens
aaggaatcagaatgaacaaaactgtggctgttcgcaccctggatccagaacgcctgggccgtgaaggagtgcagaaagaggacatcccacctgcagacctyagtgaccaagtcccggacaccgagtctgagaccagaattctcctgcaagggaccccagtggcccagatgacagaggatgccgtcgacgcggaacggctga

SEQ ID NO: 12725 - DNA, 201 bp, Homo sapiens
acgttgaggacttgaaagagccaccgaaaaatggaatctctacgaagctcatgaatatatttttgaaagactccatcaccacgtgggagattctggctgtsagcatgtcggacaagaaagggatctgtgtggcagaccccttcgaggtcacagtaatgcaggacttcttcatcgacctgcggctaccctactctgttgttc

SEQ ID NO: 12726 - DNA, 201 bp, Homo sapiens
acttgaaagagccaccgaaaaatggaatctctacgaagctcatgaatatatttttgaaagactccatcaccacgtgggagattctggctgtgagcatgtcrgacaagaaagggatctgtgtggcagaccccttcgaggtcacagtaatgcaggacttcttcatcgacctgcggctaccctactctgttgttcgaaacgagc

SEQ ID NO: 12727 - DNA, 201 bp, Homo sapiens
gctgtccagtgagaagactgtgctgacccctgccaccaaccacatgggcaacgtcaccttcacgatcccagccaacagggagttcaagtcagaaaaggggsgcaacaagttcgtgaccgtgcaggccaccttcgggacccaagtggtggagaaggtggtgctggtcagcctgcagagcgggtacctcttcatccagacaga

SEQ ID NO: 12728 - DNA, 201 bp, Homo sapiens
tgctgcccagtttcgaggtcatagtggagcctacagagaaattctactacatctataacgagaagggcctggaggtcaccatcaccgccaggttcctctaygggaagaaagtggagggaactgcctttgtcatcttcgggatccaggatggcgaacagaggatttccctgcctgaatccctcaagcgcattccgattgagg

SEQ ID NO: 12729 - DNA, 201 bp, Homo sapiens
tggtggcgtactacacgctgatcggtgccagcggccagagggaggtggtggccgactccgtgtgggtggacgtcaaggactcctgcgtgggctcgctggtrgtaaaaagcggccagtcagaagaccggcagcctgtacctgggcagcagatgaccctgaagatagagggtgaccacggggcccgggtggtactggtggccg

SEQ ID NO: 12730 - DNA, 201 bp, Homo sapiens
aggatttccctgcctgaatccctcaagcgcattccgattgaggatggctcgggggaggttgtgctgagccggaaggtactgctggacggggtgcagaaccyccgagcagaagacctggtggggaagtctttgtacgtgtctgccaccgtcatcttgcactcaggcagtgacatggtgcaggcagagcgcagcgggatcccc

SEQ ID NO: 12731 - DNA, 201 bp, Homo sapiens
accagcagaccgtaaccatcccccccaagtcctcgttgtccgttccatatgtcatcgtgccgctaaagaccggcctgcaggaagtggaagtcaaggctgcygtctaccatcatttcatcagtgacggtgtcaggaagtccctgaaggtcgtgccggaaggaatcagaatgaacaaaactgtggctgttcgcaccctggatc

SEQ ID NO: 12732 - DNA, 201 bp, Homo sapiens
ccctgtccatcaccaccgacttcatcccttccttccgcctggtggcgtactacacgctgatcggtgccagcggccagagggaggtggtggccgactccgtktgggtggacgtcaaggactcctgcgtgggctcgctggtggtaaaaagcggccagtcagaagaccggcagcctgtacctgggcagcagatgaccctgaaga

SEQ ID NO: 12733 - DNA, 201 bp, Homo sapiens; identical to SEQ ID NO: 12713

SEQ ID NO: 12734 - DNA, 201 bp, Homo sapiens; identical to SEQ ID NO: 12712

SEQ ID NO: 12735 - DNA, 201 bp, Homo sapiens; identical to SEQ ID NO: 12714

SEQ ID NO: 12736 - DNA, 201 bp, Homo sapiens; identical to SEQ ID NO: 12715

SEQ ID NO: 12737 - DNA, 201 bp, Homo sapiens; identical to SEQ ID NO: 12718

SEQ ID NO: 12738 - DNA, 201 bp, Homo sapiens; identical to SEQ ID NO: 12716

SEQ ID NO: 12739 - DNA, 134 bp, Homo sapiens; identical to SEQ ID NO: 12717

SEQ ID NO: 12740 - DNA, 201 bp, Homo sapiens; identical to SEQ ID NO: 12719

SEQ ID NO: 12741 - DNA, 201 bp, Homo sapiens; identical to SEQ ID NO: 12720

SEQ ID NO: 12742 - DNA, 201 bp, Homo sapiens
accgctgggaggaccctggtaagcagctctacaacgtggaggccacatcctatgccctcttggccctactgcagctaaaagactttgactttgtgcctccmgtcgtgcgttggctcaatgaacagagatactacggtggtggctatggctctacccaggccaccttcatggtgttccaagccttggctcaataccaaaagg

SEQ ID NO: 12743 - DNA, 201 bp, Homo sapiens; identical to SEQ ID NO: 12722

SEQ ID NO: 12744 - DNA, 201 bp, Homo sapiens; identical to SEQ ID NO: 12723

SEQ ID NO: 12745 - DNA, 201 bp, Homo sapiens; identical to SEQ ID NO: 12724

SEQ ID NO: 12746 - DNA, 201 bp, Homo sapiens; identical to SEQ ID NO: 12725

SEQ ID NO: 12747 - DNA, 201 bp, Homo sapiens; identical to SEQ ID NO: 12726

SEQ ID NO: 12748 - DNA, 201 bp, Homo sapiens; identical to SEQ ID NO: 12727

SEQ ID NO: 12749 - DNA, 201 bp, Homo sapiens; identical to SEQ ID NO: 12728

SEQ ID NO: 12750 - DNA, 201 bp, Homo sapiens; identical to SEQ ID NO: 12729

SEQ ID NO: 12751 - DNA, 201 bp, Homo sapiens; identical to SEQ ID NO: 12730

SEQ ID NO: 12752 - DNA, 201 bp, Homo sapiens; identical to SEQ ID NO: 12731

SEQ ID NO: 12753 - DNA, 201 bp, Homo sapiens; identical to SEQ ID NO: 12732

SEQ ID NO: 12754 - DNA, 201 bp, Homo sapiens
ctatatgacatggagttcaaagaagtcaactcttctctgcacctcggccatgccggaagttccccacatgccctcgcctctcctgccttttccaccatctkctccttcttcaacaacaacaccgtggctgttgaagaaagcgtacctagtggaatagcatggatgaatgacactgccagcaccatcccacctccagccact

SEQ ID NO: 12755 - DNA, 106 bp, Homo sapiens
cacacrcacacatacacagaatcctcagataacaggaggcaataaatccaacagcacatccacgttcagagaacagtgtccctgctgtcttgctaacagctgccaa

SEQ ID NO: 12756 - DNA, 201 bp, Homo sapiens
cagggcttggccttgccataggcatggtggattcttctatgatgcccatcatggggcacctggtggatctacgccacacctcggtgtatgggagtgtctaygccatcgctgatgtggctttttgcatgggctttgctataggtccatccaccggtggtgccattgtaaaggccatcggttttccctggctcatggtcatca

SEQ ID NO: 12757 - DNA, 201 bp, Homo sapiens
ctcttccataaaggctgcaggagacctgtagctgtcacaggaccttccctaagagcccgcaggggaagactgccccagtccggccatcaccatgctccggmccattctggatgctccccagcggttgctgaaggaggggagagcgtcccggcagctggtgctggtggtggtattcgtcgctttgctcctggacaacatgct

SEQ ID NO: 12758 - DNA, 201 bp, Homo sapiens
gttggccaacaagatgggtcggtggctgtgttccctaatcgggatgctggtagtaggtaccagcttgctctgtgttcctctggctcacaatatttttggtvtcattggccccaatgcagggcttggccttgccataggcatggtggattcttctatgatgcccatcatggggcacctggtggatctacgccacacctcggt

SEQ ID NO: 12759 - DNA, 201 bp, Homo sapiens
tgccagcaccatcccacctccagccactgaagccatctcagctcataaaaacaactgcttgcaaggcacaggtttcttggaggaagagactacccgggtcrgggttctgtttgcttcaaaggctgtgatgcaacttctggtcaacccattcgtgggccctctcaccaacaggattggatatcatatccccatgtttgctgg

SEQ ID NO: 12760 - DNA, 201 bp, Homo sapiens
ggccagtgtctacactgatgaccatgagagaggacgagccatgggaactgctctggggggcctggccttggggttgctggtgggagctccctttggaagtrtaatgtacgagtttgttgggaagtctgcacccttcctcatcctggccttcctggcactactggatggagcactccagctttgcatcctacagccttccaa

SEQ ID NO: 12761 - DNA, 164 bp, Homo sapiens
tagaagaaagacagaaaaaataactgattagacccaagatttcatgggaagaagttaaaagaaactgccttgaaatccctcctgattgtagatttcctaayaggaggggtgtaatgtgacattgttcatacttgctaataaatacattattgcctaattcagac

SEQ ID NO: 12762 - DNA, 201 bp, Homo sapiens
acaccaacatgggctccaagtgagtttccttcgtctgggcagactccctcccctcttccataaaggctgcaggagacctgtagctgtcacaggaccttccstaagagcccgcaggggaagactgccccagtccggccatcaccatgctccggaccattctggatgctccccagcggttgctgaaggaggggagagcgtccc

SEQ ID NO: 12763 - DNA, 201 bp, Homo sapiens
catgccggaagttccccacatgccctcgcctctcctgccttttccaccatcttctccttcttcaacaacaacaccgtggctgttgaagaaagcgtacctastggaatagcatggatgaatgacactgccagcaccatcccacctccagccactgaagccatctcagctcataaaaacaactgcttgcaaggcacaggtttc

SEQ ID NO: 12764 - DNA, 201 bp, Homo sapiens
tgtatgcaacccagaagcccacgaaggaatttcctctgggggaggacagtgatgaggagcctgaccatgaggagtagcagcagaaggtgctccttgaattmatgatgcctcagtgaccacctctttccctgggaccagatcaccatggctgagcccacggctcagtgggcttcacatacctctgcctgggaatcttctttc

SEQ ID NO: 12765 - DNA, 201 bp, Homo sapiens
ccattgtaaaggccatcggttttccctggctcatggtcatcactggggtcatcaacatcgtctatgctccactctgctactacctgcggagccccccggcraaggaagagaagcttgctattctgagtcaggactgccccatggagacccggatgtatgcaacccagaagcccacgaaggaatttcctctgggggaggaca

SEQ ID NO: 12766 - DNA, 201 bp, Homo sapiens
gagactacccgggtcggggttctgtttgcttcaaaggctgtgatgcaacttctggtcaacccattcgtgggccctctcaccaacaggattggatatcatayccccatgtttgctggctttgttatcatgtttctctccacagttatgtttgctttttctgggacctatactctactctttgtggcccgaacccttcaaggc

SEQ ID NO: 12767 - DNA, 201 bp, Homo sapiens
atgaatgacactgccagcaccatcccacctccagccactgaagccatctcagctcataaaaacaactgcttgcaaggcacaggtttcttggaggaagagaytacccgggtcggggttctgtttgcttcaaaggctgtgatgcaacttctggtcaacccattcgtgggccctctcaccaacaggattggatatcatatcccc

SEQ ID NO: 12768 - DNA, 201 bp, Homo sapiens
tctacactgatgaccatgagagaggacgagccatgggaactgctctggggggcctggccttggggttgctggtgggagctccctttggaagtgtaatgtaygagtttgttgggaagtctgcacccttcctcatcctggccttcctggcactactggatggagcactccagctttgcatcctacagccttccaaagtctctc

SEQ ID NO: 12769 - DNA, 201 bp, Homo sapiens; identical to SEQ ID NO: 12754

SEQ ID NO: 12770 - DNA, 106 bp, Homo sapiens; identical to SEQ ID NO: 12755

SEQ ID NO: 12771 - DNA, 201 bp, Homo sapiens; identical to SEQ ID NO: 12756

SEQ ID NO: 12772 - DNA, 201 bp, Homo sapiens; identical to SEQ ID NO: 12757

SEQ ID NO: 12773 - DNA, 201 bp, Homo sapiens; identical to SEQ ID NO: 12758

SEQ ID NO: 12774 - DNA, 201 bp, Homo sapiens; identical to SEQ ID NO: 12759

SEQ ID NO: 12775 - DNA, 201 bp, Homo sapiens; identical to SEQ ID NO: 12760

SEQ ID NO: 12776 - DNA, 164 bp, Homo sapiens; identical to SEQ ID NO: 12761

SEQ ID NO: 12777 - DNA, 201 bp, Homo sapiens; identical to SEQ ID NO: 12762

SEQ ID NO: 12778 - DNA, 201 bp, Homo sapiens; identical to SEQ ID NO: 12763

SEQ ID NO: 12779 - DNA, 201 bp, Homo sapiens; identical to SEQ ID NO: 12764

SEQ ID NO: 12780 - DNA, 201 bp, Homo sapiens; identical to SEQ ID NO: 12765

SEQ ID NO: 12781 - DNA, 201 bp, Homo sapiens; identical to SEQ ID NO: 12766

SEQ ID NO: 12782 - DNA, 201 bp, Homo sapiens; identical to SEQ ID NO: 12767

SEQ ID NO: 12783 - DNA, 201 bp, Homo sapiens; identical to SEQ ID NO: 12768

SEQ ID NO: 12784 - DNA, 201 bp, Homo sapiens
caagacccctatctctaaaaagaataaaaaattaaacaaattttaaaataaaaaataacttttaaaagaaggctctcatgcccccttagtaatgctttctkatcactgtggtgagttctagaatacttggctttctctgactcaagtaaatgggtttttgagcaccctgaaaccctctacgcctgggagggggcctgcgtc

SEQ ID NO: 12785 - DNA, 201 bp, Homo sapiens
cggtgaaggtccagcactcgggtgcctactggtgccaggggaccaacagtgtgggcaagggccgttcgcctctcagcaccctcaccgtctactatagcccrgagaccatcggcaggcgagtggctgtgggactcgggtcctgcctcgccatcctcatcctggcaatctgtgggctcaagctccagcgacgttggaagagga

SEQ ID NO: 12786 - DNA, 201 bp, Homo sapiens
aaaaggttagaagggcccccctctctgaagacccccactccctgggatgctacaatccaatgatggaagatggcattagctacaccaccctgcgctttccmgagatgaacataccacgaactggagatgcagagtcctcagagatgcagagacctcccccggactgcgatgacacggtcacttattcagcattgcacaagc

SEQ ID NO: 12787 - DNA, 201 bp, Homo sapiens
  misc_feature (1)...(201): n = A,T,C or G, or insertion/deletion polymorphism (see Tables 1-2)
tggaagaggacacagagccagcaggggcttcaggagaattccagcggccagagcttctttgtgaggaataaaaaggttagaagggcccccctctctgaagncccccactccctgggatgctacaatccaatgatggaagatggcattagctacaccaccctgcgctttcccgagatgaacataccacgaactggagatgca

SEQ ID NO: 12788 - DNA, 201 bp, Homo sapiens
cgagattcactctggaaactcggtcagcctccaatgtgacttctcaagcagccaccccaaagaagtccagttcttctgggagaaaaatggcaggcttctgrggaaagaaagccagctgaattttgactccatctccccagaagatgctgggagttacagctgctgggtgaacaactccataggacagacagcgtccaaggc

SEQ ID NO: 12789 - DNA, 201 bp, Homo sapiens
caatcctcttccaacaaattacacgtggtaccacaatgggaaagaaatgcagggaaggacagaggagaaagtccacatcccaaagatcctcccctggcacrctgggacttattcctgtgtggcagaaaacattcttggtactggacagaggggcccgggagctgagctggatgtccagtatcctcccaagaaggtgaccac

SEQ ID NO: 12790 - DNA, 201 bp, Homo sapiens
aaaccctctacgcctgggagggggcctgcgtctggatcccctgcacctacagagccctagatggtgacctggaaagcttcatcctgttccacaatcctgartataacaagaacacctcgaagtttgatgggacaagactctatgaaagcacaaaggatgggaaggttccttctgagcagaaaagggtgcaattcctgggag

SEQ ID NO: 12791 - DNA, 201 bp, Homo sapiens
agaggagaaagtccacatcccaaagatcctcccctggcacgctgggacttattcctgtgtggcagaaaacattcttggtactggacagaggggcccgggarctgagctggatgtccagtatcctcccaagaaggtgaccacagtgattcaaaaccccatgccgattcgagaaggagacacagtgaccctttcctgtaacta

SEQ ID NO: 12792 - DNA, 201 bp, Homo sapiens
cactgggggcagcgggggccagggaagtccccgagtttccccagacaccgccacatggcttcctcctgcgcgcatgtgcgcacacacacacacacacgcasacacacacacacacactcactgcggagaaccttgtgcctggctcagagccagtctttttggtgagggtaaccccaaacctccaaaactcctgcccctgtt

SEQ ID NO: 12793 - DNA, 201 bp, Homo sapiens
ggatgggctgcagcagaggcactgggggcagcgggggccagggaagtccccgagtttccccagacaccgccacatggcttcctcctgcgcgcatgtgcgcrcacacacacacacacgcacacacacacacacacactcactgcggagaaccttgtgcctggctcagagccagtctttttggtgagggtaaccccaaacctc

SEQ ID NO: 12794 - DNA, 201 bp, Homo sapiens
ttacccggtatgaatggaaaccccatggcgcctgggaggagccatcgcttggggtgctgaagatccaaaacgttggctgggacaacacaaccatcgcctgygcagcttgtaatagttggtgctcgtgggcctcccctgtcgccctgaatgtccagtatgccccccgagacgtgagggtccggaaaatcaagcccctttccg

SEQ ID NO: 12795 - DNA, 201 bp, Homo sapiens
gaaagtccacatcccaaagatcctcccctggcacgctgggacttattcctgtgtggcagaaaacattcttggtactggacagaggggcccgggagctgagytggatgtccagtatcctcccaagaaggtgaccacagtgattcaaaaccccatgccgattcgagaaggagacacagtgaccctttcctgtaactacaattc

SEQ ID NO: 12796 - DNA, 201 bp, Homo sapiens
cccagcactttgggaggccaaggcgggaggatcacttgaggtcaggagttcaagaccagcctggccaacatggcgaaaccctgtctctactagaaatacaraaaaattagctgggtgtggtggtgggcacctgtaatcccagctactcgggaggctgaggcaggaggatcacttgaactggggaggtagaggttacagcga

SEQ ID NO: 12797 - DNA, 201 bp, Homo sapiens
aaagcaggactggagagaggtggaatgaagtggcaaggggttcctgaggggtgatttgggacaggacatctaaagccaggtgtacgctcacgtcctcagtsccccaggctcctgcacgggctctgttcttttgcagaaaggccttttccacctcatatccagctccctccagaaattcaagagtcccaggaagtcactctg

SEQ ID NO: 12798 - DNA, 201 bp, Homo sapiens
agtcaccatgggaagattgtgacctgccagcttcaggatgcagatgggaagttcctctccaatgacacggtgcagctgaacgtgaagcgtgagtctccccrgcatgcctgtgggaagggcaaggtctgtgtcaccttctccccagccccgcagggggcatgcacccagggcagggggaagcctgcacagacggcggcatcc

SEQ ID NO: 12799 - DNA, 201 bp, Homo sapiens
cggtgaaggtccagcactcgggtgcctactggtgccaggggaccaacagtgtgggcaagggccgttcgcctctcagcaccctcaccgtctactatagcccrgagaccatcggcaggcgagtggctgtgggactcgggtcctgcctcgccatcctcatcctggcaatctgtgggctcaagctccagcgacgagatgcagagt

SEQ ID NO: 12800 - DNA, 201 bp, Homo sapiens; identical to SEQ ID NO: 12789

SEQ ID NO: 12801 - DNA, 201 bp, Homo sapiens; identical to SEQ ID NO: 12790

SEQ ID NO: 12802 - DNA, 201 bp, Homo sapiens; identical to SEQ ID NO: 12791

SEQ ID NO: 12803 - DNA, 201 bp, Homo sapiens; identical to SEQ ID NO: 12794

SEQ ID NO: 12804 - DNA, 201 bp, Homo sapiens; identical to SEQ ID NO: 12795

SEQ ID NO: 12805 - DNA, 201 bp, Homo sapiens; identical to SEQ ID NO: 12788

SEQ ID NO: 12806 - DNA, 201 bp, Homo sapiens; identical to SEQ ID NO: 12785

SEQ ID NO: 12807 - DNA, 201 bp, Homo sapiens; identical to SEQ ID NO: 12786

SEQ ID NO: 12808 - DNA, 177 bp, Homo sapiens
ggactgcgttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcttacacctgtaatcccagc

SEQ ID NO: 12809 - DNA, 201 bp, Homo sapiens; identical to SEQ ID NO: 12787
  misc_feature (1)...(201): n = A,T,C or G, or insertion/deletion polymorphism (see Tables 1-2)

SEQ ID NO: 12810 - DNA, 201 bp, Homo sapiens; identical to SEQ ID NO: 12796

SEQ ID NO: 12811 - DNA, 201 bp, Homo sapiens; identical to SEQ ID NO: 12797

SEQ ID NO: 12812 - DNA, 201 bp, Homo sapiens; identical to SEQ ID NO: 12794

SEQ ID NO: 12813 - DNA, 201 bp, Homo sapiens; identical to SEQ ID NO: 12788

SEQ ID NO: 12814 - DNA, 201 bp, Homo sapiens; identical to SEQ ID NO: 12785

SEQ ID NO: 12815 - DNA, 201 bp, Homo sapiens; identical to SEQ ID NO: 12786

SEQ ID NO: 12816 - DNA, 201 bp, Homo sapiens; identical to SEQ ID NO: 12787
  misc_feature (1)...(201): n = A,T,C or G, or insertion/deletion polymorphism (see Tables 1-2)

SEQ ID NO: 12817 - DNA, 201 bp, Homo sapiens; identical to SEQ ID NO: 12788

SEQ ID NO: 12818 - DNA, 201 bp, Homo sapiens; identical to SEQ ID NO: 12789

SEQ ID NO: 12819 - DNA, 201 bp, Homo sapiens; identical to SEQ ID NO: 12790

SEQ ID NO: 12820 - DNA, 201 bp, Homo sapiens; identical to SEQ ID NO: 12791

SEQ ID NO: 12821 - DNA, 201 bp, Homo sapiens; identical to SEQ ID NO: 12792

SEQ ID NO: 12822 - DNA, 201 bp, Homo sapiens; identical to SEQ ID NO: 12793

SEQ ID NO: 12823 - DNA, 201 bp, Homo sapiens; identical to SEQ ID NO: 12795

SEQ ID NO: 12824 - DNA, 201 bp, Homo sapiens; identical to SEQ ID NO: 12794

SEQ ID NO: 12825 - DNA, 201 bp, Homo sapiens; identical to SEQ ID NO: 12785

SEQ ID NO: 12826 - DNA, 201 bp, Homo sapiens; identical to SEQ ID NO: 12786

SEQ ID NO: 12827 - DNA, 201 bp, Homo sapiens; identical to SEQ ID NO: 12789

SEQ ID NO: 12828 - DNA, 201 bp, Homo sapiens; identical to SEQ ID NO: 12790

SEQ ID NO: 12829 - DNA, 201 bp, Homo sapiens; identical to SEQ ID NO: 12787
  misc_feature (1)...(201): n = A,T,C or G, or insertion/deletion polymorphism (see Tables 1-2)

SEQ ID NO: 12830 - DNA, 201 bp, Homo sapiens; identical to SEQ ID NO: 12791

SEQ ID NO: 12831 - DNA, 201 bp, Homo sapiens; identical to SEQ ID NO: 12794

SEQ ID NO: 12832 - DNA, 201 bp, Homo sapiens; identical to SEQ ID NO: 12795

SEQ ID NO: 12833 - DNA, 201 bp, Homo sapiens; identical to SEQ ID NO: 12788

SEQ ID NO: 12834 - DNA, 201 bp, Homo sapiens; identical to SEQ ID NO: 12789

SEQ ID NO: 12835 - DNA, 201 bp, Homo sapiens
aaaaggttagaagggcccccctctctgaaggcccccactccctgggatgctacaatccaatgatggaagatggcattagctacaccaccctgcgctttccmgagatgaacataccacgaactggagatgcagagtcctcagagatgcagagacctccccggacctgcgatgacacggtcacttattcagcattgcacaagc

SEQ ID NO: 12836 - DNA, 201 bp, Homo sapiens
ttacccggtatgaatggaaaccccatggcgcctgggaggagccatcgcttggggtgctgaagatccaaaacgttggctgggacaacacaaccatcgcctgygcacgttgtaatagttggtgctcgtgggcctcccctgtcgccctgaatgtccagtatgccccccgagacgtgagggtccggaaaatcaagcccctttccg

SEQ ID NO: 12837 - DNA, 201 bp, Homo sapiens
cggtgaaggtccagcactcgggtgcctactggtgccaggggaccaacagtgtgggcaagggccgttcgcctctcagcacccttactgtctactatagcccrgagaccatcggcaggcgagtggctgtgggactcgggtcctgcctcgccatcctcatcctggcaatctgtgggctcaagctccagcgacgttggaagagga

SEQ ID NO: 12838 - DNA, 201 bp, Homo sapiens; identical to SEQ ID NO: 12788

SEQ ID NO: 12839 - DNA, 201 bp, Homo sapiens
cactgggggcagcgggggccagggaagtccccgagtttccccagacaccgccacatggcttcctcctgcgtgcatgtgcgcacacacacacacacacgcasacacacacacacacactcactgcggagaaccttgtgcctggctcagagccagtctttttggtgagggtaaccccaaacctccaaaactcctgcccctgtt

SEQ ID NO: 12840 - DNA, 201 bp, Homo sapiens
ggatgggctgcagcagaggcactgggggcagcgggggccagggaagtccccgagtttccccagacaccgccacatggcttcctcctgcgtgcatgtgcgcrcacacacacacacacgcacacacacacacacacactcactgcggagaaccttgtgcctggctcagagccagtctttttggtgagggtaaccccaaacctc

SEQ ID NO: 12841 - DNA, 201 bp, Homo sapiens; identical to SEQ ID NO: 12787
  misc_feature (1)...(201): n = A,T,C or G, or insertion/deletion polymorphism (see Tables 1-2)

SEQ ID NO: 12842 - DNA, 201 bp, Homo sapiens; identical to SEQ ID NO: 12791

SEQ ID NO: 12843 - DNA, 201 bp, Homo sapiens; identical to SEQ ID NO: 12795

SEQ ID NO: 12844 - DNA, 201 bp, Homo sapiens; identical to SEQ ID NO: 12790

SEQ ID NO: 12845 - DNA, 201 bp, Homo sapiens
ctgcagtcaatgatcaccgctgtgggcatccctgaggtcatgtctcggctcgaggtagtgtttacagccctcatgaacagcaaaggcgtgagcctcttcgrcatcatcaaccctgagattatcactcgagatggcttcctgctgctgcagatggactttggcttccctgagcacctgctggtggatttcctccagagcttg

SEQ ID NO: 12846 - DNA, 201 bp, Homo sapiens
ccaggcctcctattctaagaaaaagctcttcttaagcctcttggatttccagattacaccaaagactgtttccaacttgactgagagcagctccgagtccrtccagagcttcctgcagtcaatgatcaccgctgtgggcatccctgaggtcatgtctcggctcgaggtagtgtttacagccctcatgaacagcaaaggcgt

SEQ ID NO: 12847 - DNA, 201 bp, Homo sapiens
tctacaagaatgtctcagaggacctccccctccccaccttctcgcccacactgctgggggactcccgcatgctgtacttctggttctctgagcgagtcttycactcgctggccaaggtagctttccaggatggccgcctcatgctcagcctgatgggagacgagttcaaggcagtgctggagacctggggcttcaacacca

SEQ ID NO: 12848 - DNA, 201 bp, Homo sapiens
tgcctggtggctgggtattgatcagtccattgacttcgagatcgactctgccattgacctccagatcaacacacagctgacctgtgactctggtagagtgyggaccgatgcccctgactgctacctgtctttccataagctgctcctgcatctccaaggggagcgagagcctgggtggatcaagcagctgttcacaaattt

SEQ ID NO: 12849 - DNA, 201 bp, Homo sapiens
agctgacctgtgactctggtagagtgcggaccgatgcccctgactgctacctgtctttccataagctgctcctgcatctccaaggggagcgagagcctggrtggatcaagcagctgttcacaaatttcatctccttcaccctgaagctggtcctgaagggacagatctgcaaagagatcaacgtcatctctaacatcatgg

SEQ ID NO: 12850 - DNA, 201 bp, Homo sapiens
atatacgggctccaggctgaacggctcgggccacttacacaccactgcctgataaccatgctggctgccacagtcctgaccctggccctgctgggcaatgsccatgcctgctccaaaggcacctcgcacgaggcaggcatcgtgtgccgcatcaccaagcctgccctcctggtgttgaaccacgagactgccaaggtgatc

SEQ ID NO: 12851 - DNA, 201 bp, Homo sapiens
ctgccagcatcctttcagatggagacattggggtggacatttccctgacaggtgatcccgtcatcacagcctcctacctggagtcccatcacaagggtcayttcatctacaagaatgtctcagaggacctccccctccccaccttctcgcccacactgctgggggactcccgcatgctgtacttctggttctctgagcgag

SEQ ID NO: 12852 - DNA, 166 bp, Homo sapiens
gtgaatctctggggccaggaagaccctgctgcccggaagagcctcatgttccgtgggggctgggcrgacatacatatacgggctccaggctgaacggctcgggccacttacacaccactgcctgataaccatgctggctgccacagtcctgaccctggccctgctg

SEQ ID NO: 12853 - DNA, 201 bp, Homo sapiens
tcatttcatctacaagaatgtctcagaggacctccccctccccaccttctcgcccacactgctgggggactcccgcatgctgtacttctggttctctgagygagtcttccactcgctggccaaggtagctttccaggatggccgcctcatgctcagcctgatgggagacgagttcaaggcagtgctggagacctggggctt

SEQ ID NO: 12854 - DNA, 201 bp, Homo sapiens
ggctcgggccacttacacaccactgcctgataaccatgctggctgccacagtcctgaccctggccctgctgggcaatgcccatgcctgctccaaaggcacmtcgcacgaggcaggcatcgtgtgccgcatcaccaagcctgccctcctggtgttgaaccacgagactgccaaggtgatccagaccgccttccagcgagcca

SEQ ID NO: 12855 - DNA, 201 bp, Homo sapiens
cgtccagagcttcctgcagtcaatgatcaccgctgtgggcatccctgaggtcatgtctcggctcgaggtagtgtttacagccctcatgaacagcaaaggcrtgagcctcttcgacatcatcaaccctgagattatcactcgagatggcttcctgctgctgcagatggactttggcttccctgagcacctgctggtggattt

SEQ ID NO: 12856 - DNA, 201 bp, Homo sapiens
ccataagctgctcctgcatctccaaggggagcgagagcctgggtggatcaagcagctgttcacaaatttcatctccttcaccctgaagctggtcctgaagkgacagatctgcaaagagatcaacgtcatctctaacatcatggccgattttgtccagacaagggctgccagcatcctttcagatggagacattggggtgga

SEQ ID NO: 12857 - DNA, 201 bp, Homo sapiens
actcccgcatgctgtacttctggttctctgagcgagtcttccactcgctggccaaggtagctttccaggatggccgcctcatgctcagcctgatgggagaygagttcaaggcagtgctggagacctggggcttcaacaccaaccaggaaatcttccaagaggttgtcggcggcttccccagccaggcccaagtcaccgtcc

SEQ ID NO: 12858 - DNA, 201 bp, Homo sapiens
ggtagctttccaggatggccgcctcatgctcagcctgatgggagacgagttcaaggcagtgctggagacctggggcttcaacaccaaccaggaaatcttcyaagaggttgtcggcggcttccccagccaggcccaagtcaccgtccactgcctcaagatgcccaagatctcctgccaaaacaagggagtcgtggtcaattc

SEQ ID NO: 12859 - DNA, 201 bp, Homo sapiens
ggatcaagcagctgttcacaaatttcatctccttcaccctgaagctggtcctgaagggacagatctgcaaagagatcaacgtcatctctaacatcatggcygattttgtccagacaagggctgccagcatcctttcagatggagacattggggtggacatttccctgacaggtgatcccgtcatcacagcctcctacctgg

SEQ ID NO: 12860 - DNA, 201 bp, Homo sapiens
tggccgcctcatgctcagcctgatgggagacgagttcaaggcagtgctggagacctggggcttcaacaccaaccaggaaatcttccaagaggttgtcggcrgcttccccagccaggcccaagtcaccgtccactgcctcaagatgcccaagatctcctgccaaaacaagggagtcgtggtcaattcttcagtgatggtgaa

SEQ ID NO: 12861 - DNA, 201 bp, Homo sapiens
ggtcaattcttcagtgatggtgaaattcctctttccacgcccagaccagcaacattctgtagcttacacatttgaagaggatatcgtgactaccgtccagscctcctattctaagaaaaagctcttcttaagcctcttggatttccagattacaccaaagactgtttccaacttgactgagagcagctccgagtccgtcca

SEQ ID NO: 12862 - DNA, 201 bp, Homo sapiens
gcctcttggatttccagattacaccaaagactgtttccaacttgactgagagcagctccgagtccgtccagagcttcctgcagtcaatgatcaccgctgtrggcatccctgaggtcatgtctcggctcgaggtagtgtttacagccctcatgaacagcaaaggcgtgagcctcttcgacatcatcaaccctgagattatca

SEQ ID NO: 12863 - DNA, 201 bp, Homo sapiens
caaaggcgtgagcctcttcgacatcatcaaccctgagattatcactcgagatggcttcctgctgctgcagatggactttggcttccctgagcacctgctgrtggatttcctccagagcttgagctagaagtctccaaggaggtcgggatggggcttgtagcagaaggcaagcaccaggctcacagctggaaccctggtgtc

SEQ ID NO: 12864 - DNA, 201 bp, Homo sapiens
atccctgaggtcatgtctcggctcgaggtagtgtttacagccctcatgaacagcaaaggcgtgagcctcttcgacatcatcaaccctgagattatcactcragatggcttcctgctgctgcagatggactttggcttccctgagcacctgctggtggatttcctccagagcttgagctagaagtctccaaggaggtcggga

SEQ ID NO: 12865 - DNA, 195 bp, Homo sapiens
tccagagcttgagctagaagtctccaaggaggtcgggatggggcttgtagcagaaggcaagcaccaggctcacagctggaaccctggtgtctcctccagcrtggtggaagttgggttaggagtacggagatggagattggctcccaactcctccctatcctaaaggcccactggcattaaagtgctgtatccaag

SEQ ID NO: 12866 - DNA, 201 bp, Homo sapiens; identical to SEQ ID NO: 12845

SEQ ID NO: 12867 - DNA, 201 bp, Homo sapiens; identical to SEQ ID NO: 12846

SEQ ID NO: 12868 - DNA, 201 bp, Homo sapiens; identical to SEQ ID NO: 12848

SEQ ID NO: 12869 - DNA, 201 bp, Homo sapiens; identical to SEQ ID NO: 12849

SEQ ID NO: 12870 - DNA, 201 bp, Homo sapiens; identical to SEQ ID NO: 12850

SEQ ID NO: 12871 - DNA, 201 bp, Homo sapiens; identical to SEQ ID NO: 12854

SEQ ID NO: 12872 - DNA, 166 bp, Homo sapiens; identical to SEQ ID NO: 12852

SEQ ID NO: 12873 - DNA, 201 bp, Homo sapiens; identical to SEQ ID NO: 12855

SEQ ID NO: 12874 - DNA, 201 bp, Homo sapiens; identical to SEQ ID NO: 12856

SEQ ID NO: 12875 - DNA, 201 bp, Homo sapiens
ttccctgacaggtgatcccgtcatcacagcctcctacctggagtcccatcacaaggcagtgctggagacctggggcttcaacaccaaccaggaaatcttcyaagaggttgtcggcggcttccccagccaggcccaagtcaccgtccactgcctcaagatgcccaagatctcctgccaaaacaagggagtcgtggtcaattc

SEQ ID NO: 12876 - DNA, 201 bp, Homo sapiens; identical to SEQ ID NO: 12859

SEQ ID NO: 12877 - DNA, 201 bp, Homo sapiens
tcccgtcatcacagcctcctacctggagtcccatcacaaggcagtgctggagacctggggcttcaacaccaaccaggaaatcttccaagaggttgtcggcrgcttccccagccaggcccaagtcaccgtccactgcctcaagatgcccaagatctcctgccaaaacaagggagtcgtggtcaattcttcagtgatggtgaa

SEQ ID NO: 12878 - DNA, 201 bp, Homo sapiens; identical to SEQ ID NO: 12861

SEQ ID NO: 12879 - DNA, 201 bp, Homo sapiens; identical to SEQ ID NO: 12862

SEQ ID NO: 12880 - DNA, 201 bp, Homo sapiens; identical to SEQ ID NO: 12863

SEQ ID NO: 12881 - DNA, 201 bp, Homo sapiens; identical to SEQ ID NO: 12864

SEQ ID NO: 12882 - DNA, 195 bp, Homo sapiens; identical to SEQ ID NO: 12865

SEQ ID NO: 12883 - DNA, 201 bp, Homo sapiens
atgggctcctgtgcctctccctatcagttggccagtggagctcgagaacaaactgttgctgccagataaagcagcaaagcctgctccactgcccagcgcargcccccttcccttcctccaccaggctgagtggagaaccctaaagctacgggacaggctcccgttccccgtgcctacacagggtgctggctctggcagaaa

SEQ ID NO: 12884 - DNA, 201 bp, Homo sapiens
gccccgcatcacctgtccgagtgcgaacaccttgggaagggggttcctggtggtcctgtgacaaccagagacccccagggccaaggaggccactgcagccyggcccttctgtgccctgggcccctcctcattgcagcaccacccaccgcaccaccctgggacagaggaaacacatggaggccatagcatagagcctgtctg

SEQ ID NO: 12885 - DNA, 201 bp, Homo sapiens
gtcctcatgtacgtccacgactactacgtgctcaactatgaggccccagcggcagaggcctgagctgcacctgagggcctggcttctcactgccacctcamacccgctgccagagcccacctctcctcctaggcctcgagtgctggggatgggcctggctgcacagcatcctcctctggtcccagggaggcctctctgccc

SEQ ID NO: 12886 - DNA, 201 bp, Homo sapiens
gcctgaatgccgtggctgagctcatgcagtttggagaccgggagttctaccgggactggtggaactccgagtctgtcacctacttctggcagaactggaasatccctgtgcacaagtggtgcatcagacacttctacaagcccatgcttcgacggggcagcagcaagtggatggccaggacaggggtgttcctggcctcgg

SEQ ID NO: 12887 - DNA, 201 bp, Homo sapiens
tgatggctcagatcccactggcctggttcgtgggccgctttttccagggcaactatggcaacgcagctgtgtggctgtcgctcatcatcggacagccaatwgccgtcctcatgtacgtccacgactactacgtgctcaactatgaggccccagcggcagaggcctgagctgcacctgagggcctggcttctcactgccacc

SEQ ID NO: 12888 - DNA, 201 bp, Homo sapiens
caggtggtttctctgttcctgaaggatccctatagctggcccgccccatgcctggttattgcggccaatgtctttgctgtggctgcattccaggttgagargcgcctggcggtgggtgccctgacggagcaggcgggactgctgctgcacgtggccaacctggccaccattctgtgtttcccagcggctgtggtcttactg

SEQ ID NO: 12889 - DNA, 201 bp, Homo sapiens; identical to SEQ ID NO: 12883

SEQ ID NO: 12890 - DNA, 201 bp, Homo sapiens
ccctcaataaagaactgcaagcacatgctggtcctggggagtcgggcaggcacggagctagctgcaagcatccgtcttcccccaggaggccactgcagccyggcccttctgtgccctgggcccctcctcattgcagcaccacccaccgcaccaccctgggacagaggaaacacatggaggccatagcatagagcctgtctg

SEQ ID NO: 12891 - DNA, 201 bp, Homo sapiens; identical to SEQ ID NO: 12885

SEQ ID NO: 12892 - DNA, 201 bp, Homo sapiens
gcctgaatgccgtggctgagctcatgcagtttggagaccgggagttctaccgggactggtggaactccgagtctgtcacctacttctggcagaactggaasatccctgtgcacaagtggtgcatcaggtaggtggggtgtgtgtgtgtgtgatgtggaacatggctgtgaacctgaaccgctttccatgccccctcctctg

SEQ ID NO: 12893 - DNA, 201 bp, Homo sapiens; identical to SEQ ID NO: 12887

SEQ ID NO: 12894 - DNA, 201 bp, Homo sapiens; identical to SEQ ID NO: 12888

SEQ ID NO: 12895 - DNA, 201 bp, Homo sapiens; identical to SEQ ID NO: 12883

SEQ ID NO: 12896 - DNA, 201 bp, Homo sapiens; identical to SEQ ID NO: 12890

SEQ ID NO: 12897 - DNA, 201 bp, Homo sapiens; identical to SEQ ID NO: 12885

SEQ ID NO: 12898 - DNA, 201 bp, Homo sapiens; identical to SEQ ID NO: 12886

SEQ ID NO: 12899 - DNA, 201 bp, Homo sapiens; identical to SEQ ID NO: 12887

SEQ ID NO: 12900 - DNA, 201 bp, Homo sapiens; identical to SEQ ID NO: 12888

SEQ ID NO: 12901 - DNA, 201 bp, Homo sapiens; identical to SEQ ID NO: 12883

SEQ ID NO: 12902 - DNA, 201 bp, Homo sapiens; identical to SEQ ID NO: 12890

SEQ ID NO: 12903 - DNA, 201 bp, Homo sapiens; identical to SEQ ID NO: 12885

SEQ ID NO: 12904 - DNA, 201 bp, Homo sapiens; identical to SEQ ID NO: 12887

SEQ ID NO: 12905 - DNA, 201 bp, Homo sapiens; identical to SEQ ID NO: 12888

SEQ ID NO: 12906 - DNA, 201 bp, Homo sapiens
tttctgccagagccagcaccctgtgtaggcacggggaacgggagcctgtcccgtagctttagggttctccactcagcctggtggaggaagggaagggggcytgcgctgggcagtggagcaggctttgctgctttatctggcagcaacagtttgttctcgagctccactggccaactgatagggagaggcacaggagcccat

SEQ ID NO: 12907 - DNA, 201 bp, Homo sapiens
cagacaggctctatgctatggcctccatgtgtttcctctgtcccagggtggtgcggtgggtggtgctgcaatgaggaggggcccagggcacagaagggccrggctgcagtggcctcctgggggaagacggatgcttgcagctagctccgtgcctgcccgactccccaggaccagcatgtgcttgcagttctttattgaggg

SEQ ID NO: 12908 - DNA, 201 bp, Homo sapiens
taccgtgtgtaccaaatagatggaaactactccgggagctctcacgtggtcctggaccatgagacctacatcctgaatctgacccaggcaaacataccggsagccataccgcactggcagcttctctacagggctcgagaaacctatgggctgcccaacacactgcctaccgcctggcacaacctggtatatcgcatgcgg

SEQ ID NO: 12909 - DNA, 201 bp, Homo sapiens
cactgtctgaagagctggagctggaattattaccgaattgtagccaggtatgagaacaccctggctgctcagttctttggccacactcatgtggatgaatytgaggtcttctatgatgaagagactctgagccggccgctggctgtagccttcctggcacccagtgcaactacctacatcggccttaatcctggttaccgt

SEQ ID NO: 12910 - DNA, 201 bp, Homo sapiens
cactgcctaccgcctggcacaacctggtatatcgcatgcggggcgacatgcaacttttccagaccttctggtttctctaccataagggccacccaccctcrgagccctgtggcacgccctgccgtctggctactctttgtgcccagctctctgcccgtgctgacagccctgctctgtgccgccacctgatgccagatggga

SEQ ID NO: 12911 - DNA, 201 bp, Homo sapiens
gcaccagactcgtcaggaccaactgcgggccctgaccaccgtcacagcacttgtgaggaagttcctggggccagtgccagtgtaccctgctgtgggtaacyatgaaagcacacctgtcaatagcttccctccccccttcattgagggcaaccactcctcccgctggctctatgaagcgatggccaaggcttgggagccctg

SEQ ID NO: 12912 - DNA, 201 bp, Homo sapiens
tggcacaacctggtatatcgcatgcggggcgacatgcaacttttccagaccttctggtttctctaccataagggccacccaccctcggagccctgtggcaygccctgccgtctggctactctttgtgcccagctctctgcccgtgctgacagccctgctctgtgccgccacctgatgccagatgggagcctcccagaggcc

SEQ ID NO: 12913 - DNA, 201 bp, Homo sapiens
gagccctggctgcctgccgaagccctgcgcaccctcagaattggggggttctatgctctttccccataccccggtctccgcctcatctctctcaatatgartttttgttcccgtgagaacttctggctcttgatcaactccacggatcccgcaggacagctccagtggctggtgggggagcttcaggctgctgaggatcga

SEQ ID NO: 12914 - DNA, 201 bp, Homo sapiens
cctgcgcaccctcagaattggggggttctatgctctttccccataccccggtctccgcctcatctctctcaatatgaatttttgttcccgtgagaacttckggctcttgatcaactccacggatcccgcaggacagctccagtggctggtgggggagcttcaggctgctgaggatcgaggagacaaagtgcatataattgg

SEQ ID NO: 12915 - DNA, 201 bp, Homo sapiens
atttgaggtcttctatgatgaagagactctgagccggccgctggctgtagccttcctggcacccagtgcaactacctacatcggccttaatcctggttacygtgtgtaccaaatagatggaaactactccgggagctctcacgtggtcctggaccatgagacctacatcctgaatctgacccaggcaaacataccgggagc

SEQ ID NO: 12916 - DNA, 201 bp, Homo sapiens
accctggagagcctgttgagtgggctgggcccagccggcccttttgatatggtgtactggacaggagacatccccgcacatgatgtctggcaccagactcrtcaggaccaactgcgggccctgaccaccgtcacagcacttgtgaggaagttcctggggccagtgccagtgtaccctgctgtgggtaaccatgaaagcaca

SEQ ID NO: 12917 - DNA, 201 bp, Homo sapiens
tggcacccagtgcaactacctacatcggccttaatcctggttaccgtgtgtaccaaatagatggaaactactccgggagctctcacgtggtcctggaccakgagacctacatcctgaatctgacccaggcaaacataccgggagccataccgcactggcagcttctctacagggctcgagaaacctatgggctgcccaaca

SEQ ID NO: 12918 - DNA, 201 bp, Homo sapiens
cgtcaggaccaactgcgggccctgaccaccgtcacagcacttgtgaggaagttcctggggccagtgccagtgtaccctgctgtgggtaaccatgaaagcayacctgtcaatagcttccctccccccttcattgagggcaaccactcctcccgctggctctatgaagcgatggccaaggcttgggagccctggctgcctgcc

SEQ ID NO: 12919 - DNA, 201 bp, Homo sapiens
gcacccagtgcaactacctacatcggccttaatcctggttaccgtgtgtaccaaatagatggaaactactccgggagctctcacgtggtcctggaccatgwgacctacatcctgaatctgacccaggcaaacataccgggagccataccgcactggcagcttctctacagggctcgagaaacctatgggctgcccaacaca

SEQ ID NO: 12920 - DNA, 201 bp, Homo sapiens
acctacatcctgaatctgacccaggcaaacataccgggagccataccgcactggcagcttctctacagggctcgagaaacctatgggctgcccaacacacygcctaccgcctggcacaacctggtatatcgcatgcggggcgacatgcaacttttccagaccttctggtttctctaccataagggccacccaccctcggag

SEQ ID NO: 12921 - DNA, 201 bp, Homo sapiens
atgggctgcccaacacactgcctaccgcctggcacaacctggtatatcgcatgcggggcgacatgcaacttttccagaccttctggtttctctaccataasggccacccaccctcggagccctgtggcacgccctgccgtctggctactctttgtgcccagctctctgcccgtgctgacagccctgctctgtgccgccacc

SEQ ID NO: 12922 - DNA, 201 bp, Homo sapiens
ttccagaccttctggtttctctaccataagggccacccaccctcggagccctgtggcacgccctgccgtctggctactctttgtgcccagctctctgcccvtgctgacagccctgctctgtgccgccacctgatgccagatgggagcctcccagaggcccagagcctgtggccaaggccactgttttgctagggccccagg

SEQ ID NO: 12923 - DNA, 201 bp, Homo sapiens
gggggagcttcaggctgctgaggatcgaggagacaaagtgcatataattggccacattcccccagggcactgtctgaagagctggagctggaattattacygaattgtagccaggtatgagaacaccctggctgctcagttctttggccacactcatgtggatgaatttgaggtcttctatgatgaagagactctgagccg

SEQ ID NO: 12924 - DNA, 201 bp, Homo sapiens
gctgaggatcgaggagacaaagtgcatataattggccacattcccccagggcactgtctgaagagctggagctggaattattaccgaattgtagccaggtrtgagaacaccctggctgctcagttctttggccacactcatgtggatgaatttgaggtcttctatgatgaagagactctgagccggccgctggctgtagcc

SEQ ID NO: 12925 - DNA, 201 bp, Homo sapiens
tttgaggtcttctatgatgaagagactctgagccggccgctggctgtagccttcctggcacccagtgcaactacctacatcggccttaatcctggttaccktgtgtaccaaatagatggaaactactccgggagctctcacgtggtcctggaccatgagacctacatcctgaatctgacccaggcaaacataccgggagcc

SEQ ID NO: 12926 - DNA, 201 bp, Homo sapiens
ccttttgatatggtgtactggacaggagacatccccgcacatgatgtctggcaccagactcgtcaggaccaactgcgggccctgaccaccgtcacagcacytgtgaggaagttcctggggccagtgccagtgtaccctgctgtgggtaaccatgaaagcacacctgtcaatagcttccctccccccttcattgagggcaac

SEQ ID NO: 12927 - DNA, 201 bp, Homo sapiens
gggagccctggctgcctgccgaagccctgcgcaccctcagaattggggggttctatgctctttccccataccccggtctccgcctcatctctctcaatatraatttttgttcccgtgagaacttctggctcttgatcaactccacggatcccgcaggacagctccagtggctggtgggggagcttcaggctgctgaggatc

SEQ ID NO: 12928 - DNA, 201 bp, Homo sapiens
actgacctgcactgggatcatgactacctggagggcacggaccctgactgtgcagacccactgtgctgccgccggggttctggcctgccgcccgcatcccrgccaggtgccggatactggggcgaatacagcaagtgtgacctgcccctgaggaccctggagagcctgttgagtgggctgggcccagccggcccttttgat

SEQ ID NO: 12929 - DNA, 201 bp, Homo sapiens
gacgggacagacgaaccagccccgtgtaggaagcgcgacaatgccccgctacggagcgtcactccgccagagctgccccaggtccggccgggagcagggayaagacgggaccgccggagcccccggactcctttggatgggcctggtgctggcgctggcgctggcgctggcgctggcgctggctctgtctgactctcgggt

SEQ ID NO: 12930 - DNA, 201 bp, Homo sapiens
aagaaggaacccaatgtggctcgcgtgggctccgtggccatcaagctgtgcaatctgctgaagatagcaccacctgccgtgtgccaatccattgtccaccyctttgaggatgacatggtggaggtgtggagacgctcagtgctgagcccatctgaggcctgtggcctgctcctgggctccacctgtgggcactgggacatt

SEQ ID NO: 12931 - DNA, 201 bp, Homo sapiens
gaagatagcaccacctgccgtgtgccaatccattgtccacctctttgaggatgacatggtggaggtgtggagacgctcagtgctgagcccatctgaggccygtggcctgctcctgggctccacctgtgggcactgggacattttctcatcttggaacatctctttgcctactgtgccgaagccgccccccaaaccccctag

SEQ ID NO: 12932 - DNA, 201 bp, Homo sapiens
gcttctctacagggctcgagaaacctatgggctgcccaacacactgcctaccgcctggcacaacctggtatatcgcatgcggggcgacatgcaacttttcyagaccttctggtttctctaccataagggccacccaccctcggagccctgtggcacgccctgccgtctggctactctttgtgcccagctctctgcccgtgc

SEQ ID NO: 12933 - DNA, 201 bp, Homo sapiens
acatggtggaggtgtggagacgctcagtgctgagcccatctgaggcctgtggcctgctcctgggctccacctgtgggcactgggacattttctcatcttgraacatctctttgcctactgtgccgaagccgccccccaaaccccctagccccccagccccaggtgcccctgtcagccgcatcctcttcctcactgacctgc

SEQ ID NO: 12934 - DNA, 201 bp, Homo sapiens
cctgatgccagatgggagcctcccagaggcccagagcctgtggccaaggccactgttttgctagggccccagggcccacatttgggaaagttcttgatgtwggaaagggtgaaaaagcccaaatgctgctgtggttcaaccaggcaagatcatccggtgaaagaaccagtccctgggccccaaggatgccggggaaacagg

SEQ ID NO: 12935 - DNA, 201 bp, Homo sapiens
cagatgggagcctcccagaggcccagagcctgtggccaaggccactgttttgctagggccccagggcccacatttgggaaagttcttgatgtaggaaaggrtgaaaaagcccaaatgctgctgtggttcaaccaggcaagatcatccggtgaaagaaccagtccctgggccccaaggatgccggggaaacaggaccttctc

SEQ ID NO: 12936 - DNA, 201 bp, Homo sapiens
gagccggccgctggctgtagccttcctggcacccagtgcaactacctacatcggccttaatcctggttaccgtgtgtaccaaatagatggaaactactccrggagctctcacgtggtcctggaccatgagacctacatcctgaatctgacccaggcaaacataccgggagccataccgcactggcagcttctctacagggc

SEQ ID NO: 12937 - DNA, 201 bp, Homo sapiens
ctgtggccaaggccactgttttgctagggccccagggcccacatttgggaaagttcttgatgtaggaaagggtgaaaaagcccaaatgctgctgtggttcmaccaggcaagatcatccggtgaaagaaccagtccctgggccccaaggatgccggggaaacaggaccttctcctttcctggagctggtttagctggatatg

SEQ ID NO: 12938 - DNA, 201 bp, Homo sapiens
aatagatggaaactactccgggagctctcacgtggtcctggaccatgagacctacatcctgaatctgacccaggcaaacataccgggagccataccgcacyggcagcttctctacagggctcgagaaacctatgggctgcccaacacactgcctaccgcctggcacaacctggtatatcgcatgcggggcgacatgcaact

SEQ ID NO: 12939 - DNA, 201 bp, Homo sapiens
actgtgctgccgccggggttctggcctgccgcccgcatcccggccaggtgccggatactggggcgaatacagcaagtgtgacctgcccctgaggaccctgkagagcctgttgagtgggctgggcccagccggcccttttgatatggtgtactggacaggagacatccccgcacatgatgtctggcaccagactcgtcagga

SEQ ID NO: 12940 - DNA, 201 bp, Homo sapiens
ctactccgggagctctcacgtggtcctggaccatgagacctacatcctgaatctgacccaggcaaacataccgggagccataccgcactggcagcttctcyacagggctcgagaaacctatgggctgcccaacacactgcctaccgcctggcacaacctggtatatcgcatgcggggcgacatgcaacttttccagacctt

SEQ ID NO: 12941 - DNA, 201 bp, Homo sapiens
tgggctgcccaacacactgcctaccgcctggcacaacctggtatatcgcatgcggggcgacatgcaacttttccagaccttctggtttctctaccataagrgccacccaccctcggagccctgtggcacgccctgccgtctggctactctttgtgcccagctctctgcccgtgctgacagccctgctctgtgccgccacct

SEQ ID NO: 12942 - DNA, 201 bp, Homo sapiens
ctccacctgtgggcactgggacattttctcatcttggaacatctctttgcctactgtgccgaagccgccccccaaaccccctagccccccagccccaggtscccctgtcagccgcatcctcttcctcactgacctgcactgggatcatgactacctggagggcacggaccctgactgtgcagacccactgtgctgccgccg

SEQ ID NO: 12943 - DNA, 201 bp, Homo sapiens
gcactgggacattttctcatcttggaacatctctttgcctactgtgccgaagccgccccccaaaccccctagccccccagccccaggtgcccctgtcagcygcatcctcttcctcactgacctgcactgggatcatgactacctggagggcacggaccctgactgtgcagacccactgtgctgccgccggggttctggcct

SEQ ID NO: 12944 - DNA, 201 bp, Homo sapiens
cccagccccaggtgcccctgtcagccgcatcctcttcctcactgacctgcactgggatcatgactacctggagggcacggaccctgactgtgcagacccamtgtgctgccgccggggttctggcctgccgcccgcatcccggccaggtgccggatactggggcgaatacagcaagtgtgacctgcccctgaggaccctgga

SEQ ID NO: 12945 - DNA, 201 bp, Homo sapiens
gctacggagcgtcactccgccagagctgccccaggtccggccgggagcagggacaagacgggaccgccggagcccccggactcctttggatgggcctggtyctggcgctggcgctggcgctggcgctggcgctggctctgtctgactctcgggttctctgggctccggcagaggctcaccctctttctccccaaggccatc

SEQ ID NO: 12946 - DNA, 201 bp, Homo sapiens
aggtgcccctgtcagccgcatcctcttcctcactgacctgcactgggatcatgactacctggagggcacggaccctgactgtgcagacccactgtgctgcygccggggttctggcctgccgcccgcatcccggccaggtgccggatactggggcgaatacagcaagtgtgacctgcccctgaggaccctggagagcctgtt

SEQ ID NO: 12947 - DNA, 201 bp, Homo sapiens
agccgcatcctcttcctcactgacctgcactgggatcatgactacctggagggcacggaccctgactgtgcagacccactgtgctgccgccggggttctgrcctgccgcccgcatcccggccaggtgccggatactggggcgaatacagcaagtgtgacctgcccctgaggaccctggagagcctgttgagtgggctgggc

SEQ ID NO: 12948 - DNA, 201 bp, Homo sapiens
tgactacctggagggcacggaccctgactgtgcagacccactgtgctgccgccggggttctggcctgccgcccgcatcccggccaggtgccggatactggrgcgaatacagcaagtgtgacctgcccctgaggaccctggagagcctgttgagtgggctgggcccagccggcccttttgatatggtgtactggacaggaga

SEQ ID NO: 12949 - DNA, 201 bp, Homo sapiens
agggcacggaccctgactgtgcagacccactgtgctgccgccggggttctggcctgccgcccgcatcccggccaggtgccggatactggggcgaatacagmaagtgtgacctgcccctgaggaccctggagagcctgttgagtgggctgggcccagccggcccttttgatatggtgtactggacaggagacatccccgcac

SEQ ID NO: 12950 - DNA, 201 bp, Homo sapiens
tcaggaccaactgcgggccctgaccaccgtcacagcacttgtgaggaagttcctggggccagtgccagtgtaccctgctgtgggtaaccatgaaagcacasctgtcaatagcttccctccccccttcattgagggcaaccactcctcccgctggctctatgaagcgatggccaaggcttgggagccctggctgcctgccga

SEQ ID NO: 12951 - DNA, 201 bp, Homo sapiens
gagcctgttgagtgggctgggcccagccggcccttttgatatggtgtactggacaggagacatccccgcacatgatgtctggcaccagactcgtcaggacmaactgcgggccctgaccaccgtcacagcacttgtgaggaagttcctggggccagtgccagtgtaccctgctgtgggtaaccatgaaagcacacctgtcaa

SEQ ID NO: 12952 - DNA, 201 bp, Homo sapiens
accaccgtcacagcacttgtgaggaagttcctggggccagtgccagtgtaccctgctgtgggtaaccatgaaagcacacctgtcaatagcttccctccccscttcattgagggcaaccactcctcccgctggctctatgaagcgatggccaaggcttgggagccctggctgcctgccgaagccctgcgcaccctcagaatt

SEQ ID NO: 12953 - DNA, 201 bp, Homo sapiens
gggccagtgccagtgtaccctgctgtgggtaaccatgaaagcacacctgtcaatagcttccctccccccttcattgagggcaaccactcctcccgctggcyctatgaagcgatggccaaggcttgggagccctggctgcctgccgaagccctgcgcaccctcagaattggggggttctatgctctttccccataccccggt

SEQ ID NO: 12954 - DNA, 201 bp, Homo sapiens
cgctacggagcgtcactccgccagagctgccccaggtccggccgggagcagggacaagacgggaccgccggagcccccggactcctttggatgggcctggygctggcgctggcgctggcgctggcgctggcgctggctctgtctgactctcgggttctctgggctccggcagaggctcaccctctttctccccaaggccat

SEQ ID NO: 12955 - DNA, 201 bp, Homo sapiens
gtcaatagcttccctccccccttcattgagggcaaccactcctcccgctggctctatgaagcgatggccaaggcttgggagccctggctgcctgccgaagmcctgcgcaccctcagaattggggggttctatgctctttccccataccccggtctccgcctcatctctctcaatatgaatttttgttcccgtgagaacttc

SEQ ID NO: 12956 - DNA, 201 bp, Homo sapiens
gaagccctgcgcaccctcagaattggggggttctatgctctttccccataccccggtctccgcctcatctctctcaatatgaatttttgttcccgtgagamcttctggctcttgatcaactccacggatcccgcaggacagctccagtggctggtgggggagcttcaggctgctgaggatcgaggagacaaagtgcatata

SEQ ID NO: 12957 - DNA, 201 bp, Homo sapiens
aagttcttgatgtaggaaagggtgaaaaagcccaaatgctgctgtggttcaaccaggcaagatcatccggtgaaagaaccagtccctgggccccaaggatrccggggaaacaggaccttctcctttcctggagctggtttagctggatatgggagggggtttggctgcctgtgcccaggagctagactgccttgaggctgc

SEQ ID NO: 12958 - DNA, 201 bp, Homo sapiens
tttgcggccggccgcggagcagtcagccgactacagagaagggtaatcgggtgtccccggcgccgcccggggccctgagggctggctagggtccaggccgsgggggacgggacagacgaaccagccccgtgtaggaagcgcgacaatgccccgctacggagcgtcactccgccagagctgccccaggtccggccgggagca

SEQ ID NO: 12959 - DNA, 201 bp, Homo sapiens
gaagcgatggccaaggcttgggagccctggctgcctgccgaagccctgcgcaccctcagaattggggggttctatgctctttccccataccccggtctccdcctcatctctctcaatatgaatttttgttcccgtgagaacttctggctcttgatcaactccacggatcccgcaggacagctccagtggctggtgggggag

SEQ ID NO: 12960 - DNA, 201 bp, Homo sapiens
ttgagtgggctgggcccagccggcccttttgatatggtgtactggacaggagacatccccgcacatgatgtctggcaccagactcgtcaggaccaactgcrggccctgaccaccgtcacagcacttgtgaggaagttcctggggccagtgccagtgtaccctgctgtgggtaaccatgaaagcacacctgtcaatagcttc

SEQ ID NO: 12961 - DNA, 201 bp, Homo sapiens
ggccaaggcttgggagccctggctgcctgccgaagccctgcgcaccctcagaattggggggttctatgctctttccccataccccggtctccgcctcatcyctctcaatatgaatttttgttcccgtgagaacttctggctcttgatcaactccacggatcccgcaggacagctccagtggctggtgggggagcttcaggc

SEQ ID NO: 12962 - DNA, 201 bp, Homo sapiens
ctcaatatgaatttttgttcccgtgagaacttctggctcttgatcaactccacggatcccgcaggacagctccagtggctggtgggggagcttcaggctgytgaggatcgaggagacaaagtgcatataattggccacattcccccagggcactgtctgaagagctggagctggaattattaccgaattgtagccaggtat

SEQ ID NO: 12963 - DNA, 201 bp, Homo sapiens
tgagaacttctggctcttgatcaactccacggatcccgcaggacagctccagtggctggtgggggagcttcaggctgctgaggatcgaggagacaaagtgyatataattggccacattcccccagggcactgtctgaagagctggagctggaattattaccgaattgtagccaggtatgagaacaccctggctgctcagtt

SEQ ID NO: 12964 - DNA, 201 bp, Homo sapiens
aaagtgcatataattggccacattcccccagggcactgtctgaagagctggagctggaattattaccgaattgtagccaggtatgagaacaccctggctgytcagttctttggccacactcatgtggatgaatttgaggtcttctatgatgaagagactctgagccggccgctggctgtagccttcctggcacccagtgca

SEQ ID NO: 12965 - DNA, 201 bp, Homo sapiens
cccagccggcccttttgatatggtgtactggacaggagacatccccgcacatgatgtctggcaccagactcgtcaggaccaactgcgggccctgaccaccrtcacagcacttgtgaggaagttcctggggccagtgccagtgtaccctgctgtgggtaaccatgaaagcacacctgtcaatagcttccctccccccttcat

SEQ ID NO: 12966 - DNA, 201 bp, Homo sapiens
ccgaattgtagccaggtatgagaacaccctggctgctcagttctttggccacactcatgtggatgaatttgaggtcttctatgatgaagagactctgagcyggccgctggctgtagccttcctggcacccagtgcaactacctacatcggccttaatcctggttaccgtgtgtaccaaatagatggaaactactccgggag

SEQ ID NO: 12967 - DNA, 201 bp, Homo sapiens
attgtagccaggtatgagaacaccctggctgctcagttctttggccacactcatgtggatgaatttgaggtcttctatgatgaagagactctgagccggcygctggctgtagccttcctggcacccagtgcaactacctacatcggccttaatcctggttaccgtgtgtaccaaatagatggaaactactccgggagctct

SEQ ID NO: 12968 - DNA, 201 bp, Homo sapiens
agaacaccctggctgctcagttctttggccacactcatgtggatgaatttgaggtcttctatgatgaagagactctgagccggccgctggctgtagccttmctggcacccagtgcaactacctacatcggccttaatcctggttaccgtgtgtaccaaatagatggaaactactccgggagctctcacgtggtcctggacc

SEQ ID NO: 12969 - DNA, 201 bp, Homo sapiens
cgcccgcatcccggccaggtgccggatactggggcgaatacagcaagtgtgacctgcccctgaggaccctggagagcctgttgagtgggctgggcccagcyggcccttttgatatggtgtactggacaggagacatccccgcacatgatgtctggcaccagactcgtcaggaccaactgcgggccctgaccaccgtcacag

SEQ ID NO: 12970 - DNA, 201 bp, Homo sapiens
ctttggccacactcatgtggatgaatttgaggtcttctatgatgaagagactctgagccggccgctggctgtagccttcctggcacccagtgcaactaccwacatcggccttaatcctggttaccgtgtgtaccaaatagatggaaactactccgggagctctcacgtggtcctggaccatgagacctacatcctgaatct

SEQ ID NO: 12971 - DNA, 201 bp, Homo sapiens
ggatgaatttgaggtcttctatgatgaagagactctgagccggccgctggctgtagccttcctggcacccagtgcaactacctacatcggccttaatcctrgttaccgtgtgtaccaaatagatggaaactactccgggagctctcacgtggtcctggaccatgagacctacatcctgaatctgacccaggcaaacatacc

SEQ ID NO: 12972 - DNA, 201 bp, Homo sapiens
gcctcatctctctcaatatgaatttttgttcccgtgagaacttctggctcttgatcaactccacggatcccgcaggacagctccagtggctggtgggggarcttcaggctgctgaggatcgaggagacaaagtgcatataattggccacattcccccagggcactgtctgaagagctggagctggaattattaccgaattg

SEQ ID NO: 12973 - DNA, 201 bp, Homo sapiens
ctgggatcatgactacctggagggcacggaccctgactgtgcagacccactgtgctgccgccggggttctggcctgccgcccgcatcccggccaggtgccrgatactggggcgaatacagcaagtgtgacctgcccctgaggaccctggagagcctgttgagtgggctgggcccagccggcccttttgatatggtgtactg

SEQ ID NO: 12974 - DNA, 201 bp, Homo sapiens
cgccggggttctggcctgccgcccgcatcccggccaggtgccggatactggggcgaatacagcaagtgtgacctgcccctgaggaccctggagagcctgtwgagtgggctgggcccagccggcccttttgatatggtgtactggacaggagacatccccgcacatgatgtctggcaccagactcgtcaggaccaactgcgg

SEQ ID NO: 12975 - DNA, 201 bp, Homo sapiens
tcctcactgacctgcactgggatcatgactacctggagggcacggaccctgactgtgcagacccactgtgctgccgccggggttctggcctgccgcccgcrtcccggccaggtgccggatactggggcgaatacagcaagtgtgacctgcccctgaggaccctggagagcctgttgagtgggctgggcccagccggccctt

SEQ ID NO: 12976 - DNA, 201 bp, Homo sapiens
ggagggcacggaccctgactgtgcagacccactgtgctgccgccggggttctggcctgccgcccgcatcccggccaggtgccggatactggggcgaatacmgcaagtgtgacctgcccctgaggaccctggagagcctgttgagtgggctgggcccagccggcccttttgatatggtgtactggacaggagacatccccgc

SEQ ID NO: 12977 - DNA, 201 bp, Homo sapiens; identical to SEQ ID NO: 12908

SEQ ID NO: 12978 - DNA, 201 bp, Homo sapiens; identical to SEQ ID NO: 12909

SEQ ID NO: 12979 - DNA, 201 bp, Homo sapiens; identical to SEQ ID NO: 12910

SEQ ID NO: 12980 - DNA, 201 bp, Homo sapiens; identical to SEQ ID NO: 12911

SEQ ID NO: 12981 - DNA, 201 bp, Homo sapiens; identical to SEQ ID NO: 12912

SEQ ID NO: 12982 - DNA, 201 bp, Homo sapiens; identical to SEQ ID NO: 12915

SEQ ID NO: 12983 - DNA, 201 bp, Homo sapiens; identical to SEQ ID NO: 12916

SEQ ID NO: 12984 - DNA, 201 bp, Homo sapiens; identical to SEQ ID NO: 12917

SEQ ID NO: 12985 - DNA, 201 bp, Homo sapiens; identical to SEQ ID NO: 12918

SEQ ID NO: 12986 - DNA, 201 bp, Homo sapiens; identical to SEQ ID NO: 12919

SEQ ID NO: 12987 - DNA, 201 bp, Homo sapiens; identical to SEQ ID NO: 12920

SEQ ID NO: 12988 - DNA, 201 bp, Homo sapiens; identical to SEQ ID NO: 12921

SEQ ID NO: 12989 - DNA, 201 bp, Homo sapiens; identical to SEQ ID NO: 12957

SEQ ID NO: 12990 - DNA, 201 bp, Homo sapiens; identical to SEQ ID NO: 12922

SEQ ID NO: 12991 - DNA, 201 bp, Homo sapiens
cttatcgtccgtggaaacccaggaagggaaaagaaaggtgcatataattggccacattcccccagggcactgtctgaagagctggagctggaattattacygaattgtagccaggtatgagaacaccctggctgctcagttctttggccacactcatgtggatgaatttgaggtcttctatgatgaagagactctgagccg

SEQ ID NO: 12992 - DNA, 201 bp, Homo sapiens
acccaggaagggaaaagaaaggtgcatataattggccacattcccccagggcactgtctgaagagctggagctggaattattaccgaattgtagccaggtrtgagaacaccctggctgctcagttctttggccacactcatgtggatgaatttgaggtcttctatgatgaagagactctgagccggccgctggctgtagcc

SEQ ID NO: 12993 - DNA, 201 bp, Homo sapiens; identical to SEQ ID NO: 12925

SEQ ID NO: 12994 - DNA, 201 bp, Homo sapiens; identical to SEQ ID NO: 12926

SEQ ID NO: 12995 - DNA, 201 bp, Homo sapiens; identical to SEQ ID NO: 12958

SEQ ID NO: 12996 - DNA, 201 bp, Homo sapiens; identical to SEQ ID NO: 12928

SEQ ID NO: 12997 - DNA, 201 bp, Homo sapiens; identical to SEQ ID NO: 12960

SEQ ID NO: 12998 - DNA, 201 bp, Homo sapiens; identical to SEQ ID NO: 12929

SEQ ID NO: 12999 - DNA, 201 bp, Homo sapiens; identical to SEQ ID NO: 12930

SEQ ID NO: 13000 - DNA, 201 bp, Homo sapiens
agcgatggccaaggcttgggagccctggctgcctgccgaagccctgcgcaccctcaggtacttatcgtccgtggaaacccaggaagggaaaagaaaggtgyatataattggccacattcccccagggcactgtctgaagagctggagctggaattattaccgaattgtagccaggtatgagaacaccctggctgctcagtt

SEQ ID NO: 13001 - DNA, 201 bp, Homo sapiens; identical to SEQ ID NO: 12931

SEQ ID NO: 13002 - DNA, 201 bp, Homo sapiens
aaggtgcatataattggccacattcccccagggcactgtctgaagagctggagctggaattattaccgaattgtagccaggtatgagaacaccctggctgytcagttctttggccacactcatgtggatgaatttgaggtcttctatgatgaagagactctgagccggccgctggctgtagccttcctggcacccagtgca

SEQ ID NO: 13003 - DNA, 201 bp, Homo sapiens; identical to SEQ ID NO: 12932

SEQ ID NO: 13004 - DNA, 201 bp, Homo sapiens; identical to SEQ ID NO: 12965

SEQ ID NO: 13005 - DNA, 201 bp, Homo sapiens; identical to SEQ ID NO: 12966

SEQ ID NO: 13006 - DNA, 201 bp, Homo sapiens; identical to SEQ ID NO: 12933

SEQ ID NO: 13007 - DNA, 201 bp, Homo sapiens; identical to SEQ ID NO: 12967

SEQ ID NO: 13008 - DNA, 201 bp, Homo sapiens; identical to SEQ ID NO: 12968

SEQ ID NO: 13009 - DNA, 201 bp, Homo sapiens; identical to SEQ ID NO: 12969

SEQ ID NO: 13010 - DNA, 201 bp, Homo sapiens; identical to SEQ ID NO: 12970

SEQ ID NO: 13011 - DNA, 201 bp, Homo sapiens; identical to SEQ ID NO: 12971

SEQ ID NO: 13012 - DNA, 201 bp, Homo sapiens; identical to SEQ ID NO: 12934

SEQ ID NO: 13013 - DNA, 201 bp, Homo sapiens; identical to SEQ ID NO: 12936

SEQ ID NO: 13014 - DNA, 201 bp, Homo sapiens; identical to SEQ ID NO: 12935

SEQ ID NO: 13015 - DNA, 201 bp, Homo sapiens; identical to SEQ ID NO: 12937

SEQ ID NO: 13016 - DNA, 201 bp, Homo sapiens; identical to SEQ ID NO: 12973

SEQ ID NO: 13017 - DNA, 201 bp, Homo sapiens; identical to SEQ ID NO: 12974

SEQ ID NO: 13018 - DNA, 201 bp, Homo sapiens; identical to SEQ ID NO: 12938

SEQ ID NO: 13019 - DNA, 201 bp, Homo sapiens; identical to SEQ ID NO: 12975

SEQ ID NO: 13020 - DNA, 201 bp, Homo sapiens; identical to SEQ ID NO: 12939

SEQ ID NO: 13021 - DNA, 201 bp, Homo sapiens; identical to SEQ ID NO: 12940

SEQ ID NO: 13022 - DNA, 201 bp, Homo sapiens; identical to SEQ ID NO: 12976

SEQ ID NO: 13023 - DNA, 201 bp, Homo sapiens; identical to SEQ ID NO: 12941

SEQ ID NO: 13024 - DNA, 201 bp, Homo sapiens; identical to SEQ ID NO: 12942

SEQ ID NO: 13025 - DNA, 201 bp, Homo sapiens; identical to SEQ ID NO: 12943

SEQ ID NO: 13026 - DNA, 201 bp, Homo sapiens; identical to SEQ ID NO: 12944

SEQ ID NO: 13027 - DNA, 201 bp, Homo sapiens; identical to SEQ ID NO: 12945

SEQ ID NO: 13028 - DNA, 201 bp, Homo sapiens; identical to SEQ ID NO: 12946

SEQ ID NO: 13029 - DNA, 201 bp, Homo sapiens; identical to SEQ ID NO: 12947

SEQ ID NO: 13030 - DNA, 201 bp, Homo sapiens; identical to SEQ ID NO: 12948

SEQ ID NO: 13031 - DNA, 201 bp, Homo sapiens; identical to SEQ ID NO: 12949

SEQ ID NO: 13032 - DNA, 201 bp, Homo sapiens; identical to SEQ ID NO: 12950

SEQ ID NO: 13033 - DNA, 201 bp, Homo sapiens; identical to SEQ ID NO: 12951

SEQ ID NO: 13034 - DNA, 201 bp, Homo sapiens
accaccgtcacagcacttgtgaggaagttcctggggccagtgccagtgtaccctgctgtgggtaaccatgaaagcacacctgtcaatagcttccctccccscttcattgagggcaaccactcctcccgctggctctatgaagcgatggccaaggcttgggagccctggctgcctgccgaagccctgcgcaccctcaggtac

SEQ ID NO: 13035 - DNA, 201 bp, Homo sapiens
gtcaatagcttccctccccccttcattgagggcaaccactcctcccgctggctctatgaagcgatggccaaggcttgggagccctggctgcctgccgaagmcctgcgcaccctcaggtacttatcgtccgtggaaacccaggaagggaaaagaaaggtgcatataattggccacattcccccagggcactgtctgaagagc

SEQ ID NO: 13036 - DNA, 201 bp, Homo sapiens; identical to SEQ ID NO: 12954

SEQ ID NO: 13037 - DNA, 201 bp, Homo sapiens
gggccagtgccagtgtaccctgctgtgggtaaccatgaaagcacacctgtcaatagcttccctccccccttcattgagggcaaccactcctcccgctggcyctatgaagcgatggccaaggcttgggagccctggctgcctgccgaagccctgcgcaccctcaggtacttatcgtccgtggaaacccaggaagggaaaaga

SEQ ID NO: 13038 - DNA, 201 bp, Homo sapiens; identical to SEQ ID NO: 12908

SEQ ID NO: 13039 - DNA, 201 bp, Homo sapiens; identical to SEQ ID NO: 12909

SEQ ID NO: 13040 - DNA, 201 bp, Homo sapiens; identical to SEQ ID NO: 12910

SEQ ID NO: 13041 - DNA, 201 bp, Homo sapiens; identical to SEQ ID NO: 12911

SEQ ID NO: 13042 - DNA, 201 bp, Homo sapiens; identical to SEQ ID NO: 12912

SEQ ID NO: 13043 - DNA, 201 bp, Homo sapiens
acttatcgtccgtggaaacccaggaagggaaaagaaagaattggggggttctatgctctttccccataccccggtctccgcctcatctctctcaatatgartttttgttcccgtgagaacttctggctcttgatcaactccacggatcccgcaggacagctccagtggctggtgggggagcttcaggctgctgaggatcga

SEQ ID NO: 13044 - DNA, 201 bp, Homo sapiens
gaagggaaaagaaagaattggggggttctatgctctttccccataccccggtctccgcctcatctctctcaatatgaatttttgttcccgtgagaacttckggctcttgatcaactccacggatcccgcaggacagctccagtggctggtgggggagcttcaggctgctgaggatcgaggagacaaagtgcatataattgg

SEQ ID NO: 13045 - DNA, 201 bp, Homo sapiens; identical to SEQ ID NO: 12916

SEQ ID NO: 13046 - DNA, 201 bp, Homo sapiens; identical to SEQ ID NO: 12915

SEQ ID NO: 13047 - DNA, 201 bp, Homo sapiens; identical to SEQ ID NO: 12917

SEQ ID NO: 13048 - DNA, 201 bp, Homo sapiens; identical to SEQ ID NO: 12918

SEQ ID NO: 13049 - DNA, 201 bp, Homo sapiens; identical to SEQ ID NO: 12919

SEQ ID NO: 13050 - DNA, 201 bp, Homo sapiens; identical to SEQ ID NO: 12920

SEQ ID NO: 13051 - DNA, 201 bp, Homo sapiens; identical to SEQ ID NO: 12921

SEQ ID NO: 13052 - DNA, 201 bp, Homo sapiens; identical to SEQ ID NO: 12922

SEQ ID NO: 13053 - DNA, 201 bp, Homo sapiens; identical to SEQ ID NO: 12923

SEQ ID NO: 13054 - DNA, 201 bp, Homo sapiens; identical to SEQ ID NO: 12924

SEQ ID NO: 13055 - DNA, 201 bp, Homo sapiens; identical to SEQ ID NO: 12925

SEQ ID NO: 13056 - DNA, 201 bp, Homo sapiens; identical to SEQ ID NO: 12926

SEQ ID NO: 13057 - DNA, 201 bp, Homo sapiens
gtacttatcgtccgtggaaacccaggaagggaaaagaaagaattggggggttctatgctctttccccataccccggtctccgcctcatctctctcaatatraatttttgttcccgtgagaacttctggctcttgatcaactccacggatcccgcaggacagctccagtggctggtgggggagcttcaggctgctgaggatc

SEQ ID NO: 13058 - DNA, 201 bp, Homo sapiens; identical to SEQ ID NO: 12928

SEQ ID NO: 13059 - DNA, 144 bp, Homo sapiens
ctgaagatagcaccacctgccgtgtgccaatccattgtccaccyctttgaggatgacatggtggaggtgtggagacgctcagtgctgagcccatctgaggcctgtggcctgctcctgggctccacctgtgggcactgggacatt

SEQ ID NO: 13060 - DNA, 201 bp, Homo sapiens; identical to SEQ ID NO: 12932

SEQ ID NO: 13061 - DNA, 201 bp, Homo sapiens; identical to SEQ ID NO: 12931

SEQ ID NO: 13062 - DNA, 201 bp, Homo sapiens; identical to SEQ ID NO: 12933

SEQ ID NO: 13063 - DNA, 201 bp, Homo sapiens; identical to SEQ ID NO: 12934

SEQ ID NO: 13064 - DNA, 201 bp, Homo sapiens; identical to SEQ ID NO: 12935

SEQ ID NO: 13065 - DNA, 201 bp, Homo sapiens; identical to SEQ ID NO: 12936

SEQ ID NO: 13066 - DNA, 201 bp, Homo sapiens; identical to SEQ ID NO: 12937

SEQ ID NO: 13067 - DNA, 201 bp, Homo sapiens; identical to SEQ ID NO: 12938

SEQ ID NO: 13068 - DNA, 201 bp, Homo sapiens; identical to SEQ ID NO: 12939

SEQ ID NO: 13069 - DNA, 201 bp, Homo sapiens; identical to SEQ ID NO: 12940

SEQ ID NO: 13070 - DNA, 201 bp, Homo sapiens; identical to SEQ ID NO: 12941

SEQ ID NO: 13071 - DNA, 201 bp, Homo sapiens; identical to SEQ ID NO: 12942

SEQ ID NO: 13072 - DNA, 201 bp, Homo sapiens; identical to SEQ ID NO: 12943

SEQ ID NO: 13073 - DNA, 201 bp, Homo sapiens; identical to SEQ ID NO: 12944

SEQ ID NO: 13074 - DNA, 201 bp, Homo sapiens; identical to SEQ ID NO: 12946

SEQ ID NO: 13075 - DNA, 201 bp, Homo sapiens; identical to SEQ ID NO: 12947

SEQ ID NO: 13076 - DNA, 201 bp, Homo sapiens; identical to SEQ ID NO: 12948

SEQ ID NO: 13077 - DNA, 201 bp, Homo sapiens; identical to SEQ ID NO: 12949

SEQ ID NO: 13078 - DNA, 201 bp, Homo sapiens; identical to SEQ ID NO: 12950

SEQ ID NO: 13079 - DNA, 201 bp, Homo sapiens; identical to SEQ ID NO: 12951

SEQ ID NO: 13080 - DNA, 201 bp, Homo sapiens; identical to SEQ ID NO: 13034

SEQ ID NO: 13081 - DNA, 201 bp, Homo sapiens; identical to SEQ ID NO: 13037

SEQ ID NO: 13082 - DNA, 201 bp, Homo sapiens
gtcaatagcttccctccccccttcattgagggcaaccactcctcccgctggctctatgaagcgatggccaaggcttgggagccctggctgcctgccgaagmcctgcgcaccctcaggtacttatcgtccgtggaaacccaggaagggaaaagaaagaattggggggttctatgctctttccccataccccggtctccgcct

SEQ ID NO: 13083 - DNA, 201 bp, Homo sapiens
cccaggaagggaaaagaaagaattggggggttctatgctctttccccataccccggtctccgcctcatctctctcaatatgaatttttgttcccgtgagamcttctggctcttgatcaactccacggatcccgcaggacagctccagtggctggtgggggagcttcaggctgctgaggatcgaggagacaaagtgcatata

SEQ ID NO: 13084 - DNA, 201 bp, Homo sapiens; identical to SEQ ID NO: 12957

SEQ ID NO: 13085 - DNA, 201 bp, Homo sapiens
aagccctgcgcaccctcaggtacttatcgtccgtggaaacccaggaagggaaaagaaagaattggggggttctatgctctttccccataccccggtctccdcctcatctctctcaatatgaatttttgttcccgtgagaacttctggctcttgatcaactccacggatcccgcaggacagctccagtggctggtgggggag

SEQ ID NO: 13086 - DNA, 201 bp, Homo sapiens
cgcaccctcaggtacttatcgtccgtggaaacccaggaagggaaaagaaagaattggggggttctatgctctttccccataccccggtctccgcctcatcyctctcaatatgaatttttgttcccgtgagaacttctggctcttgatcaactccacggatcccgcaggacagctccagtggctggtgggggagcttcaggc

SEQ ID NO: 13087 - DNA, 201 bp, Homo sapiens; identical to SEQ ID NO: 12960

SEQ ID NO: 13088 - DNA, 201 bp, Homo sapiens; identical to SEQ ID NO: 12962

SEQ ID NO: 13089 - DNA, 201 bp, Homo sapiens; identical to SEQ ID NO: 12963

SEQ ID NO: 13090 - DNA, 201 bp, Homo sapiens; identical to SEQ ID NO: 12964

SEQ ID NO: 13091 - DNA, 201 bp, Homo sapiens; identical to SEQ ID NO: 12966

SEQ ID NO: 13092 - DNA, 201 bp, Homo sapiens; identical to SEQ ID NO: 12965

SEQ ID NO: 13093 - DNA, 201 bp, Homo sapiens; identical to SEQ ID NO: 12967

SEQ ID NO: 13094 - DNA, 201 bp, Homo sapiens; identical to SEQ ID NO: 12968

SEQ ID NO: 13095 - DNA, 201 bp, Homo sapiens; identical to SEQ ID NO: 12970

SEQ ID NO: 13096 - DNA, 201 bp, Homo sapiens; identical to SEQ ID NO: 12969

SEQ ID NO: 13097 - DNA, 201 bp, Homo sapiens; identical to SEQ ID NO: 12971

SEQ ID NO: 13098 - DNA, 201 bp, Homo sapiens; identical to SEQ ID NO: 12972

SEQ ID NO: 13099 - DNA, 201 bp, Homo sapiens; identical to SEQ ID NO: 12973

SEQ ID NO: 13100 - DNA, 201 bp, Homo sapiens; identical to SEQ ID NO: 12974

SEQ ID NO: 13101 - DNA, 201 bp, Homo sapiens; identical to SEQ ID NO: 12975

SEQ ID NO: 13102 - DNA, 201 bp, Homo sapiens; identical to SEQ ID NO: 12976

SEQ ID NO: 13103 - DNA, 201 bp, Homo sapiens
taaggggcgttgactcacccgggcggggctccgggagttgcacagaccaaggccctgtgcctccctctacagccctcagggagctcattgaggagctggtmaacatcacccagaaccagaaggctccgctctgcaatggcagcatggtatggagcatcaacctgacagctggcatgtactgtgcagccctggaatccctga

SEQ ID NO: 13104 - DNA, 201 bp, Homo sapiens
agcctcatccgaggcagggtcaggagaggggcagaacagccgctcctgtctgccagccagcagccagctctcagccaacgagtaatttattgtttttcctygtatttaaatattaaatatgttagcaaagagttaatatatagaagggtaccttgaacactgggggaggggacattgaacaagttgtttcattgactatca

SEQ ID NO: 13105 - DNA, 201 bp, Homo sapiens
gaccccaggagtccctggtaataagtactgtgtacagaattctgctacctcactggggtcctggggcctcggagcctcatccgaggcagggtcaggagagsggcagaacagccgctcctgtctgccagccagcagccagctctcagccaacgagtaatttattgtttttcctcgtatttaaatattaaatatgttagcaaa

SEQ ID NO: 13106 - DNA, 201 bp, Homo sapiens
ccagtttgtaaaggacctgctcttacatttaaagaaactttttcgcgagggacggttcaactgaaacttcgaaagcatcattatttgcagagacaggaccygactattgaagttgcagattcatttttctttctgatgtcaaaaatgtcttgggtaggcgggaaggagggttagggaggggtaaaattccttagcttagac

SEQ ID NO: 13107 - DNA, 201 bp, Homo sapiens
gggcagttttccagcttgcatgtccgagacaccaaaatcgaggtggcccagtttgtaaaggacctgctcttacatttaaagaaactttttcgcgagggacrgttcaactgaaacttcgaaagcatcattatttgcagagacaggacctgactattgaagttgcagattcatttttctttctgatgtcaaaaatgtcttggg

SEQ ID NO: 13108 - DNA, 201 bp, Homo sapiens
gagtgtgtttgtcaccgttggggattggggaagactgtggctgctggcacttggagccaagggttcagagactcagggccccagcactaaagcagtggacmccaggagtccctggtaataagtactgtgtacagaattctgctacctcactggggtcctggggcctcggagcctcatccgaggcagggtcaggagaggggc

SEQ ID NO: 13109 - DNA, 201 bp, Homo sapiens
ctcattgaggagctggtcaacatcacccagaaccagaaggctccgctctgcaatggcagcatggtatggagcatcaacctgacagctggcatgtactgtgmagccctggaatccctgatcaacgtgtcaggctgcagtgccatcgagaagacccagaggatgctgagcggattctgcccgcacaaggtctcagctgggcag

SEQ ID NO: 13110 - DNA, 201 bp, Homo sapiens
agcagctcaggcacacttcttcttggtcttatttattattgtgtgttatttaaatgagtgtgtttgtcaccgttggggattggggaagactgtggctgctrgcacttggagccaagggttcagagactcagggccccagcactaaagcagtggaccccaggagtccctggtaataagtactgtgtacagaattctgctacc

SEQ ID NO: 13111 - DNA, 201 bp, Homo sapiens
tgttgaccacggtcattgctctcacttgccttggcggctttgcctccccaggccctgtgcctccctctacagccctcagggagctcattgaggagctggtmaacatcacccagaaccagaaggctccgctctgcaatggcagcatggtatggagcatcaacctgacagctggcatgtactgtgcagccctggaatccctga

SEQ ID NO: 13112 - DNA, 201 bp, Homo sapiens; identical to SEQ ID NO: 13104

SEQ ID NO: 13113 - DNA, 201 bp, Homo sapiens; identical to SEQ ID NO: 13105

SEQ ID NO: 13114 - DNA, 201 bp, Homo sapiens; identical to SEQ ID NO: 13106

SEQ ID NO: 13115 - DNA, 201 bp, Homo sapiens; identical to SEQ ID NO: 13107

SEQ ID NO: 13116 - DNA, 201 bp, Homo sapiens; identical to SEQ ID NO: 13108

SEQ ID NO: 13117 - DNA, 201 bp, Homo sapiens; identical to SEQ ID NO: 13110

SEQ ID NO: 13118 - DNA, 201 bp, Homo sapiens; identical to SEQ ID NO: 13109

SEQ ID NO: 13119 - DNA, 201 bp, Homo sapiens; identical to SEQ ID NO: 13107

SEQ ID NO: 13120 - DNA, 201 bp, Homo sapiens; identical to SEQ ID NO: 13109

SEQ ID NO: 13121 - DNA, 201 bp, Homo sapiens
gacaccaggagtccctggtaataagtactgtgtacagaattctgctacctcactggggtcctggggcctcggagcctcatccgaggcagggtcaggagagsggcagaacagccgctcctgtctgccagccagcagccagctctcagccaacgagtaatttattgtttttccttgtatttaaatattaaatatgttagcaaa

SEQ ID NO: 13122 - DNA, 201 bp, Homo sapiens
ccagtttgtaaaggacctgctcttacatttaaagaaactttttcgcgagggacagttcaactgaaacttcgaaagcatcattatttgcagagacaggaccygactattgaagttgcagattcatttttctttctgatgtcaaaaatgtcttgggtaggcgggaaggagggttagggaggggtaaaattccttagcttagac

SEQ ID NO: 13123 - DNA, 201 bp, Homo sapiens; identical to SEQ ID NO: 13104

SEQ ID NO: 13124 - DNA, 201 bp, Homo sapiens
gagtgtgtttgtcaccgttggggattggggaagactgtggctgctagcacttggagccaagggttcagagactcagggccccagcactaaagcagtggacmccaggagtccctggtaataagtactgtgtacagaattctgctacctcactggggtcctggggcctcggagcctcatccgaggcagggtcaggagaggggc

SEQ ID NO: 13125 - DNA, 201 bp, Homo sapiens
agcagctcaggcacacttcttcttggtcttatttattattgtgtgttatttaaatgagtgtgtttgtcaccgttggggattggggaagactgtggctgctrgcacttggagccaagggttcagagactcagggccccagcactaaagcagtggacaccaggagtccctggtaataagtactgtgtacagaattctgctacc

SEQ ID NO: 13126 - DNA, 201 bp, Homo sapiens
aggccctgctccctctccagccttgacagcccctccccctgcctatgccaccctgggcccccgcccatctccagggggctctgcaggggccagttcctccrcctgtcctctgggggggccctgagagggaaggagaggtttctcacaccaaggcagatgctcctctggtgggagggtgctggccctggcaagattgaagga

SEQ ID NO: 13127 - DNA, 201 bp, Homo sapiens
ctccgaaggttccgaagccgatactggtctccaggccgagggggcaggggtgctcaggaggtagcctccaccctggcatcctcccctccttcccacttctkcccccaccccatgtctctgtccttgtcccagccaggccctgctccctctccagccttgacagcccctccccctgcctatgccaccctgggcccccgccca

SEQ ID NO: 13128 - DNA, 123 bp, Homo sapiens
tcgcttccatccctggccggccrgcgggcgggctccccagccaggccgctgcacctgtcaggggaacaagctggaggagcaggaccctagacctctgcagcccataccaggtctcatggaggg

SEQ ID NO: 13129 - DNA, 201 bp, Homo sapiens
gatgtatggaaactgctatactttcaatgacaagaacaactccaacctctggatgtcttccatgcctggaatcaacaacggtctgtccctgatgctgcgcrcagagcagaatgacttcattcccctgctgtccacagtgactggggcccgggtaatggtgcacgggcaggatgaacctgcctttatggatgatggtggctt

SEQ ID NO: 13130 - DNA, 201 bp, Homo sapiens
attactctcacttccaccacccgatgtatggaaactgctatactttcaatgacaagaacaactccaacctctggatgtcttccatgcctggaatcaacaayggtctgtccctgatgctgcgcgcagagcagaatgacttcattcccctgctgtccacagtgactggggcccgggtaatggtgcacgggcaggatgaacctg

SEQ ID NO: 13131 - DNA, 188 bp, Homo sapiens
tcgcttccatccctggccggccagcgggcgggctccccagccaggccgctgcacctgtcaggggaacaagctggaggagcaggacccyagacctctgcagcccataccaggtctcatggaggggaacaagctggaggagcaggactctagccctccacagtccactccagggctcatgaaggggaaca

SEQ ID NO: 13132 - DNA, 201 bp, Homo sapiens
ggttacaacacacgagctacaaactacaatgctggagacagaagcactgattatgggatatttcagatcaatagccgctactggtgtaatgatggcaaaamcccaggagcagttaatgcctgtcatttatcctgcagtgctttgctgcaagataacatcgctgatgctgtagcttgtgcaaagagggttgtccgtgatcca

SEQ ID NO: 13133 - DNA, 201 bp, Homo sapiens
atgggagagtggttacaacacacgagctacaaactacaatgctggagacagaagcactgattatgggatatttcagatcaatagccgctactggtgtaatsatggcaaaaccccaggagcagttaatgcctgtcatttatcctgcagtgctttgctgcaagataacatcgctgatgctgtagcttgtgcaaagagggttgt

SEQ ID NO: 13134 - DNA, 201 bp, Homo sapiens
aagtaaaaaatataagaaaaggttatcttaaatagatcttaggcaaaataccagctgatgaaggcatctgatgccttcatctgttcagtcatctccaaaamcagtaaaaataaccactttttgttgggcaatatgaaatttttaaaggagtagaataccaaatgatagaaacagactgcctgaatgtgtttctttctaaat

SEQ ID NO: 13135 - DNA, 201 bp, Homo sapiens
atcagcctagcaaactggatgtgtttggccaaatgggagagtggttacaacacacgagctacaaactacaatgctggagacagaagcactgattatgggayatttcagatcaatagccgctactggtgtaatgatggcaaaaccccaggagcagttaatgcctgtcatttatcctgcagtgctttgctgcaagataacatc

SEQ ID NO: 13136 - DNA, 201 bp, Homo sapiens
tttggccaaatgggagagtggttacaacacacgagctacaaactacaatgctggagacagaagcactgattatgggatatttcagatcaatagccgctacyggtgtaatgatggcaaaaccccaggagcagttaatgcctgtcatttatcctgcagtgctttgctgcaagataacatcgctgatgctgtagcttgtgcaaa

SEQ ID NO: 13137 - DNA, 201 bp, Homo sapiens
aataatatttttacagaagcaggagcaaaatatggcctttcttctaagagatataatgttcactaatgtggttattttatattaagcctacaacatttttyagtttgcaaatagaactaatactggtgaaaatttacctaaaaccttggttatcaaatacatctccagtacattccgttctttttttttagacagtctcgc

SEQ ID NO: 13138 - DNA, 201 bp, Homo sapiens
gagacagggtttcaccgtgttgttcttatcaaagaaataacccagacttaatcttgaatgatacgattatgcccaatattaagtaaaaaatataagaaaakgttatcttaaatagatcttaggcaaaataccagctgatgaaggcatctgatgccttcatctgttcagtcatctccaaaaacagtaaaaataaccactttt

SEQ ID NO: 13139 - DNA, 201 bp, Homo sapiens
aaaaggttatcttaaatagatcttaggcaaaataccagctgatgaaggcatctgatgccttcatctgttcagtcatctccaaaaacagtaaaaataaccaytttttgttgggcaatatgaaatttttaaaggagtagaataccaaatgatagaaacagactgcctgaatgtgtttctttctaaattgctgttccttaattt

SEQ ID NO: 13140 - DNA, 201 bp, Homo sapiens
ccattatttccccttcaaacaaataatatttttacagaagcaggagcaaaatatggcctttcttctaagagatataatgttcactaatgtggttattttayattaagcctacaacatttttcagtttgcaaatagaactaatactggtgaaaatttacctaaaaccttggttatcaaatacatctccagtacattccgttc

SEQ ID NO: 13141 - DNA, 132 bp, Homo sapiens
ggtcagcctagcactctgacctagcagtcaayatgaaggctctcattgttctggggcttgtcctcctttctgttacggtccagggcaaggtctttgaaaggtgtgagttggccagaactctgaaaagattgg

SEQ ID NO: 13142 - DNA, 201 bp, Homo sapiens; identical to SEQ ID NO: 13132

SEQ ID NO: 13143 - DNA, 201 bp, Homo sapiens; identical to SEQ ID NO: 13133

SEQ ID NO: 13144 - DNA, 201 bp, Homo sapiens; identical to SEQ ID NO: 13134

SEQ ID NO: 13145 - DNA, 201 bp, Homo sapiens; identical to SEQ ID NO: 13135

SEQ ID NO: 13146 - DNA, 201 bp, Homo sapiens; identical to SEQ ID NO: 13136

SEQ ID NO: 13147 - DNA, 201 bp, Homo sapiens
aataatatttttacagaagcaggagcaaaatatggcctttcttctaagagatataatgttcactaatgtggttattttatattaagcctacaacatttttyagtttgcaaatagaactaatactggtgaaaatttacctaaaaccttggttatcaaatacatctccagtacattccgttcttttttttgagacagtctcgc

SEQ ID NO: 13148 - DNA, 201 bp, Homo sapiens
cactgcgcccggccacattcagttcttatcaaagaaataacccagacttaatcttgaatgatacgattatgcccaatattaagtaaaaaatataagaaaakgttatcttaaatagatcttaggcaaaataccagctgatgaaggcatctgatgccttcatctgttcagtcatctccaaaaacagtaaaaataaccactttt

SEQ ID NO: 13149 - DNA, 201 bp, Homo sapiens; identical to SEQ ID NO: 13139

SEQ ID NO: 13150 - DNA, 201 bp, Homo sapiens; identical to SEQ ID NO: 13140

SEQ ID NO: 13151 - DNA, 132 bp, Homo sapiens; identical to SEQ ID NO: 13141

SEQ ID NO: 13152 - DNA, 201 bp, Homo sapiens; identical to SEQ ID NO: 13132

SEQ ID NO: 13153 - DNA, 201 bp, Homo sapiens; identical to SEQ ID NO: 13133

SEQ ID NO: 13154 - DNA, 201 bp, Homo sapiens
aagtaaaaaatataagaaaaggttatcttaaatagatcttaggcaaaataccagctgatgaaggcatctgatgccttcatctgttcagtcatctccaaaamcagtaaaaataaccactttttgttgggcaatatgaaatttttaaaggagtagaataccaaatgatagaaacagactgcctgaattgagaattttgatttt

SEQ ID NO: 13155 - DNA, 201 bp, Homo sapiens
acagtaaaaataaccactttttgttgggcaatatgaaatttttaaaggagtagaataccaaatgatagaaacagactgcctgaattgagaattttgatttyttaaagtgtgtttctttctaaattgctgttccttaatttgattaatttaattcatgtattatgattaaatctgaggcagatgagcttacaagtattgaaa

SEQ ID NO: 13156 - DNA, 201 bp, Homo sapiens; identical to SEQ ID NO: 13135

SEQ ID NO: 13157 - DNA, 201 bp, Homo sapiens; identical to SEQ ID NO: 13136

SEQ ID NO: 13158 - DNA, 201 bp, Homo sapiens
aataatatttttacagaagcaggagcaaaatatggcctttcttctaagagatataatgttcactaatgtggttattttatattaagcctacaacatttttyagtttgcaaatagaactaatactggtgaaaatttacctaaaaccttggttatcaaatacatctccagtacattccgttcttttttttttttttttttttt

SEQ ID NO: 13159 - DNA, 201 bp, Homo sapiens; identical to SEQ ID NO: 13148

SEQ ID NO: 13160 - DNA, 201 bp, Homo sapiens
aaaaggttatcttaaatagatcttaggcaaaataccagctgatgaaggcatctgatgccttcatctgttcagtcatctccaaaaacagtaaaaataaccaytttttgttgggcaatatgaaatttttaaaggagtagaataccaaatgatagaaacagactgcctgaattgagaattttgattttttaaagtgtgtttctt

SEQ ID NO: 13161 - DNA, 201 bp, Homo sapiens; identical to SEQ ID NO: 13140

SEQ ID NO: 13162 - DNA, 132 bp, Homo sapiens; identical to SEQ ID NO: 13141

SEQ ID NO: 13163 - DNA, 201 bp, Homo sapiens
tgtgccttccagcctcagctgggccccaagtgctgaacagtggctgcctgggaccagagctgatgaaggcagccccgtggagcccagccaagagcaggacrtcctaaccagcatggaggcctctggccacctcagcacaaatctctggcatgctgtcactgatgatgacacaggtcagaaagaaatacccatttctgaacg

SEQ ID NO: 13164 - DNA, 201 bp, Homo sapiens
ggtacgaagccctgccccaggcagtgtttgtggccctgagcgatgacacggcctggatcatcaggaccagtggggacctatacttgcagacaggtctgagygtggatcgcccttgtgccagagccgtaaaggtggactgtccctacccgctgtcccagatcacagcccggaacaatgtggtgtgggcgctgacagagcaga

SEQ ID NO: 13165 - DNA, 201 bp, Homo sapiens
tcctccggcccggcggggccgacgagtccggaggggctgccgcgggagcccccaggtttccctagatgacaaataaacattccttttcctgcgtgaagatmgtctgtggaaaccttggccatggcatcgatatcagagcctgttacattcagagagttctgcccgttgtactatctcctcaatgccattccgacaaagatc

SEQ ID NO: 13166 - DNA, 201 bp, Homo sapiens
cggtctctgccttggcagccagcactcacaagccctggcttgagcagcctccacgggatcagacattgacgtccagcgatgaggaggacatctatgcccaygggcttccttcttcatcctcagagacgagtgtgacagagctcggacctagttgctcccagcaggacctgagccggctgggtgcagaggacgccgggctgc

SEQ ID NO: 13167 - DNA, 201 bp, Homo sapiens
cgtcacggcccgggctccggctatggaaggctgatgtccacgggactgttcaagccacgtttatcttaaaagatgcttttgccgggggagtcaagcctttwgaactgcacccgcgtctggaatcccccaacagtggaagttgcagcttacctgagaggcacctggggcttgtttcatgtttctttcaagaaggctgggtgc

SEQ ID NO: 13168 - DNA, 201 bp, Homo sapiens
gtgggcgctgacagagcagagggccctcctgtaccgggagggcgtgagcagcttctgtccggaaggcgagcagtggaagtgtgacattgtcagcgaaaggmaagctttagaacccgtctgcataacgctcggggatcagcagactctctgggccctggacatccatgggaacctgtggttcagaactggcattatttccaa

SEQ ID NO: 13169 - DNA, 201 bp, Homo sapiens
tgtcgatgacctcaagtgtcctgggcagtagcgtggatcagttaagtgcagagtctccagaccaggaaagcagcttcaatggtgaagtgaacggtgtcccrcaggaaaatactgaccccgaaacgtttaatgtcctggaggtgtcaggatcaatgcctgattctctggctgaggaagatgacattagaactgaaatgccac

SEQ ID NO: 13170 - DNA, 201 bp, Homo sapiens
attaacatcaacagactcttctttcttagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcgg

SEQ ID NO: 13171 - DNA, 201 bp, Homo sapiens
gaggcagtgatgtcacgggactcggagatgagccgtgtcctgcagatgatggaccaaatagcacacagttacccttccaagaacaggacagctctcctggrgcgcatgatggggaagacatccaacccattggcccccaaagcactttttgtgaagtccccctcctgaactcactcactgtgccttccagcctcagctggg

SEQ ID NO: 13172 - DNA, 201 bp, Homo sapiens
ccgacgagtccggaggggctgccgcgggagcccccaggtttccctagatgacaaataaacattccttttcctgcgtgaagatagtctgtggaaaccttggycatggcatcgatatcagagcctgttacattcagagagttctgcccgttgtactatctcctcaatgccattccgacaaagatccagaagggtttccgctct

SEQ ID NO: 13173 - DNA, 201 bp, Homo sapiens
ccagctccgtggccagcgagccaaggagcaggagcagctcgctcaactccaccgacagcggctccgggctcctgccccctgggctccaggccacccctgarctgggcaagggcagccagcccctgtcacagagattcaacgccatcagctcagaggactttgaccaggagcttgtcgtgaagcctatcaaagtgaaaagga

SEQ ID NO: 13174 - DNA, 201 bp, Homo sapiens
gccaaggagcaggagcagctcgctcaactccaccgacagcggctccgggctcctgccccctgggctccaggccacccctgagctgggcaagggcagccagyccctgtcacagagattcaacgccatcagctcagaggactttgaccaggagcttgtcgtgaagcctatcaaagtgaaaaggaagaagaagaagaagaagac

SEQ ID NO: 13175 - DNA, 201 bp, Homo sapiens; identical to SEQ ID NO: 13163

SEQ ID NO: 13176 - DNA, 201 bp, Homo sapiens; identical to SEQ ID NO: 13164

SEQ ID NO: 13177 - DNA, 201 bp, Homo sapiens
cgagtgggaggtcatctgaaggagccctggccgagtcacgcggaggggcccggcgtctgtggcgggcacaggggcttcggagtgactccctggtggacgcrctgcctcaacacttgtccagacacctctggccaggttggacccgcacacttactttcatctatgttggtttctgtctcgttccagaacccacagcctcca

SEQ ID NO: 13178 - DNA, 201 bp, Homo sapiens
cctcaacacttgtccagacacctctggccaggttggacccgcacacttactttcatctatgttggtttctgtctcgttccagaacccacagcctccacccrtggctggcgtgattgctgcagcagtggcgcctcctagctcaggacagtggcgactgcccggctgcatgcactccgattacccacgtgctgccgtcctggt

SEQ ID NO: 13179 - DNA, 201 bp, Homo sapiens
ccgcaccgcaccgcaccgtacctcgccacatctcaccacaccacaccacaccacacctcactgcccacacacggcgcaggctgcccgcctcctggagagcrcacttcagctgaaacagtaaagcctgatgggtgcaaatggaacctggatgtgtgcacgtgtgtcccaggtagggacggcacaggagggtgcatggggcgt

SEQ ID NO: 13180 - DNA, 201 bp, Homo sapiens; identical to SEQ ID NO: 13169

SEQ ID NO: 13181 - DNA, 201 bp, Homo sapiens
gcaccgcaccgcaccgtacctcgccacatctcaccacaccacaccacaccacacctcactgcccacacacggcgcaggctgcccgcctcctggagagcacwcttcagctgaaacagtaaagcctgatgggtgcaaatggaacctggatgtgtgcacgtgtgtcccaggtagggacggcacaggagggtgcatggggcgtgg

SEQ ID NO: 13182 - DNA, 201 bp, Homo sapiens
aagcaggcctgaaggattaacatcaacagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcgg

SEQ ID NO: 13183 - DNA, 201 bp, Homo sapiens
cccaccctgaggacctggaggacgagtgggaggtcatctgaaggagccctggccgagtcacgcggaggggcccggcgtctgtggcgggcacaggggcttcrgagtgactccctggtggacgcgctgcctcaacacttgtccagacacctctggccaggttggacccgcacacttactttcatctatgttggtttctgtctc

SEQ ID NO: 13184 - DNA, 201 bp, Homo sapiens; identical to SEQ ID NO: 13165

SEQ ID NO: 13185 - DNA, 201 bp, Homo sapiens; identical to SEQ ID NO: 13166

SEQ ID NO: 13186 - DNA, 201 bp, Homo sapiens; identical to SEQ ID NO: 13167

SEQ ID NO: 13187 - DNA, 201 bp, Homo sapiens; identical to SEQ ID NO: 13168

SEQ ID NO: 13188 - DNA, 201 bp, Homo sapiens; identical to SEQ ID NO: 13171

SEQ ID NO: 13189 - DNA, 201 bp, Homo sapiens
aaaatacctcatttcaaatcaaatcttacaaatttagaagagagatatgttttccgaaaacagtggaagccctttgttccttcccgggtttgtcctgagcytgcactgtcctcgcctgcagcctcagaggggcaggcatccccgcacagacttgactggcagggcggtcacgggacctgcgggctggctccgagtggcagc

SEQ ID NO: 13190 - DNA, 201 bp, Homo sapiens
ttcaaatcaaatcttacaaatttagaagagagatatgttttccgaaaacagtggaagccctttgttccttcccgggtttgtcctgagcctgcactgtcctygcctgcagcctcagaggggcaggcatccccgcacagacttgactggcagggcggtcacgggacctgcgggctggctccgagtggcagcccatgccttctg

SEQ ID NO: 13191 - DNA, 201 bp, Homo sapiens; identical to SEQ ID NO: 13173

SEQ ID NO: 13192 - DNA, 201 bp, Homo sapiens; identical to SEQ ID NO: 13172

SEQ ID NO: 13193 - DNA, 201 bp, Homo sapiens
cctgcagcctcagaggggcaggcatccccgcacagacttgactggcagggcggtcacgggacctgcgggctggctccgagtggcagcccatgccttctgcrgggtatgggttgacacttgacaggttgaaaccagtgcctctatggacggctgctgtggccccttcagacaatgggcagtgcccaccccgcccactggcat

SEQ ID NO: 13194 - DNA, 201 bp, Homo sapiens; identical to SEQ ID NO: 13174

SEQ ID NO: 13195 - DNA, 201 bp, Homo sapiens
cggggtatgggttgacacttgacaggttgaaaccagtgcctctatggacggctgctgtggccccttcagacaatgggcagtgcccaccccgcccactggcrtctgcgtgtgagggctaggccgccctgccacacatcccgccccctcccggaggcagcttcaggacaggacaccaggctggctgctttttttagcctgccc

SEQ ID NO: 13196 - DNA, 201 bp, Homo sapiens; identical to SEQ ID NO: 13163

SEQ ID NO: 13197 - DNA, 201 bp, Homo sapiens; identical to SEQ ID NO: 13164

SEQ ID NO: 13198 - DNA, 201 bp, Homo sapiens; identical to SEQ ID NO: 13177

SEQ ID NO: 13199 - DNA, 201 bp, Homo sapiens; identical to SEQ ID NO: 13178

SEQ ID NO: 13200 - DNA, 201 bp, Homo sapiens; identical to SEQ ID NO: 13179

SEQ ID NO: 13201 - DNA, 201 bp, Homo sapiens; identical to SEQ ID NO: 13169

SEQ ID NO: 13202 - DNA, 201 bp, Homo sapiens; identical to SEQ ID NO: 13181

SEQ ID NO: 13203 - DNA, 201 bp, Homo sapiens; identical to SEQ ID NO: 13182

SEQ ID NO: 13204 - DNA, 201 bp, Homo sapiens; identical to SEQ ID NO: 13183

SEQ ID NO: 13205 - DNA, 201 bp, Homo sapiens; identical to SEQ ID NO: 13165

SEQ ID NO: 13206 - DNA, 201 bp, Homo sapiens; identical to SEQ ID NO: 13166

SEQ ID NO: 13207 - DNA, 201 bp, Homo sapiens; identical to SEQ ID NO: 13167

SEQ ID NO: 13208 - DNA, 201 bp, Homo sapiens; identical to SEQ ID NO: 13168

SEQ ID NO: 13209 - DNA, 201 bp, Homo sapiens; identical to SEQ ID NO: 13171

SEQ ID NO: 13210 - DNA, 201 bp, Homo sapiens; identical to SEQ ID NO: 13189

SEQ ID NO: 13211 - DNA, 201 bp, Homo sapiens; identical to SEQ ID NO: 13190

SEQ ID NO: 13212 - DNA, 201 bp, Homo sapiens; identical to SEQ ID NO: 13173

SEQ ID NO: 13213 - DNA, 201 bp, Homo sapiens; identical to SEQ ID NO: 13172

SEQ ID NO: 13214 - DNA, 201 bp, Homo sapiens; identical to SEQ ID NO: 13193

SEQ ID NO: 13215 - DNA, 201 bp, Homo sapiens; identical to SEQ ID NO: 13174

SEQ ID NO: 13216 - DNA, 201 bp, Homo sapiens; identical to SEQ ID NO: 13195

SEQ ID NO: 13217 - DNA, 201 bp, Homo sapiens; identical to SEQ ID NO: 13163

SEQ ID NO: 13218 - DNA, 201 bp, Homo sapiens; identical to SEQ ID NO: 13164

SEQ ID NO: 13219 - DNA, 201 bp, Homo sapiens; identical to SEQ ID NO: 13177

SEQ ID NO: 13220 - DNA, 201 bp, Homo sapiens; identical to SEQ ID NO: 13178

SEQ ID NO: 13221 - DNA, 201 bp, Homo sapiens; identical to SEQ ID NO: 13179

SEQ ID NO: 13222 - DNA, 201 bp, Homo sapiens; identical to SEQ ID NO: 13169

SEQ ID NO: 13223 - DNA, 201 bp, Homo sapiens; identical to SEQ ID NO: 13181

SEQ ID NO: 13224 - DNA, 201 bp, Homo sapiens; identical to SEQ ID NO: 13182

SEQ ID NO: 13225 - DNA, 201 bp, Homo sapiens; identical to SEQ ID NO: 13183

SEQ ID NO: 13226 - DNA, 201 bp, Homo sapiens; identical to SEQ ID NO: 13165

SEQ ID NO: 13227 - DNA, 201 bp, Homo sapiens; identical to SEQ ID NO: 13166

SEQ ID NO: 13228 - DNA, 201 bp, Homo sapiens; identical to SEQ ID NO: 13167

SEQ ID NO: 13229 - DNA, 201 bp, Homo sapiens; identical to SEQ ID NO: 13168

SEQ ID NO: 13230 - DNA, 201 bp, Homo sapiens; identical to SEQ ID NO: 13171

SEQ ID NO: 13231 - DNA, 201 bp, Homo sapiens; identical to SEQ ID NO: 13189

SEQ ID NO: 13232 - DNA, 201 bp, Homo sapiens; identical to SEQ ID NO: 13190

SEQ ID NO: 13233 - DNA, 201 bp, Homo sapiens; identical to SEQ ID NO: 13173

SEQ ID NO: 13234 - DNA, 201 bp, Homo sapiens; identical to SEQ ID NO: 13172

SEQ ID NO: 13235 - DNA, 201 bp, Homo sapiens; identical to SEQ ID NO: 13193

SEQ ID NO: 13236 - DNA, 201 bp, Homo sapiens; identical to SEQ ID NO: 13174

SEQ ID NO: 13237 - DNA, 201 bp, Homo sapiens; identical to SEQ ID NO: 13195

SEQ ID NO: 13238 - DNA, 201 bp, Homo sapiens
gttaaagataaggtgtttaaggataattgctgcaagagagaaattctggctcttcagatctattgtcggaatgaaagcagaggttgtgcagagcagttaaygctgggacatctgctggtgcatttaaaaaatgattgccattttgaagaacttccatgtgtgcgtcctgactgcaaagaaaaggtcttgaggaaagacctg

SEQ ID NO: 13239 - DNA, 201 bp, Homo sapiens
tccggcccttccggcagaactgggaggaagcagacagcatgaagagcagcgtggagtccctccagaaccgcgtgaccgagctggagagcgtggacaagagygcggggcaagtggctcggaacacaggcctgctggagtcccagctgagccggcatgaccagatgctgagtgtgcacgacatccgcctagccgacatggacc

SEQ ID NO: 13240 - DNA, 201 bp, Homo sapiens
tcatctggaagattcgcgactacaagcggcggaagcaggaggccgtcatggggaagaccctgtccctttacagccagcctttctacactggttactttggytataagatgtgtgccagggtctacctgaacggggacgggatggggaaggggacgcacttgtcgctgttttttgtcatcatgcgtggagaatatgatgccc

SEQ ID NO: 13241 - DNA, 201 bp, Homo sapiens
tccaccaccccttcctccccagagcagtctctgccgagggacagcacctgtgtcccttcgatgccacaacagccagttgaacaggggagccctttgctcargcagcttctcctgcctctccctcctttctccttccctgccccatccccgtgcccttcttggcctgtggcgctggggagccatggtgtggcatactggggc

SEQ ID NO: 13242 - DNA, 201 bp, Homo sapiens
caaattcaatgacttaattggaaaacacacaagctggcatgatgtccggtgatttctgtaagaaatgcctgtaggagaaggtctgtgaagtgtggagggcrgtgtcgacgctgcacagcatctgcagattcgcagcctcttctctgccggtgcctctgttcggttctgttacccaaaaacaaagaccaaagaaggccaatc

SEQ ID NO: 13243 - DNA, 201 bp, Homo sapiens
acagaagagaactcctctttcctaaaatggagtcgagtaaaaagatggactctcctggcgcgctgcagactaacccgccgctaaagctgcacactgaccgyagtgctgggacgccagtttttgtccctgaacaaggaggttacaaggaaaagtttgtgaagaccgtggaggacaagtacaagtgtgagaagtgccacctgg

SEQ ID NO: 13244 - DNA, 201 bp, Homo sapiens
caacgtcacattccagcaccccttttgcttgatggcgtctggtggtagtcagcatggtggacccacatcctacagccagaggtgatgttggacaaaggaargggagtctggatgggtccttaaacgaccattctgtccgcagcggggtcattccttgtcagcccaagggagggccggggagtacactgatcccaacagctg

SEQ ID NO: 13245 - DNA, 201 bp, Homo sapiens
gccggggttgcagcccagccgggactttccagccggcggcagccgcggcggccgccggctcttccccgccccccgccatggggcagcccggggagcagaaygctgcggaccgcggcggaggacgcgcccggcgcccctgagccggccgagcggcgacggaccgcgagatgaggaaaatgaggcccaaagaagtgatgccac

SEQ ID NO: 13246 - DNA, 201 bp, Homo sapiens
caagctggcatgatgtccggtgatttctgtaagaaatgcctgtaggagaaggtctgtgaagtgtggagggcagtgtcgacgctgcacagcatctgcagatkcgcagcctcttctctgccggtgcctctgttcggttctgttacccaaaaacaaagaccaaagaaggccaatctctcatttgaccctgtctttttaatctgc

SEQ ID NO: 13247 - DNA, 201 bp, Homo sapiens
acggggaggattggcctgaggaccgtcaccctgtgcacagccccagtagggtggcagtgccactgtctccttgggccgttgcaggattgggcgggtgcagmctccccttgcgggccccttgctcaatccccggccctcccagactcctccctctactgggggtaatttgtgtgtcagaagggctctggcagagctgtaaaa

SEQ ID NO: 13248 - DNA, 201 bp, Homo sapiens
gcttccaggtcctggagaccgccagctacaatggagtgctcatctggaagattcgcgactacaagcggcggaagcaggaggccgtcatggggaagaccctstccctttacagccagcctttctacactggttactttggctataagatgtgtgccagggtctacctgaacggggacgggatggggaaggggacgcacttgt

SEQ ID NO: 13249 - DNA, 201 bp, Homo sapiens
agccccgacatacgctgggcctttcagctcgccgtgctctggtgacacacaggcggccaggttgggatttgtgtcaattctaggagccatcaagcatgaawgtggttctgtctcctgagcgcaagcctcgccggacccctgggcgaaggcctggacttgcagatgtgtgttccctgtgcgggtggacagagggggccctta

SEQ ID NO: 13250 - DNA, 201 bp, Homo sapiens
ccatagttctgttttccgtttgcaaatctcagtagctctgttttctccaaagtagaatgtgcgcaccggggtcctagccaggcgaggtcagtgtcggcagrctacctggtcattattgctgcctcgtccaggctgatgctgatggtcacaggcacggtggcatcagggagccgggccagcaggcggcgtgaggcggggcca

SEQ ID NO: 13251 - DNA, 201 bp, Homo sapiens
ccacttcctcagcccgggccccacaggcccaccacctgccagggctcccactgcactggctgtggcaggaggcttccccatgaccccgtgtggcccagctyggtgaggatgcagttctaggcacagcccctgggacagccagctgcctcccagaccacgtcagcctgctccagggtcctcagtcaccctgggccaggggcc

SEQ ID NO: 13252 - DNA, 201 bp, Homo sapiens; identical to SEQ ID NO: 13238

SEQ ID NO: 13253 - DNA, 201 bp, Homo sapiens; identical to SEQ ID NO: 13239

SEQ ID NO: 13254 - DNA, 201 bp, Homo sapiens; identical to SEQ ID NO: 13240

SEQ ID NO: 13255 - DNA, 201 bp, Homo sapiens; identical to SEQ ID NO: 13241

SEQ ID NO: 13256 - DNA, 201 bp, Homo sapiens; identical to SEQ ID NO: 13242

SEQ ID NO: 13257 - DNA, 201 bp, Homo sapiens
gaccgcgagaactcctctttcctaaaatggagtcgagtaaaaagatggactctcctggcgcgctgcagactaacccgccgctaaagctgcacactgaccgyagtgctgggacgccagtttttgtccctgaacaaggaggttacaaggaaaagtttgtgaagaccgtggaggacaagtacaagtgtgagaagtgccacctgg

SEQ ID NO: 13258 - DNA, 201 bp, Homo sapiens; identical to SEQ ID NO: 13244

SEQ ID NO: 13259 - DNA, 201 bp, Homo sapiens
gccggggttgcagcccagccgggactttccagccggcggcagccgcggcggccgccggctcttccccgccccccgccatggggcagcccggggagcagaaygctgcggaccgcggcggaggacgcgcccggcgcccctgagccggccgagcggcgacggaccgcgagaactcctctttcctaaaatggagtcgagtaaaaa

SEQ ID NO: 13260 - DNA, 201 bp, Homo sapiens; identical to SEQ ID NO: 13246

SEQ ID NO: 13261 - DNA, 201 bp, Homo sapiens; identical to SEQ ID NO: 13247

SEQ ID NO: 13262 - DNA, 201 bp, Homo sapiens; identical to SEQ ID NO: 13248

SEQ ID NO: 13263 - DNA, 201 bp, Homo sapiens; identical to SEQ ID NO: 13249

SEQ ID NO: 13264 - DNA, 201 bp, Homo sapiens; identical to SEQ ID NO: 13250

SEQ ID NO: 13265 - DNA, 201 bp, Homo sapiens; identical to SEQ ID NO: 13251

SEQ ID NO: 13266 - DNA, 201 bp, Homo sapiens; identical to SEQ ID NO: 13238

SEQ ID NO: 13267 - DNA, 201 bp, Homo sapiens; identical to SEQ ID NO: 13239

SEQ ID NO: 13268 - DNA, 201 bp, Homo sapiens; identical to SEQ ID NO: 13240

SEQ ID NO: 13269 - DNA, 201 bp, Homo sapiens; identical to SEQ ID NO: 13241

SEQ ID NO: 13270 - DNA, 201 bp, Homo sapiens; identical to SEQ ID NO: 13242

SEQ ID NO: 13271 - DNA, 201 bp, Homo sapiens; identical to SEQ ID NO: 13243

SEQ ID NO: 13272 - DNA, 201 bp, Homo sapiens; identical to SEQ ID NO: 13244

SEQ ID NO: 13273 - DNA, 201 bp, Homo sapiens; identical to SEQ ID NO: 13245

SEQ ID NO: 13274 - DNA, 201 bp, Homo sapiens; identical to SEQ ID NO: 13246

SEQ ID NO: 13275 - DNA, 201 bp, Homo sapiens; identical to SEQ ID NO: 13247

SEQ ID NO: 13276 - DNA, 201 bp, Homo sapiens; identical to SEQ ID NO: 13248

SEQ ID NO: 13277 - DNA, 201 bp, Homo sapiens; identical to SEQ ID NO: 13249

SEQ ID NO: 13278 - DNA, 201 bp, Homo sapiens; identical to SEQ ID NO: 13250

SEQ ID NO: 13279 - DNA, 201 bp, Homo sapiens; identical to SEQ ID NO: 13251

SEQ ID NO: 13280 - DNA, 201 bp, Homo sapiens
gtttcatttattctttggctgccatacctggatatatggttctcttgaggtgtatgaaatctgaagagaagtcccttggtgtgggattacatacattttgyacaagagtatttgctggcattcctgcacctatatattttggcgctttaatggattccacatgtttacactggggaactttgaaatgtggtgagtcagggg

SEQ ID NO: 13281 - DNA, 201 bp, Homo sapiens
cttttttcagaattagagaacatgctgtacaacttaattgttttaaaaatcagtagagatataatagataactttttcttgtctttaagaacctaaaaaamctcttaactcaaaataataaaatgttcactaatgatatttctaaggtatcagtgacacttgagttttcctaggagggacatcaataacagccccctaaag

SEQ ID NO: 13282 - DNA, 201 bp, Homo sapiens
aagatttatatgtggaaaatgacatctttgctgattgcaatgtggattgcaactgtccatctaaaatatgggatcctgtgtgtggaaacaatggcttgtcrtatctgtcagcttgtcttgctggttgtgagacatccattggaacgggaataaacatggtgttccaaaattgcagctgtattcaaacatcaggaaattcat

SEQ ID NO: 13283 - DNA, 201 bp, Homo sapiens
ttggacttttgttggcatcattctgtgcaaatgtttatgttgacactggatttgtgaacacagatgatctgatcataactcccactgacactcgttgggtyggtgcatggtggtttggctttctgatttgtgcaggagttaacgtgctcactgccattccttttttctttttgcccaacacacttccaaaggaaggactag

SEQ ID NO: 13284 - DNA, 201 bp, Homo sapiens
acactggatttgtgaacacagatgatctgatcataactcccactgacactcgttgggtcggtgcatggtggtttggctttctgatttgtgcaggagttaaygtgctcactgccattccttttttctttttgcccaacacacttccaaaggaaggactagagactaatgctgacatcattaaaaatgaaaatgaagacaaac

SEQ ID NO: 13285 - DNA, 201 bp, Homo sapiens
aaataataaaatgttcactaatgatatttctaaggtatcagtgacacttgagttttcctaggagggacatcaataacagccccctaaagaagattcttagmgccagctttatttttatgttgaaacagcaatttcccttaattcatcgaagtaagggtgtacttcctacatctccttctactaatacttctaaaaattttc

SEQ ID NO: 13286 - DNA, 201 bp, Homo sapiens
ttatagagacaaaagtcaaagggaaggaaaatgagtgcaaagatatataccaaaagtccacggttttgaaagatgatgaattgaaaactaaattgtaattktcctattatattacttttttcagaattagagaacatgctgtacaacttaattgttttaaaaatcagtagagatataatagataactttttcttgtcttta

SEQ ID NO: 13287 - DNA, 201 bp, Homo sapiens
gggtagaagtaagacatatcaagatttaaaacataaatagcttggaacaccctgaagagcaacatgggagaaactgagaaaagaattgaaacccatagaayaagatgtctttccaagttgaagatgtttctgttggcaataacatgtgcatttgtatccaaaacactgtctggatcttatatgaattccatgctcacacaa

SEQ ID NO: 13288 - DNA, 201 bp, Homo sapiens
ttttaagaccaacgcaggatccatcagagtgtacaaaggaagttaaatcattaatgtgggtgtacgtcctagtaggcaatattgtacgtggaatgggtgamactcccatcctgcctttgggtatttcctatatagaagattttgccaaatttgaaaattctcctttatatattgggcttgtagaaacaggagctattattg

SEQ ID NO: 13289 - DNA, 201 bp, Homo sapiens
cttatagagacaaaagtcaaagggaaggaaaatgagtgcaaagatatataccaaaagtccacggttttgaaagatgatgaattgaaaactaaattgtaatygtcctattatattacttttttcagaattagagaacatgctgtacaacttaattgttttaaaaatcagtagagatataatagataactttttcttgtcttt

SEQ ID NO: 13290 - DNA, 201 bp, Homo sapiens
ggttatgggcttaggctgtttcttaaaatcactacctcatttcctcatgaaccaatatgaatatgaatctacagtttcagtttcaggcaacttgtcctcawacagtttcttgtgtatggaaaatggaacccagattttaagaccaacgcaggatccatcagagtgtacaaaggaagttaaatcattaatgtgggtgtacgt

SEQ ID NO: 13291 - DNA, 201 bp, Homo sapiens; identical to SEQ ID NO: 13280

SEQ ID NO: 13292 - DNA, 201 bp, Homo sapiens; identical to SEQ ID NO: 13281

SEQ ID NO: 13293 - DNA, 201 bp, Homo sapiens; identical to SEQ ID NO: 13282

SEQ ID NO: 13294 - DNA, 201 bp, Homo sapiens; identical to SEQ ID NO: 13283

SEQ ID NO: 13295 - DNA, 201 bp, Homo sapiens; identical to SEQ ID NO: 13284

SEQ ID NO: 13296 - DNA, 201 bp, Homo sapiens; identical to SEQ ID NO: 13285

SEQ ID NO: 13297 - DNA, 201 bp, Homo sapiens; identical to SEQ ID NO: 13286

SEQ ID NO: 13298 - DNA, 201 bp, Homo sapiens; identical to SEQ ID NO: 13287

SEQ ID NO: 13299 - DNA, 201 bp, Homo sapiens; identical to SEQ ID NO: 13288

SEQ ID NO: 13300 - DNA, 201 bp, Homo sapiens; identical to SEQ ID NO: 13289

SEQ ID NO: 13301 - DNA, 201 bp, Homo sapiens; identical to SEQ ID NO: 13290

SEQ ID NO: 13302 - DNA, 201 bp, Homo sapiens
gtttcatttattctttggctgccatacctggatatatggttctcttgaggtgtatgaaatctgaagagaagtcccttggtgtgggattacatacattttgyacaagagtatttggtaaaaatagttattttttcccacatcctatcagaacaatattattattattattttttattacactttaagttttagggtacatgt

SEQ ID NO: 13303 - DNA, 201 bp, Homo sapiens
tatacatgtgccatgttggtgtgctgcacccattaactcatcatttaacattaggtgaatctcctaatgctatccctccccccttcccccaccccacaacrggccgtggtgtgtgatgttccccttcctgtgtccatgtgcagaacaatattaaatactagataaacaaggtaatattatttcagaaaagcagtctagcaa

SEQ ID NO: 13304 - DNA, 201 bp, Homo sapiens; identical to SEQ ID NO: 13282

SEQ ID NO: 13305 - DNA, 201 bp, Homo sapiens
ctgtgtccatgtgcagaacaatattaaatactagataaacaaggtaatattatttcagaaaagcagtctagcaaatgtcccttctgtatgtaaaaagcacrttataaatatgagaatgcagcacacaaagagatagagaatctcttttacttgaaaaggccctgtctgaccttaattacactattctttgtttgaagattt

SEQ ID NO: 13306 - DNA, 201 bp, Homo sapiens; identical to SEQ ID NO: 13283

SEQ ID NO: 13307 - DNA, 201 bp, Homo sapiens
ctgaagagaagtcccttggtgtgggattacatacattttgcacaagagtatttggtaaaaatagttattttttcccacatcctatcagaacaatattattmttattattttttattacactttaagttttagggtacatgtgcacaacgtgcaggtttgttacatatgtatacatgtgccatgttggtgtgctgcacccat

SEQ ID NO: 13308 - DNA, 201 bp, Homo sapiens; identical to SEQ ID NO: 13284

SEQ ID NO: 13309 - DNA, 201 bp, Homo sapiens
tgaagagaagtcccttggtgtgggattacatacattttgcacaagagtatttggtaaaaatagttattttttcccacatcctatcagaacaatattattaktattattttttattacactttaagttttagggtacatgtgcacaacgtgcaggtttgttacatatgtatacatgtgccatgttggtgtgctgcacccatt

SEQ ID NO: 13310 - DNA, 201 bp, Homo sapiens; identical to SEQ ID NO: 13288

SEQ ID NO: 13311 - DNA, 201 bp, Homo sapiens; identical to SEQ ID NO: 13290

SEQ ID NO: 13312 - DNA, 201 bp, Homo sapiens
atcctatcagaacaatattattattattattttttattacactttaagttttagggtacatgtgcacaacgtgcaggtttgttacatatgtatacatgtgycatgttggtgtgctgcacccattaactcatcatttaacattaggtgaatctcctaatgctatccctccccccttcccccaccccacaacaggccgtggtg

SEQ ID NO: 13313 - DNA, 201 bp, Homo sapiens; identical to SEQ ID NO: 13280

SEQ ID NO: 13314 - DNA, 201 bp, Homo sapiens; identical to SEQ ID NO: 13281

SEQ ID NO: 13315 - DNA, 201 bp, Homo sapiens; identical to SEQ ID NO: 13282

SEQ ID NO: 13316 - DNA, 201 bp, Homo sapiens; identical to SEQ ID NO: 13283

SEQ ID NO: 13317 - DNA, 201 bp, Homo sapiens; identical to SEQ ID NO: 13284

SEQ ID NO: 13318 - DNA, 201 bp, Homo sapiens; identical to SEQ ID NO: 13285

SEQ ID NO: 13319 - DNA, 201 bp, Homo sapiens; identical to SEQ ID NO: 13286

SEQ ID NO: 13320 - DNA, 201 bp, Homo sapiens; identical to SEQ ID NO: 13287

SEQ ID NO: 13321 - DNA, 201 bp, Homo sapiens; identical to SEQ ID NO: 13288

SEQ ID NO: 13322 - DNA, 201 bp, Homo sapiens; identical to SEQ ID NO: 13289

SEQ ID NO: 13323 - DNA, 201 bp, Homo sapiens; identical to SEQ ID NO: 13290

SEQ ID NO: 13324 - DNA, 201 bp, Homo sapiens
ccactcaggtgtcttgatgtgtcgggggtgtggctgcctgccccctgatgctccctgccccaccctgtgcagtaggaacccagccatggtgaacgaagccwgaggaaacagcagcctcaacccctgcttggagggcagtgccagcagtggcagtgagagctccaaagatagttcgagatgttccaccccgggcctggaccc

SEQ ID NO: 13325 - DNA, 201 bp, Homo sapiens
accatcctgcacatgacctgctgccgtcagcgcctggaggagatcacgggccatctgcacaaagctaagcagctgggcctgaagaacatcatggcgctgcrgggagacccaataggtgaccagtgggaagaggaggagggaggcttcaactacgcagtggacctggtgaagcacatccgaagtgagtttggtgactacttt

SEQ ID NO: 13326 - DNA, 201 bp, Homo sapiens
gccagcagtggcagtgagagctccaaagatagttcgagatgttccaccccgggcctggaccccgagcggcatgagagactccgggagaagatgaggcggcrattggaatctggtgacaagtggttctccctggaattcttccctcctcgaactgctgagggagctgtcaatctcatctcaaggtttgaccggatggcagca

SEQ ID NO: 13327 - DNA, 201 bp, Homo sapiens
actactacctcttctacctgaagagcaagtcccccaaggaggagctgctgaagatgtggggggaggagctgaccagtgaagaaagtgtctttgaagtcttygttctttacctctcgggagaaccaaaccggaatggtcacaaagtgacttgcctgccctggaacgatgagcccctggcggctgagaccagcctgctgaagg

SEQ ID NO: 13328 - DNA, 201 bp, Homo sapiens
gcctttggggagctgaaggactactacctcttctacctgaagagcaagtcccccaaggaggagctgctgaagatgtggggggaggagctgaccagtgaagmaagtgtctttgaagtctttgttctttacctctcgggagaaccaaaccggaatggtcacaaagtgacttgcctgccctggaacgatgagcccctggcggct

SEQ ID NO: 13329 - DNA, 201 bp, Homo sapiens
gcaattcctcttcccctgcctttggggagctgaaggactactacctcttctacctgaagagcaagtcccccaaggaggagctgctgaagatgtggggggakgagctgaccagtgaagaaagtgtctttgaagtctttgttctttacctctcgggagaaccaaaccggaatggtcacaaagtgacttgcctgccctggaacg

SEQ ID NO: 13330 - DNA, 201 bp, Homo sapiens
gatggcagcaggtggccccctctacatagacgtgacctggcacccagcaggtgaccctggctcagacaaggagacctcctccatgatgatcgccagcaccrccgtgaactactgtggcctggagaccatcctgcacatgacctgctgccgtcagcgcctggaggagatcacgggccatctgcacaaagctaagcagctggg

SEQ ID NO: 13331 - DNA, 201 bp, Homo sapiens
ccgcgagatggctaccacagaggtgctgaagcgcctggggatgtggactgaggaccccaggcgtcccctaccctgggctctcagcgcccaccccaagcgcygagaggaagatgtacgtcccatcttctgggcctccagaccaaagagttacatctaccgtacccaggagtgggacgagttccctaacggccgctggggcaa

SEQ ID NO: 13332 - DNA, 201 bp, Homo sapiens
tgaactgcagccgaatgctgtcacttggggcatcttccctgggcgagagatcatccagcccaccgtagtggatcccgtcagcttcatgttctggaaggacraggcctttgccctgtggattgagcggtggggaaagctgtatgaggaggagtccccgtcccgcaccatcatccagtacatccacgacaactacttcctggt

SEQ ID NO: 13333 - DNA, 201 bp, Homo sapiens
ggcctgatgctgccccgttccctgtcagaggctaagatgagatttgccactgggatttcttcgctgctctagctggcaggacacatcccggcctcttcttccacccattcccccatgtggctgaagacattccaacaatggggtgggcccataatagttagccctcagtcagttcccggagcacagccctgggagggggct

SEQ ID NO: 13334 - DNA, 201 bp, Homo sapiens
aggcctgatgctgccccgttccctgtcagaggctaagatgagatttgccactgggatttcttcgctgctctagctggcaggacacatcccggcctcttcttccacccattcccccatgtggctgaagacattccaacaatggggtgggcccataatagttagccctcagtcagttcccggagcacagccctgggagggggc

SEQ ID NO: 13335 - DNA, 201 bp, Homo sapiens
gaggcctgatgctgccccgttccctgtcagaggctaagatgagatttgccactgggatttcttcgctgctctagctggcaggacacatcccggcctcttcttccacccattcccccatgtggctgaagacattccaacaatggggtgggcccataatagttagccctcagtcagttcccggagcacagccctgggaggggg

SEQ ID NO: 13336 - DNA, 201 bp, Homo sapiens
gaggaaacagcagcctcaacccctgcttggagggcagtgccagcagtggcagtgagagctccaaagatagttcgagatgttccaccccgggcctggacccygagcggcatgagagactccgggagaagatgaggcggcgattggaatctggtgacaagtggttctccctggaattcttccctcctcgaactgctgagggag

SEQ ID NO: 13337 - DNA, 201 bp, Homo sapiens
tgtgtggcaggttaccccaaaggccaccccgaagcagggagctttgaggctgacctgaagcacttgaaggagaaggtgtctgcgggagccgatttcatcaycacgcagcttttctttgaggctgacacattcttccgctttgtgaaggcatgcaccgacatgggcatcacttgccccatcgtccccgggatctttcccatc

SEQ ID NO: 13338 - DNA, 201 bp, Homo sapiens
caccccaagcgccgagaggaagatgtacgtcccatcttctgggcctccagaccaaagagttacatctaccgtacccaggagtgggacgagttccctaacgrccgctggggcaattcctcttcccctgcctttggggagctgaaggactactacctcttctacctgaagagcaagtcccccaaggaggagctgctgaagatg

SEQ ID NO: 13339 - DNA, 201 bp, Homo sapiens
acttctacaccctcaaccgcgagatggctaccacagaggtgctgaagcgcctggggatgtggactgaggaccccaggcgtcccctaccctgggctctcagygcccaccccaagcgccgagaggaagatgtacgtcccatcttctgggcctccagaccaaagagttacatctaccgtacccaggagtgggacgagttcccta

SEQ ID NO: 13340 - DNA, 201 bp, Homo sapiens
gtggcaggttaccccaaaggccaccccgaagcagggagctttgaggctgacctgaagcacttgaaggagaaggtgtctgcgggagccgatttcatcatcaygcagcttttctttgaggctgacacattcttccgctttgtgaaggcatgcaccgacatgggcatcacttgccccatcgtccccgggatctttcccatccag

SEQ ID NO: 13341 - DNA, 201 bp, Homo sapiens
aagcagggagctttgaggctgacctgaagcacttgaaggagaaggtgtctgcgggagccgatttcatcatcacgcagcttttctttgaggctgacacattyttccgctttgtgaaggcatgcaccgacatgggcatcacttgccccatcgtccccgggatctttcccatccagggctaccactcccttcggcagcttgtga

SEQ ID NO: 13342 - DNA, 201 bp, Homo sapiens
tactttgacatctgtgtggcaggttaccccaaaggccaccccgaagcagggagctttgaggctgacctgaagcacttgaaggagaaggtgtctgcgggagycgatttcatcatcacgcagcttttctttgaggctgacacattcttccgctttgtgaaggcatgcaccgacatgggcatcacttgccccatcgtccccggg

SEQ ID NO: 13343 - DNA, 201 bp, Homo sapiens
tggggcatcttccctgggcgagagatcatccagcccaccgtagtggatcccgtcagcttcatgttctggaaggacgaggcctttgccctgtggattgagcrgtggggaaagctgtatgaggaggagtccccgtcccgcaccatcatccagtacatccacgacaactacttcctggtcaacctggtggacaatgacttccca

SEQ ID NO: 13344 - DNA, 201 bp, Homo sapiens
gagctccgggttaattaccaccttgtcaatgtgaagggtgaaaacatcaccaatgcccctgaactgcagccgaatgctgtcacttggggcatcttccctgrgcgagagatcatccagcccaccgtagtggatcccgtcagcttcatgttctggaaggacgaggcctttgccctgtggattgagcggtggggaaagctgtat

SEQ ID NO: 13345 - DNA, 201 bp, Homo sapiens
gctccgggttaattaccaccttgtcaatgtgaagggtgaaaacatcaccaatgcccctgaactgcagccgaatgctgtcacttggggcatcttccctgggygagagatcatccagcccaccgtagtggatcccgtcagcttcatgttctggaaggacgaggcctttgccctgtggattgagcggtggggaaagctgtatga

SEQ ID NO: 13346 - DNA, 201 bp, Homo sapiens
gatgctgccatccgcaactatggcatcgagctggccgtgagcctgtgccaggagcttctggccagtggcttggtgccaggcctccacttctacaccctcarccgcgagatggctaccacagaggtgctgaagcgcctggggatgtggactgaggaccccaggcgtcccctaccctgggctctcagcgcccaccccaagcgc

SEQ ID NO: 13347 - DNA, 201 bp, Homo sapiens
tgcccctgaactgcagccgaatgctgtcacttggggcatcttccctgggcgagagatcatccagcccaccgtagtggatcccgtcagcttcatgttctggwaggacgaggcctttgccctgtggattgagcggtggggaaagctgtatgaggaggagtccccgtcccgcaccatcatccagtacatccacgacaactactt

SEQ ID NO: 13348 - DNA, 187 bp, Homo sapiens
aaggctagttcctttcaattccatttaaaaaacaaaaaccagcaggtgtggtggctcatggcgtaatgggcctgcccaatgctttgggaggccaaggcagrtagatcgcttgagcccaggagtttgagacaagccctggcaacatagtgagatcccatttctacaaaaaaaaaaaaaaaattagccg

SEQ ID NO: 13349 - DNA, 201 bp, Homo sapiens
aggaccccaggcgtcccctaccctgggctctcagcgcccaccccaagcgccgagaggaagatgtacgtcccatcttctgggcctccagaccaaagagttasatctaccgtacccaggagtgggacgagttccctaacggccgctggggcaattcctcttcccctgcctttggggagctgaaggactactacctcttctacc

SEQ ID NO: 13350 - DNA, 201 bp, Homo sapiens
agtgccagcagtggcagtgagagctccaaagatagttcgagatgttccaccccgggcctggaccccgagcggcatgagagactccgggagaagatgaggcsgcgattggaatctggtgacaagtggttctccctggaattcttccctcctcgaactgctgagggagctgtcaatctcatctcaaggtttgaccggatggca

SEQ ID NO: 13351 - DNA, 201 bp, Homo sapiens
aacgatgctgccatccgcaactatggcatcgagctggccgtgagcctgtgccaggagcttctggccagtggcttggtgccaggcctccacttctacacccycaaccgcgagatggctaccacagaggtgctgaagcgcctggggatgtggactgaggaccccaggcgtcccctaccctgggctctcagcgcccaccccaag

SEQ ID NO: 13352 - DNA, 112 bp, Homo sapiens
ccaatgctttgggaggccaaggcaggtagatcgcttgagcccaggagtttgagacaagccctggcaacatagtgagatcccatttctacaaaaaaaaaaaaaaaattagccg

SEQ ID NO: 13353 - DNA, 201 bp, Homo sapiens
ccctggcggctgagaccagcctgctgaaggaggagctgctgcgggtgaaccgccagggcatcctcaccatcaactcacagcccaacatcaacgggaagccrtcctccgaccccatcgtgggctggggccccagcgggggctatgtcttccagaaggcctacttagagtttttcacttcccgcgagacagcggaagcacttc

SEQ ID NO: 13354 - DNA, 201 bp, Homo sapiens
aacctggtggacaatgacttcccactggacaactgcctctggcaggtggtggaagacacattggagcttctcaacaggcccacccagaatgcgagagaaayggaggctccatgaccctgcgtcctgacgccctgcgttggagccactcctgtcccgccttcctcctccacagtgctgcttctcttgggaactccactctcc

SEQ ID NO: 13355 - DNA, 201 bp, Homo sapiens
tgctgccatccgcaactatggcatcgagctggccgtgagcctgtgccaggagcttctggccagtggcttggtgccaggcctccacttctacaccctcaacygcgagatggctaccacagaggtgctgaagcgcctggggatgtggactgaggaccccaggcgtcccctaccctgggctctcagcgcccaccccaagcgccg

SEQ ID NO: 13356 - DNA, 113 bp, Homo sapiens
cccaatgctttgggaggccaaggcaggtagatcgcttgagcccaggagtttgagacaagccctggcaacatagtgagatcccatttctacaaaaaaaaaaaaaaaattagccg

SEQ ID NO: 13357 - DNA, 201 bp, Homo sapiens
caaccgcgagatggctaccacagaggtgctgaagcgcctggggatgtggactgaggaccccaggcgtcccctaccctgggctctcagcgcccaccccaagygccgagaggaagatgtacgtcccatcttctgggcctccagaccaaagagttacatctaccgtacccaggagtgggacgagttccctaacggccgctgggg

SEQ ID NO: 13358 - DNA, 201 bp, Homo sapiens
ggtggcacctcctgagaaggcgaggagagtggttgttgccaactaagccctcgaaccaaggcagcctccagagccagcctgggactcccagtgaacttacmcttggagcccgtgcagtacaggcaaaacacgcaagggcatcaggcactggtggcatcgtagaagagatgtggcaaagtgctgtacccttccacctcctag

SEQ ID NO: 13359 - DNA, 179 bp, Homo sapiens
gccacagtggtgcggccggcggccgagcgttctgagtcacccgggactggagggccttcttcctgtgtggaaatacagygcctccggcttgaacctgccactcaggtgtcttgatgtgtcgggggtgtggctgcctgccccctgatgctccctgccccaccctgtgcagtaggaaccca

SEQ ID NO: 13360 - DNA, 201 bp, Homo sapiens
agacctcctccatgatgatcgccagcaccgccgtgaactactgtggcctggagaccatcctgcacatgacctgctgccgtcagcgcctggaggagatcacrggccatctgcacaaagctaagcagctgggcctgaagaacatcatggcgctgcggggagacccaataggtgaccagtgggaagaggaggagggaggcttca

SEQ ID NO: 13361 - DNA, 201 bp, Homo sapiens
ggatggcagcaggtggccccctctacatagacgtgacctggcacccagcaggtgaccctggctcagacaaggagacctcctccatgatgatcgccagcacmgccgtgaactactgtggcctggagaccatcctgcacatgacctgctgccgtcagcgcctggaggagatcacgggccatctgcacaaagctaagcagctgg

SEQ ID NO: 13362 - DNA, 201 bp, Homo sapiens
ccgggcctggaccccgagcggcatgagagactccgggagaagatgaggcggcgattggaatctggtgacaagtggttctccctggaattcttccctcctcraactgctgagggagctgtcaatctcatctcaaggtttgaccggatggcagcaggtggccccctctacatagacgtgacctggcacccagcaggtgaccct

SEQ ID NO: 13363 - DNA, 201 bp, Homo sapiens
cctgaagaacatcatggcgctgcggggagacccaataggtgaccagtgggaagaggaggagggaggcttcaactacgcagtggacctggtgaagcacatcygaagtgagtttggtgactactttgacatctgtgtggcaggttaccccaaaggccaccccgaagcagggagctttgaggctgacctgaagcacttgaagga

SEQ ID NO: 13364 - DNA, 201 bp, Homo sapiens
ctactgcccctcgctaggaatatgggcctcgcaggtcggcagcgtgaggtcctctgtgccaccttccatcagtaggaacccagccatggtgaacgaagccwgaggaaacagcagcctcaacccctgcttggagggcagtgccagcagtggcagtgagagctccaaagatagttcgagatgttccaccccgggcctggaccc

SEQ ID NO: 13365 - DNA, 201 bp, Homo sapiens; identical to SEQ ID NO: 13325

SEQ ID NO: 13366 - DNA, 201 bp, Homo sapiens; identical to SEQ ID NO: 13326

SEQ ID NO: 13367 - DNA, 201 bp, Homo sapiens; identical to SEQ ID NO: 13327

SEQ ID NO: 13368 - DNA, 201 bp, Homo sapiens; identical to SEQ ID NO: 13328

SEQ ID NO: 13369 - DNA, 201 bp, Homo sapiens; identical to SEQ ID NO: 13329

SEQ ID NO: 13370 - DNA, 201 bp, Homo sapiens; identical to SEQ ID NO: 13330

SEQ ID NO: 13371 - DNA, 201 bp, Homo sapiens; identical to SEQ ID NO: 13332

SEQ ID NO: 13372 - DNA, 201 bp, Homo sapiens; identical to SEQ ID NO: 13331

SEQ ID NO: 13373 - DNA, 201 bp, Homo sapiens; identical to SEQ ID NO: 13336

SEQ ID NO: 13374 - DNA, 201 bp, Homo sapiens; identical to SEQ ID NO: 13337

SEQ ID NO: 13375 - DNA, 201 bp, Homo sapiens; identical to SEQ ID NO: 13339

SEQ ID NO: 13376 - DNA, 201 bp, Homo sapiens; identical to SEQ ID NO: 13338

SEQ ID NO: 13377 - DNA, 201 bp, Homo sapiens; identical to SEQ ID NO: 13340

SEQ ID NO: 13378 - DNA, 201 bp, Homo sapiens; identical to SEQ ID NO: 13341

SEQ ID NO: 13379 - DNA, 201 bp, Homo sapiens; identical to SEQ ID NO: 13342

SEQ ID NO: 13380 - DNA, 201 bp, Homo sapiens; identical to SEQ ID NO: 13343

SEQ ID NO: 13381 - DNA, 201 bp, Homo sapiens; identical to SEQ ID NO: 13344

SEQ ID NO: 13382 - DNA, 201 bp, Homo sapiens; identical to SEQ ID NO: 13345

SEQ ID NO: 13383 - DNA, 201 bp, Homo sapiens; identical to SEQ ID NO: 13346

SEQ ID NO: 13384 - DNA, 201 bp, Homo sapiens; identical to SEQ ID NO: 13347

SEQ ID NO: 13385 - DNA, 201 bp, Homo sapiens; identical to SEQ ID NO: 13349

SEQ ID NO: 13386 - DNA, 201 bp, Homo sapiens; identical to SEQ ID NO: 13350

SEQ ID NO: 13387 - DNA, 201 bp, Homo sapiens; identical to SEQ ID NO: 13351

SEQ ID NO: 13388 - DNA, 201 bp, Homo sapiens; identical to SEQ ID NO: 13354

SEQ ID NO: 13389 - DNA, 201 bp, Homo sapiens; identical to SEQ ID NO: 13353

SEQ ID NO: 13390 - DNA, 201 bp, Homo sapiens; identical to SEQ ID NO: 13355

SEQ ID NO: 13391 - DNA, 201 bp, Homo sapiens; identical to SEQ ID NO: 13358

SEQ ID NO: 13392 - DNA, 201 bp, Homo sapiens; identical to SEQ ID NO: 13357

SEQ ID NO: 13393 - DNA, 201 bp, Homo sapiens; identical to SEQ ID NO: 13360

SEQ ID NO: 13394 - DNA, 201 bp, Homo sapiens; identical to SEQ ID NO: 13361

SEQ ID NO: 13395 - DNA, 201 bp, Homo sapiens; identical to SEQ ID NO: 13362

SEQ ID NO: 13396 - DNA, 201 bp, Homo sapiens; identical to SEQ ID NO: 13363

SEQ ID NO: 13397 - DNA, 201 bp, Homo sapiens; identical to SEQ ID NO: 13324

SEQ ID NO: 13398 - DNA, 201 bp, Homo sapiens; identical to SEQ ID NO: 13325

SEQ ID NO: 13399 - DNA, 201 bp, Homo sapiens; identical to SEQ ID NO: 13326

SEQ ID NO: 13400 - DNA, 201 bp, Homo sapiens; identical to SEQ ID NO: 13327

SEQ ID NO: 13401 - DNA, 201 bp, Homo sapiens; identical to SEQ ID NO: 13328

SEQ ID NO: 13402 - DNA, 201 bp, Homo sapiens; identical to SEQ ID NO: 13329

SEQ ID NO: 13403 - DNA, 201 bp, Homo sapiens; identical to SEQ ID NO: 13330

SEQ ID NO: 13404 - DNA, 201 bp, Homo sapiens; identical to SEQ ID NO: 13332

SEQ ID NO: 13405 - DNA, 201 bp, Homo sapiens; identical to SEQ ID NO: 13331

SEQ ID NO: 13406 - DNA, 201 bp, Homo sapiens; identical to SEQ ID NO: 13336

SEQ ID NO: 13407 - DNA, 201 bp, Homo sapiens; identical to SEQ ID NO: 13337

SEQ ID NO: 13408 - DNA, 201 bp, Homo sapiens; identical to SEQ ID NO: 13339

SEQ ID NO: 13409 - DNA, 201 bp, Homo sapiens; identical to SEQ ID NO: 13338

SEQ ID NO: 13410 - DNA, 201 bp, Homo sapiens; identical to SEQ ID NO: 13340

SEQ ID NO: 13411 - DNA, 201 bp, Homo sapiens; identical to SEQ ID NO: 13341

SEQ ID NO: 13412 - DNA, 201 bp, Homo sapiens; identical to SEQ ID NO: 13342

SEQ ID NO: 13413 - DNA, 201 bp, Homo sapiens; identical to SEQ ID NO: 13343

SEQ ID NO: 13414 - DNA, 201 bp, Homo sapiens; identical to SEQ ID NO: 13344

SEQ ID NO: 13415 - DNA, 201 bp, Homo sapiens; identical to SEQ ID NO: 13345

SEQ ID NO: 13416 - DNA, 201 bp, Homo sapiens; identical to SEQ ID NO: 13346

SEQ ID NO: 13417 - DNA, 201 bp, Homo sapiens; identical to SEQ ID NO: 13347

SEQ ID NO: 13418 - DNA, 201 bp, Homo sapiens; identical to SEQ ID NO: 13349

SEQ ID NO: 13419 - DNA, 201 bp, Homo sapiens; identical to SEQ ID NO: 13350

SEQ ID NO: 13420 - DNA, 201 bp, Homo sapiens; identical to SEQ ID NO: 13351

SEQ ID NO: 13421 - DNA, 201 bp, Homo sapiens; identical to SEQ ID NO: 13354

SEQ ID NO: 13422 - DNA, 201 bp, Homo sapiens; identical to SEQ ID NO: 13353

SEQ ID NO: 13423 - DNA, 201 bp, Homo sapiens; identical to SEQ ID NO: 13355

SEQ ID NO: 13424 - DNA, 201 bp, Homo sapiens; identical to SEQ ID NO: 13358

SEQ ID NO: 13425 - DNA, 201 bp, Homo sapiens; identical to SEQ ID NO: 13357

SEQ ID NO: 13426 - DNA, 179 bp, Homo sapiens; identical to SEQ ID NO: 13359

SEQ ID NO: 13427 - DNA, 201 bp, Homo sapiens; identical to SEQ ID NO: 13360

SEQ ID NO: 13428 - DNA, 201 bp, Homo sapiens; identical to SEQ ID NO: 13361

SEQ ID NO: 13429 - DNA, 201 bp, Homo sapiens; identical to SEQ ID NO: 13362

SEQ ID NO: 13430 - DNA, 201 bp, Homo sapiens; identical to SEQ ID NO: 13363

SEQ ID NO: 13431 - DNA, 126 bp, Homo sapiens
gaacccagccatggtgaacgaagccwgaggaaacagcagcctcaacccctgcttggagggcagtgccagcagtggcagtgagagctccaaagatagttcgagatgttccaccccgggcctggaccc

SEQ ID NO: 13432 - DNA, 201 bp, Homo sapiens; identical to SEQ ID NO: 13325

SEQ ID NO: 13433 - DNA, 201 bp, Homo sapiens; identical to SEQ ID NO: 13326

SEQ ID NO: 13434 - DNA, 201 bp, Homo sapiens; identical to SEQ ID NO: 13327

SEQ ID NO: 13435 - DNA, 201 bp, Homo sapiens; identical to SEQ ID NO: 13328

SEQ ID NO: 13436 - DNA, 201 bp, Homo sapiens; identical to SEQ ID NO: 13329

SEQ ID NO: 13437 - DNA, 201 bp, Homo sapiens; identical to SEQ ID NO: 13330

SEQ ID NO: 13438 - DNA, 201 bp, Homo sapiens; identical to SEQ ID NO: 13332

SEQ ID NO: 13439 - DNA, 201 bp, Homo sapiens; identical to SEQ ID NO: 13331

SEQ ID NO: 13440 - DNA, 201 bp, Homo sapiens; identical to SEQ ID NO: 13336

SEQ ID NO: 13441 - DNA, 201 bp, Homo sapiens; identical to SEQ ID NO: 13337

SEQ ID NO: 13442 - DNA, 201 bp, Homo sapiens; identical to SEQ ID NO: 13339

SEQ ID NO: 13443 - DNA, 201 bp, Homo sapiens; identical to SEQ ID NO: 13338

SEQ ID NO: 13444 - DNA, 201 bp, Homo sapiens; identical to SEQ ID NO: 13340

SEQ ID NO: 13445 - DNA, 201 bp, Homo sapiens; identical to SEQ ID NO: 13341

SEQ ID NO: 13446 - DNA, 201 bp, Homo sapiens; identical to SEQ ID NO: 13342

SEQ ID NO: 13447 - DNA, 201 bp, Homo sapiens; identical to SEQ ID NO: 13343

SEQ ID NO: 13448 - DNA, 201 bp, Homo sapiens; identical to SEQ ID NO: 13344

SEQ ID NO: 13449 - DNA, 201 bp, Homo sapiens; identical to SEQ ID NO: 13345

SEQ ID NO: 13450 - DNA, 201 bp, Homo sapiens; identical to SEQ ID NO: 13346

SEQ ID NO: 13451 - DNA, 201 bp, Homo sapiens; identical to SEQ ID NO: 13347

SEQ ID NO: 13452 - DNA, 201 bp, Homo sapiens; identical to SEQ ID NO: 13349

SEQ ID NO: 13453 - DNA, 201 bp, Homo sapiens; identical to SEQ ID NO: 13350

SEQ ID NO: 13454 - DNA, 201 bp, Homo sapiens; identical to SEQ ID NO: 13351

SEQ ID NO: 13455 - DNA, 201 bp, Homo sapiens; identical to SEQ ID NO: 13354

SEQ ID NO: 13456 - DNA, 201 bp, Homo sapiens; identical to SEQ ID NO: 13353

SEQ ID NO: 13457 - DNA, 201 bp, Homo sapiens; identical to SEQ ID NO: 13355

SEQ ID NO: 13458 - DNA, 201 bp, Homo sapiens; identical to SEQ ID NO: 13358

SEQ ID NO: 13459 - DNA, 201 bp, Homo sapiens; identical to SEQ ID NO: 13357

SEQ ID NO: 13460 - DNA, 201 bp, Homo sapiens; identical to SEQ ID NO: 13360

SEQ ID NO: 13461 - DNA, 201 bp, Homo sapiens; identical to SEQ ID NO: 13361

SEQ ID NO: 13462 - DNA, 201 bp, Homo sapiens; identical to SEQ ID NO: 13362

SEQ ID NO: 13463 - DNA, 201 bp, Homo sapiens; identical to SEQ ID NO: 13363

SEQ ID NO: 13464 - DNA, 201 bp, Homo sapiens; identical to SEQ ID NO: 13364

SEQ ID NO: 13465 - DNA, 201 bp, Homo sapiens; identical to SEQ ID NO: 13325

SEQ ID NO: 13466 - DNA, 201 bp, Homo sapiens; identical to SEQ ID NO: 13326

SEQ ID NO: 13467 - DNA, 201 bp, Homo sapiens; identical to SEQ ID NO: 13327

SEQ ID NO: 13468 - DNA, 201 bp, Homo sapiens; identical to SEQ ID NO: 13328

SEQ ID NO: 13469 - DNA, 201 bp, Homo sapiens; identical to SEQ ID NO: 13329

SEQ ID NO: 13470 - DNA, 201 bp, Homo sapiens; identical to SEQ ID NO: 13330

SEQ ID NO: 13471 - DNA, 201 bp, Homo sapiens; identical to SEQ ID NO: 13331

SEQ ID NO: 13472 - DNA, 201 bp, Homo sapiens; identical to SEQ ID NO: 13332

SEQ ID NO: 13473 - DNA, 201 bp, Homo sapiens; identical to SEQ ID NO: 13333

SEQ ID NO: 13474 - DNA, 201 bp, Homo sapiens; identical to SEQ ID NO: 13334

SEQ ID NO: 13475 - DNA, 201 bp, Homo sapiens; identical to SEQ ID NO: 13335

SEQ ID NO: 13476 - DNA, 201 bp, Homo sapiens; identical to SEQ ID NO: 13336

SEQ ID NO: 13477 - DNA, 201 bp, Homo sapiens; identical to SEQ ID NO: 13337

SEQ ID NO: 13478 - DNA, 201 bp, Homo sapiens; identical to SEQ ID NO: 13338

SEQ ID NO: 13479 - DNA, 201 bp, Homo sapiens; identical to SEQ ID NO: 13339

SEQ ID NO: 13480 - DNA, 201 bp, Homo sapiens; identical to SEQ ID NO: 13340

SEQ ID NO: 13481 - DNA, 201 bp, Homo sapiens; identical to SEQ ID NO: 13341

SEQ ID NO: 13482 - DNA, 201 bp, Homo sapiens; identical to SEQ ID NO: 13342

SEQ ID NO: 13483 - DNA, 201 bp, Homo sapiens; identical to SEQ ID NO: 13343

SEQ ID NO: 13484 - DNA, 201 bp, Homo sapiens; identical to SEQ ID NO: 13344

SEQ ID NO: 13485 - DNA, 201 bp, Homo sapiens; identical to SEQ ID NO: 13345

SEQ ID NO: 13486 - DNA, 201 bp, Homo sapiens; identical to SEQ ID NO: 13346

SEQ ID NO: 13487 - DNA, 201 bp, Homo sapiens; identical to SEQ ID NO: 13347

SEQ ID NO: 13488 - DNA, 187 bp, Homo sapiens; identical to SEQ ID NO: 13348

SEQ ID NO: 13489 - DNA, 201 bp, Homo sapiens; identical to SEQ ID NO: 13349

SEQ ID NO: 13490 - DNA, 201 bp, Homo sapiens; identical to SEQ ID NO: 13350

SEQ ID NO: 13491 - DNA, 201 bp, Homo sapiens; identical to SEQ ID NO: 13351

SEQ ID NO: 13492 - DNA, 112 bp, Homo sapiens; identical to SEQ ID NO: 13352

SEQ ID NO: 13493 - DNA, 201 bp, Homo sapiens; identical to SEQ ID NO: 13353

SEQ ID NO: 13494 - DNA, 201 bp, Homo sapiens; identical to SEQ ID NO: 13354

SEQ ID NO: 13495 - DNA, 201 bp, Homo sapiens; identical to SEQ ID NO: 13355

SEQ ID NO: 13496 - DNA, 113 bp, Homo sapiens; identical to SEQ ID NO: 13356

SEQ ID NO: 13497 - DNA, 201 bp, Homo sapiens; identical to SEQ ID NO: 13357

SEQ ID NO: 13498 - DNA, 201 bp, Homo sapiens; identical to SEQ ID NO: 13358

SEQ ID NO: 13499 - DNA, 201 bp, Homo sapiens; identical to SEQ ID NO: 13360

SEQ ID NO: 13500 - DNA, 201 bp, Homo sapiens; identical to SEQ ID NO: 13361

SEQ ID NO: 13501 - DNA, 201 bp, Homo sapiens; identical to SEQ ID NO: 13362

SEQ ID NO: 13502 - DNA, 201 bp, Homo sapiens; identical to SEQ ID NO: 13363

SEQ ID NO: 13503 - DNA, 201 bp, Homo sapiens
tgcgttccccgcccctgcagcggccacagtggtgcggccggcggccgagcgttctgagtcacccgggactggagggaacccagccatggtgaacgaagccwgaggaaacagcagcctcaacccctgcttggagggcagtgccagcagtggcagtgagagctccaaagatagttcgagatgttccaccccgggcctggaccc

SEQ ID NO: 13504 - DNA, 201 bp, Homo sapiens; identical to SEQ ID NO: 13325

SEQ ID NO: 13505 - DNA, 201 bp, Homo sapiens; identical to SEQ ID NO: 13326

SEQ ID NO: 13506 - DNA, 201 bp, Homo sapiens; identical to SEQ ID NO: 13327

SEQ ID NO: 13507 - DNA, 201 bp, Homo sapiens; identical to SEQ ID NO: 13328

SEQ ID NO: 13508 - DNA, 201 bp, Homo sapiens; identical to SEQ ID NO: 13329

SEQ ID NO: 13509 - DNA, 201 bp, Homo sapiens; identical to SEQ ID NO: 13330

SEQ ID NO: 13510 - DNA, 201 bp, Homo sapiens; identical to SEQ ID NO: 13332

SEQ ID NO: 13511 - DNA, 201 bp, Homo sapiens; identical to SEQ ID NO: 13331

SEQ ID NO: 13512 - DNA, 201 bp, Homo sapiens; identical to SEQ ID NO: 13336

SEQ ID NO: 13513 - DNA, 201 bp, Homo sapiens; identical to SEQ ID NO: 13337

SEQ ID NO: 13514 - DNA, 201 bp, Homo sapiens; identical to SEQ ID NO: 13339

SEQ ID NO: 13515 - DNA, 201 bp, Homo sapiens; identical to SEQ ID NO: 13338

SEQ ID NO: 13516 - DNA, 201 bp, Homo sapiens; identical to SEQ ID NO: 13340

SEQ ID NO: 13517 - DNA, 201 bp, Homo sapiens; identical to SEQ ID NO: 13341

SEQ ID NO: 13518 - DNA, 201 bp, Homo sapiens; identical to SEQ ID NO: 13342

SEQ ID NO: 13519 - DNA, 201 bp, Homo sapiens; identical to SEQ ID NO: 13343

SEQ ID NO: 13520 - DNA, 201 bp, Homo sapiens; identical to SEQ ID NO: 13344

SEQ ID NO: 13521 - DNA, 201 bp, Homo sapiens; identical to SEQ ID NO: 13345

SEQ ID NO: 13522 - DNA, 201 bp, Homo sapiens; identical to SEQ ID NO: 13346

SEQ ID NO: 13523 - DNA, 201 bp, Homo sapiens; identical to SEQ ID NO: 13347

SEQ ID NO: 13524 - DNA, 201 bp, Homo sapiens; identical to SEQ ID NO: 13349

SEQ ID NO: 13525 - DNA, 201 bp, Homo sapiens; identical to SEQ ID NO: 13350

SEQ ID NO: 13526 - DNA, 201 bp, Homo sapiens; identical to SEQ ID NO: 13351

SEQ ID NO: 13527 - DNA, 201 bp, Homo sapiens; identical to SEQ ID NO: 13354

SEQ ID NO: 13528 - DNA, 201 bp, Homo sapiens; identical to SEQ ID NO: 13353

SEQ ID NO: 13529 - DNA, 201 bp, Homo sapiens; identical to SEQ ID NO: 13355

SEQ ID NO: 13530 - DNA, 201 bp, Homo sapiens; identical to SEQ ID NO: 13358

SEQ ID NO: 13531 - DNA, 201 bp, Homo sapiens; identical to SEQ ID NO: 13357

SEQ ID NO: 13532 - DNA, 201 bp, Homo sapiens; identical to SEQ ID NO: 13360

SEQ ID NO: 13533 - DNA, 201 bp, Homo sapiens; identical to SEQ ID NO: 13361

SEQ ID NO: 13534 - DNA, 201 bp, Homo sapiens; identical to SEQ ID NO: 13362

SEQ ID NO: 13535 - DNA, 201 bp, Homo sapiens; identical to SEQ ID NO: 13363

SEQ ID NO: 13536 - DNA, 201 bp, Homo sapiens
cctgcattctgttagagcacaaggtggtgctacagtcccgagactacaatgcactctccatgtctgtgatggcattcgtggcaatgatctacccactggartatatgtttcctgtcatcccgctgctacccacctgcatggcatcagcagagcagctgctgttggctccaaccccgtacatcattggggttcctgccagct

SEQ ID NO: 13537 - DNA, 201 bp, Homo sapiens
atatgtttgatccagccctgattggtgacaagccaaagtggtatgctcatcagctgcagcctatccactatcgcgtctatgacagcaattcccagctggcwgaggccctgagtgtaccaccagagcgggactctgactccgaacctactgatgatagtggcagtgatagtatggattatgacgattcaagctcttcttact

SEQ ID NO: 13538 - DNA, 201 bp, Homo sapiens
agcagtaggcgtctccaagcccctcccttccgtgcctcccagcattggcaaatcgaacgtggacagacgtcaggcagaaattggagaggggtcagtgcgcyggcgaatctatgacaatccatacttcgagccccaatatggctttccccctgaggaagatgaggatgagcagggggaaagttacactccccgattcagcca

SEQ ID NO: 13539 - DNA, 201 bp, Homo sapiens
gcagtaggcgtctccaagcccctcccttccgtgcctcccagcattggcaaatcgaacgtggacagacgtcaggcagaaattggagaggggtcagtgcgccrgcgaatctatgacaatccatacttcgagccccaatatggctttccccctgaggaagatgaggatgagcagggggaaagttacactccccgattcagccaa

SEQ ID NO: 13540 - DNA, 201 bp, Homo sapiens
agggatgggtatggaccagggtccccaggaaatgatcgacaggtacctgtcccttggagaacatgaccggaagcgcctggaagatgatgaagatcgcttgytggccacacttctgcacaacctcatctcctacatgctgctgatgaaggtaaataagaatgacatccgcaagaaggtgaggcgcctaatgggaaagtcgca

SEQ ID NO: 13541 - DNA, 201 bp, Homo sapiens
actacaatgcactctccatgtctgtgatggcattcgtggcaatgatctacccactggaatatatgtttcctgtcatcccgctgctacccacctgcatggcrtcagcagagcagctgctgttggctccaaccccgtacatcattggggttcctgccagcttcttcctctacaaactggacttcaaaatgcctgatgatgtat

SEQ ID NO: 13542 - DNA, 201 bp, Homo sapiens
cctttcttctccaccttccgagagtgtttgtatactctcaagcgcctggtggactgctgtagtgagcgccttctgggcaagaaactgggcatccctcgagrcgtacaaagggacaccatgtggcggatctttactggatcgctgctggtagaggagaagtcaagtgcccttctgcatgaccttcgagagattgaggcctgg

SEQ ID NO: 13543 - DNA, 201 bp, Homo sapiens
tcagaagagggtggcactgagagctcagagagtggctcatccctgcagcctctcagtgctgactctacccctgatgtgaaccagtctcctcggggcaaacrccgggccaaggcggggagccgctcccgcaacagtactctcacgtccctgtgcgtgctcagccactaccctttcttctccaccttccgagagtgtttgtat

SEQ ID NO: 13544 - DNA, 201 bp, Homo sapiens
caactctgaacctgctgactctacggagatggatgataaggcagcagtaggcgtctccaagcccctcccttccgtgcctcccagcattggcaaatcgaacrtggacagacgtcaggcagaaattggagaggggtcagtgcgccggcgaatctatgacaatccatacttcgagccccaatatggctttccccctgaggaaga

SEQ ID NO: 13545 - DNA, 201 bp, Homo sapiens
aacatgacctactgtcccaagacgaaggtgttgtgcttgtggcgtagaaatggctctgagacccagctcaacaagttctatactaaaaagtgtcgggagcygtactactgtgtgaaggacagcatggagcgcgctgccgcccgacagcaaagcatcaaacccggacctgaattgggtggcgagttccctgtgcaggacctg

SEQ ID NO: 13546 - DNA, 163 bp, Homo sapiens
tttgcacatctgtctgcaggctgtctctccaggcacggggtgtcaggagggagagacagcctgggtatgggcaagaaatgactgtaaatatttcagccccmcattatttatagaaaatgtacagttgtgtgaatgtgaaataaatgtcctcaactcccttcag

SEQ ID NO: 13547 - DNA, 201 bp, Homo sapiens
aatttcatgagggccaggagatcccccttctcttgggaaggccttctaatgacctgcagtccacaccgtccactgaattcaacccactcatctatggcaaygatgtggattctgtggatgttgcaaccagggttgccatggtacggttcttcaattccgccaacgtgctgcagggatttcagatgcacacgcgtaccctgc

SEQ ID NO: 13548 - DNA, 201 bp, Homo sapiens
ccaggaaatgatcgacaggtacctgtcccttggagaacatgaccggaagcgcctggaagatgatgaagatcgcttgctggccacacttctgcacaacctcrtctcctacatgctgctgatgaaggtaaataagaatgacatccgcaagaaggtgaggcgcctaatgggaaagtcgcacattgggcttgtgtacagccagca

SEQ ID NO: 13549 - DNA, 201 bp, Homo sapiens
caagccggcagctactgcccagggcccgcagtgttggctgctgcctgccacagcctctgtgactgcagtggagcggcgaattccctgtggcctgccacgcyttcggcatcagaggatggagtggtcgaggctagtggagtcccagggaccgctggctgctctgcctgagcatcagggagggggcaggaaagaccaagctgg

SEQ ID NO: 13550 - DNA, 201 bp, Homo sapiens
tcccaagccggcagctactgcccagggcccgcagtgttggctgctgcctgccacagcctctgtgactgcagtggagcggcgaattccctgtggcctgccaygccttcggcatcagaggatggagtggtcgaggctagtggagtcccagggaccgctggctgctctgcctgagcatcagggagggggcaggaaagaccaagc

SEQ ID NO: 13551 - DNA, 201 bp, Homo sapiens
cagtaggcgtctccaagcccctcccttccgtgcctcccagcattggcaaatcgaacgtggacagacgtcaggcagaaattggagaggggtcagtgcgccgkcgaatctatgacaatccatacttcgagccccaatatggctttccccctgaggaagatgaggatgagcagggggaaagttacactccccgattcagccaac

SEQ ID NO: 13552 - DNA, 201 bp, Homo sapiens
agtaggcgtctccaagcccctcccttccgtgcctcccagcattggcaaatcgaacgtggacagacgtcaggcagaaattggagaggggtcagtgcgccggygaatctatgacaatccatacttcgagccccaatatggctttccccctgaggaagatgaggatgagcagggggaaagttacactccccgattcagccaaca

SEQ ID NO: 13553 - DNA, 201 bp, Homo sapiens; identical to SEQ ID NO: 13536

SEQ ID NO: 13554 - DNA, 201 bp, Homo sapiens; identical to SEQ ID NO: 13537

SEQ ID NO: 13555 - DNA, 201 bp, Homo sapiens; identical to SEQ ID NO: 13542

SEQ ID NO: 13556 - DNA, 201 bp, Homo sapiens
caactctgaacctgctgactctacggagatggatgataaggcagcagtaggcgtctccaagcccctcccttccgtgcctcccagcattggcaaatcgaacrtggacagacgtcaggcagaaattggagagggggctcaaaagctgctgcggcccaacagcttgagactggcaagtgactcagatgcagagtcagactctcg

SEQ ID NO: 13557 - DNA, 201 bp, Homo sapiens; identical to SEQ ID NO: 13543

SEQ ID NO: 13558 - DNA, 201 bp, Homo sapiens; identical to SEQ ID NO: 13545

SEQ ID NO: 13559 - DNA, 163 bp, Homo sapiens; identical to SEQ ID NO: 13546

SEQ ID NO: 13560 - DNA, 201 bp, Homo sapiens; identical to SEQ ID NO: 13540

SEQ ID NO: 13561 - DNA, 201 bp, Homo sapiens; identical to SEQ ID NO: 13541

SEQ ID NO: 13562 - DNA, 201 bp, Homo sapiens; identical to SEQ ID NO: 13547

SEQ ID NO: 13563 - DNA, 201 bp, Homo sapiens; identical to SEQ ID NO: 13548

SEQ ID NO: 13564 - DNA, 201 bp, Homo sapiens; identical to SEQ ID NO: 13550

SEQ ID NO: 13565 - DNA, 201 bp, Homo sapiens; identical to SEQ ID NO: 13549

SEQ ID NO: 13566 - DNA, 201 bp, Homo sapiens; identical to SEQ ID NO: 13536

SEQ ID NO: 13567 - DNA, 201 bp, Homo sapiens; identical to SEQ ID NO: 13537

SEQ ID NO: 13568 - DNA, 201 bp, Homo sapiens; identical to SEQ ID NO: 13538

SEQ ID NO: 13569 - DNA, 201 bp, Homo sapiens; identical to SEQ ID NO: 13539

SEQ ID NO: 13570 - DNA, 201 bp, Homo sapiens; identical to SEQ ID NO: 13540

SEQ ID NO: 13571 - DNA, 201 bp, Homo sapiens; identical to SEQ ID NO: 13541

SEQ ID NO: 13572 - DNA, 201 bp, Homo sapiens; identical to SEQ ID NO: 13542

SEQ ID NO: 13573 - DNA, 201 bp, Homo sapiens; identical to SEQ ID NO: 13543

SEQ ID NO: 13574 - DNA, 201 bp, Homo sapiens; identical to SEQ ID NO: 13544

SEQ ID NO: 13575 - DNA, 201 bp, Homo sapiens; identical to SEQ ID NO: 13545

SEQ ID NO: 13576 - DNA, 163 bp, Homo sapiens; identical to SEQ ID NO: 13546

SEQ ID NO: 13577 - DNA, 201 bp, Homo sapiens; identical to SEQ ID NO: 13547

SEQ ID NO: 13578 - DNA, 201 bp, Homo sapiens; identical to SEQ ID NO: 13548

SEQ ID NO: 13579 - DNA, 201 bp, Homo sapiens; identical to SEQ ID NO: 13549

SEQ ID NO: 13580 - DNA, 201 bp, Homo sapiens; identical to SEQ ID NO: 13550

SEQ ID NO: 13581 - DNA, 201 bp, Homo sapiens; identical to SEQ ID NO: 13551

SEQ ID NO: 13582 - DNA, 201 bp, Homo sapiens; identical to SEQ ID NO: 13552

SEQ ID NO: 13583 - DNA, 201 bp, Homo sapiens; identical to SEQ ID NO: 13536

SEQ ID NO: 13584 - DNA, 201 bp, Homo sapiens; identical to SEQ ID NO: 13537

SEQ ID NO: 13585 - DNA, 201 bp, Homo sapiens; identical to SEQ ID NO: 13542

SEQ ID NO: 13586 - DNA, 201 bp, Homo sapiens; identical to SEQ ID NO: 13556

SEQ ID NO: 13587 - DNA, 201 bp, Homo sapiens; identical to SEQ ID NO: 13543

SEQ ID NO: 13588 - DNA, 201 bp, Homo sapiens; identical to SEQ ID NO: 13545

SEQ ID NO: 13589 - DNA, 163 bp, Homo sapiens; identical to SEQ ID NO: 13546

SEQ ID NO: 13590 - DNA, 201 bp, Homo sapiens; identical to SEQ ID NO: 13540

SEQ ID NO: 13591 - DNA, 201 bp, Homo sapiens; identical to SEQ ID NO: 13541

SEQ ID NO: 13592 - DNA, 201 bp, Homo sapiens; identical to SEQ ID NO: 13547

SEQ ID NO: 13593 - DNA, 201 bp, Homo sapiens; identical to SEQ ID NO: 13548

SEQ ID NO: 13594 - DNA, 201 bp, Homo sapiens; identical to SEQ ID NO: 13550

SEQ ID NO: 13595 - DNA, 201 bp, Homo sapiens; identical to SEQ ID NO: 13549

SEQ ID NO: 13596 - DNA, 201 bp, Homo sapiens; identical to SEQ ID NO: 13536

SEQ ID NO: 13597 - DNA, 201 bp, Homo sapiens; identical to SEQ ID NO: 13537

SEQ ID NO: 13598 - DNA, 201 bp, Homo sapiens; identical to SEQ ID NO: 13538

SEQ ID NO: 13599 - DNA, 201 bp, Homo sapiens; identical to SEQ ID NO: 13539

SEQ ID NO: 13600 - DNA, 201 bp, Homo sapiens; identical to SEQ ID NO: 13540

SEQ ID NO: 13601 - DNA, 201 bp, Homo sapiens; identical to SEQ ID NO: 13541

SEQ ID NO: 13602 - DNA, 201 bp, Homo sapiens; identical to SEQ ID NO: 13542

SEQ ID NO: 13603 - DNA, 201 bp, Homo sapiens; identical to SEQ ID NO: 13543

SEQ ID NO: 13604 - DNA, 201 bp, Homo sapiens; identical to SEQ ID NO: 13544

SEQ ID NO: 13605 - DNA, 201 bp, Homo sapiens; identical to SEQ ID NO: 13545

SEQ ID NO: 13606 - DNA, 163 bp, Homo sapiens; identical to SEQ ID NO: 13546

SEQ ID NO: 13607 - DNA, 201 bp, Homo sapiens; identical to SEQ ID NO: 13547

SEQ ID NO: 13608 - DNA, 201 bp, Homo sapiens; identical to SEQ ID NO: 13548

SEQ ID NO: 13609 - DNA, 201 bp, Homo sapiens; identical to SEQ ID NO: 13549

SEQ ID NO: 13610 - DNA, 201 bp, Homo sapiens; identical to SEQ ID NO: 13550

SEQ ID NO: 13611 - DNA, 201 bp, Homo sapiens; identical to SEQ ID NO: 13551

SEQ ID NO: 13612 - DNA, 201 bp, Homo sapiens; identical to SEQ ID NO: 13552

SEQ ID NO: 13613 - DNA, 201 bp, Homo sapiens; identical to SEQ ID NO: 13536

SEQ ID NO: 13614 - DNA, 201 bp, Homo sapiens; identical to SEQ ID NO: 13537

SEQ ID NO: 13615 - DNA, 201 bp, Homo sapiens; identical to SEQ ID NO: 13538

SEQ ID NO: 13616 - DNA, 201 bp, Homo sapiens; identical to SEQ ID NO: 13539

SEQ ID NO: 13617 - DNA, 201 bp, Homo sapiens; identical to SEQ ID NO: 13540

SEQ ID NO: 13618 - DNA, 201 bp, Homo sapiens; identical to SEQ ID NO: 13541

SEQ ID NO: 13619 - DNA, 126 bp, Homo sapiens
cacgtgcatgtgtagcatgccttggkttttcctttggcatctgaaaaaggcacaacctgaaagacctagaacccagtgtcggtccccaggccctttgggacaggaagagaagagccgtgtggccgc

SEQ ID NO: 13620 - DNA, 201 bp, Homo sapiens
tgaaaaaggcacaacctgaaagacctagaacccagtgtcggtccccaggccctttgggacaggaagagaagagccgtgtggccgcggggaggatgtcctgmggcggggctgtcctcgcggactgactggactccatctcccagcgggcgccgcggcgcggccacgcccccccactccccgcgcgcgcccggtggagacttc

SEQ ID NO: 13621 - DNA, 201 bp, Homo sapiens; identical to SEQ ID NO: 13542

SEQ ID NO: 13622 - DNA, 201 bp, Homo sapiens; identical to SEQ ID NO: 13544

SEQ ID NO: 13623 - DNA, 201 bp, Homo sapiens; identical to SEQ ID NO: 13543

SEQ ID NO: 13624 - DNA, 201 bp, Homo sapiens; identical to SEQ ID NO: 13545

SEQ ID NO: 13625 - DNA, 163 bp, Homo sapiens; identical to SEQ ID NO: 13546

SEQ ID NO: 13626 - DNA, 201 bp, Homo sapiens; identical to SEQ ID NO: 13547

SEQ ID NO: 13627 - DNA, 201 bp, Homo sapiens; identical to SEQ ID NO: 13548

SEQ ID NO: 13628 - DNA, 201 bp, Homo sapiens; identical to SEQ ID NO: 13550

SEQ ID NO: 13629 - DNA, 201 bp, Homo sapiens; identical to SEQ ID NO: 13549

SEQ ID NO: 13630 - DNA, 201 bp, Homo sapiens; identical to SEQ ID NO: 13551

SEQ ID NO: 13631 - DNA, 201 bp, Homo sapiens; identical to SEQ ID NO: 13552

SEQ ID NO: 13632 - DNA, 201 bp, Homo sapiens; identical to SEQ ID NO: 13536

SEQ ID NO: 13633 - DNA, 201 bp, Homo sapiens; identical to SEQ ID NO: 13537

SEQ ID NO: 13634 - DNA, 201 bp, Homo sapiens; identical to SEQ ID NO: 13542

SEQ ID NO: 13635 - DNA, 201 bp, Homo sapiens; identical to SEQ ID NO: 13556

SEQ ID NO: 13636 - DNA, 201 bp, Homo sapiens; identical to SEQ ID NO: 13543

SEQ ID NO: 13637 - DNA, 201 bp, Homo sapiens; identical to SEQ ID NO: 13545

SEQ ID NO: 13638 - DNA, 163 bp, Homo sapiens; identical to SEQ ID NO: 13546

SEQ ID NO: 13639 - DNA, 201 bp, Homo sapiens; identical to SEQ ID NO: 13540

SEQ ID NO: 13640 - DNA, 201 bp, Homo sapiens; identical to SEQ ID NO: 13541

SEQ ID NO: 13641 - DNA, 201 bp, Homo sapiens; identical to SEQ ID NO: 13547

SEQ ID NO: 13642 - DNA, 201 bp, Homo sapiens; identical to SEQ ID NO: 13548

SEQ ID NO: 13643 - DNA, 201 bp, Homo sapiens; identical to SEQ ID NO: 13550

SEQ ID NO: 13644 - DNA, 201 bp, Homo sapiens; identical to SEQ ID NO: 13549

SEQ ID NO: 13645 - DNA, 201 bp, Homo sapiens; identical to SEQ ID NO: 13536

SEQ ID NO: 13646 - DNA, 201 bp, Homo sapiens; identical to SEQ ID NO: 13537

SEQ ID NO: 13647 - DNA, 201 bp, Homo sapiens; identical to SEQ ID NO: 13538

SEQ ID NO: 13648 - DNA, 201 bp, Homo sapiens; identical to SEQ ID NO: 13539

SEQ ID NO: 13649 - DNA, 201 bp, Homo sapiens; identical to SEQ ID NO: 13540

SEQ ID NO: 13650 - DNA, 201 bp, Homo sapiens; identical to SEQ ID NO: 13541

SEQ ID NO: 13651 - DNA, 201 bp, Homo sapiens; identical to SEQ ID NO: 13542

SEQ ID NO: 13652 - DNA, 201 bp, Homo sapiens; identical to SEQ ID NO: 13543

SEQ ID NO: 13653 - DNA, 201 bp, Homo sapiens; identical to SEQ ID NO: 13544

SEQ ID NO: 13654 - DNA, 201 bp, Homo sapiens; identical to SEQ ID NO: 13545

SEQ ID NO: 13655 - DNA, 163 bp, Homo sapiens; identical to SEQ ID NO: 13546

SEQ ID NO: 13656 - DNA, 201 bp, Homo sapiens; identical to SEQ ID NO: 13547

SEQ ID NO: 13657 - DNA, 201 bp, Homo sapiens; identical to SEQ ID NO: 13548

SEQ ID NO: 13658 - DNA, 201 bp, Homo sapiens; identical to SEQ ID NO: 13549

SEQ ID NO: 13659 - DNA, 201 bp, Homo sapiens; identical to SEQ ID NO: 13550

SEQ ID NO: 13660 - DNA, 201 bp, Homo sapiens; identical to SEQ ID NO: 13551

SEQ ID NO: 13661 - DNA, 201 bp, Homo sapiens; identical to SEQ ID NO: 13552

SEQ ID NO: 13662 - DNA, 201 bp, Homo sapiens; identical to SEQ ID NO: 13536

SEQ ID NO: 13663 - DNA, 201 bp, Homo sapiens; identical to SEQ ID NO: 13537

SEQ ID NO: 13664 - DNA, 201 bp, Homo sapiens; identical to SEQ ID NO: 13538

SEQ ID NO: 13665 - DNA, 201 bp, Homo sapiens; identical to SEQ ID NO: 13539

SEQ ID NO: 13666 - DNA, 201 bp, Homo sapiens; identical to SEQ ID NO: 13540

SEQ ID NO: 13667 - DNA, 201 bp, Homo sapiens; identical to SEQ ID NO: 13541

SEQ ID NO: 13668 - DNA, 201 bp, Homo sapiens; identical to SEQ ID NO: 13542

SEQ ID NO: 13669 - DNA, 201 bp, Homo sapiens; identical to SEQ ID NO: 13543

SEQ ID NO: 13670 - DNA, 201 bp, Homo sapiens; identical to SEQ ID NO: 13544

SEQ ID NO: 13671 - DNA, 201 bp, Homo sapiens; identical to SEQ ID NO: 13545

SEQ ID NO: 13672 - DNA, 163 bp, Homo sapiens; identical to SEQ ID NO: 13546

SEQ ID NO: 13673 - DNA, 201 bp, Homo sapiens; identical to SEQ ID NO: 13547

SEQ ID NO: 13674 - DNA, 201 bp, Homo sapiens; identical to SEQ ID NO: 13548

SEQ ID NO: 13675 - DNA, 201 bp, Homo sapiens; identical to SEQ ID NO: 13549

SEQ ID NO: 13676 - DNA, 201 bp, Homo sapiens; identical to SEQ ID NO: 13550

SEQ ID NO: 13677 - DNA, 201 bp, Homo sapiens; identical to SEQ ID NO: 13551

SEQ ID NO: 13678 - DNA, 201 bp, Homo sapiens; identical to SEQ ID NO: 13552

SEQ ID NO: 13679 - DNA, 201 bp, Homo sapiens
gtggtagaagaatctgcccgagcttctgtctcagttttgggagacatattaggctctgccatgcaaaacacacaaaatcttctccagatgccctatggctrtggagagcagaatatggtcctctttgctcctaacatctatgtactggattatctaaatgaaacacagcagcttactccagagatcaagtccaaggccatt

SEQ ID NO: 13680 - DNA, 173 bp, Homo sapiens
tgagtttgcaattgctgagtacaatgctccttgcagcaaagatcttggaaatgcttgaagaccacaaggctgaaaagtgctttgctggagtcctgttctcwgagctccacagaagacacgtgtttttgtatctttaaagacttgatgaataaacactttttctggtcaatgtc

SEQ ID NO: 13681 - DNA, 201 bp, Homo sapiens
cttcagggacattttccagcaaattccaagtggacaacaacaaccgcctgttactgcagcaggtctcattgccagagctgcctggggaatacagcatgaargtgacaggagaaggatgtgtctacctccagacatccttgaaatacaatattctcccagaaaaggaagagttcccctttgctttaggagtgcagactctgc

SEQ ID NO: 13682 - DNA, 201 bp, Homo sapiens
caagaagaaggaacagtggtggaattgactggaaggcagtccagtgaaatcacaagaaccataaccaaactctcatttgtgaaagtggactcacactttcracagggaattcccttctttgggcaggtgcgcctagtagatgggaaaggcgtccctataccaaataaagtcatattcatcagaggaaatgaagcaaactat

SEQ ID NO: 13683 - DNA, 165 bp, Homo sapiens
caattgctgagtacaatgctccttgcagcaaagatcttggaaatgcttgaagaccacaaggctgaaaagtgctttgctggagtcctgttctcagagctccmcagaagacacgtgtttttgtatctttaaagacttgatgaataaacactttttctggtcaatgtc

SEQ ID NO: 13684 - DNA, 201 bp, Homo sapiens
tccactgcctctctccgagccttccagcccttctttgtggagctcacaatgccttactctgtgattcgtggagaggccttcacactcaaggccacggtccwaaactaccttcccaaatgcatccgggtcagtgtgcagctggaagcctctcccgccttcctagctgtcccagtggagaaggaacaagcgcctcactgcatc

SEQ ID NO: 13685 - DNA, 201 bp, Homo sapiens
aatgcttgaaagatctaaccatgtgagccggacagaagtcagcagcaaccatgtcttgatttaccttgataaggtgtcaaatcagacactgagcttgttcytcacggttctgcaagatgtcccagtaagagatctgaaaccagccatagtgaaagtctatgattactacgagacggatgagtttgcaattgctgagtacaa

SEQ ID NO: 13686 - DNA, 201 bp, Homo sapiens
tagtccctgttacggctaccagtgggtgtcagaagaacacgaagaggcacatcacactgcttatcttgtgttctccccaagcaagagctttgtccaccttragcccatgtctcatgaactaccctgtggccatactcagacagtccaggcacattatattctgaatggaggcaccctgctggggctgaagaagctctcctt

SEQ ID NO: 13687 - DNA, 201 bp, Homo sapiens
tccaatgctaccacggatgagcatggccttgtacagttctctatcaacaccaccaatgttatgggtacctctcttactgttagggtcaattacaaggatcrtagtccctgttacggctaccagtgggtgtcagaagaacacgaagaggcacatcacactgcttatcttgtgttctccccaagcaagagctttgtccacctt

SEQ ID NO: 13688 - DNA, 201 bp, Homo sapiens
aaggccacggtcctaaactaccttcccaaatgcatccgggtcagtgtgcagctggaagcctctcccgccttcctagctgtcccagtggagaaggaacaagygcctcactgcatctgtgcaaacgggcggcaaactgtgtcctgggcagtaaccccaaagtcattaggaaatgtgaatttcactgtgagcgcagaggcacta

SEQ ID NO: 13689 - DNA, 176 bp, Homo sapiens
ggatgagtttgcaattgctgagtacaatgctccttgcagcaaagatcttggaaatgcttgaagaccacaaggctgaaaagtgctttgctggagtcctgttytcagagctccacagaagacacgtgtttttgtatctttaaagacttgatgaataaacactttttctggtcaatgtc

SEQ ID NO: 13690 - DNA, 201 bp, Homo sapiens
gctcatgaagcctgatgctgagctctcggcgtcctcggtttacaacctgctaccagaaaaggacctcactggcttccctgggcctttgaatgaccaggacratgaagactgcatcaatcgtcataatgtctatattaatggaatcacatatactccagtatcaagtacaaatgaaaaggatatgtacagcttcctagagga

SEQ ID NO: 13691 - DNA, 201 bp, Homo sapiens
ttgtacagttctctatcaacaccaccaatgttatgggtacctctcttactgttagggtcaattacaaggatcgtagtccctgttacggctaccagtgggtrtcagaagaacacgaagaggcacatcacactgcttatcttgtgttctccccaagcaagagctttgtccaccttgagcccatgtctcatgaactaccctgtg

SEQ ID NO: 13692 - DNA, 201 bp, Homo sapiens
gagtcagcctggaagacagcacaagaaggggaccatggcagccatgtatataccaaagcactgctggcctatgcttttgccctggcaggtaaccaggacargaggaaggaagtactcaagtcacttaatgaggaagctgtgaagaaagacaactctgtccattgggagcgccctcagaaacccaaggcaccagtggggcat

SEQ ID NO: 13693 - DNA, 201 bp, Homo sapiens
cttactctgtgattcgtggagaggccttcacactcaaggccacggtcctaaactaccttcccaaatgcatccgggtcagtgtgcagctggaagcctctccygccttcctagctgtcccagtggagaaggaacaagcgcctcactgcatctgtgcaaacgggcggcaaactgtgtcctgggcagtaaccccaaagtcattag

SEQ ID NO: 13694 - DNA, 201 bp, Homo sapiens
cggatgagcatggccttgtacagttctctatcaacaccaccaatgttatgggtacctctcttactgttagggtcaattacaaggatcgtagtccctgttayggctaccagtgggtgtcagaagaacacgaagaggcacatcacactgcttatcttgtgttctccccaagcaagagctttgtccaccttgagcccatgtctc

SEQ ID NO: 13695 - DNA, 201 bp, Homo sapiens
gtggagatgacatcctatgtgctcctcgcttatctcacggcccagccagccccaacctcggaggacctgacctctgcaaccaacatcgtgaagtggatcaygaagcagcagaatgcccagggcggtttctcctccacccaggacacagtggtggctctccatgctctgtccaaatatggagcagccacatttaccaggact

SEQ ID NO: 13696 - DNA, 201 bp, Homo sapiens
ccagggattctatttagcccgccaggaattaaccttgactataaataggccatcaatgacctttccagagaatgttcagagacctcaactttgtttagagrtcttgtgtgggtggaacttcctgtttgcacacagagcagcataaagcccagttgctttgggaagtgtttgggaccagatggattgtagggagtagggtac

SEQ ID NO: 13697 - DNA, 201 bp, Homo sapiens
tggaacttcctgtttgcacacagagcagcataaagcccagttgctttgggaagtgtttgggaccagatggattgtagggagtagggtacaatacagtctgktctcctccagctccttctttctgcaacatggggaagaacaaactccttcatccaagtctggttcttctcctcttggtcctcctgcccacagacgcctcag

SEQ ID NO: 13698 - DNA, 201 bp, Homo sapiens
gaggacatgggcttaaaggcattcaccaactcaaagattcgtaaacccaaaatgtgtccacagcttcaacagtatgaaatgcatggacctgaaggtctacrtgtaggtttttatgagtcagatgtaatgggaagaggccatgcacgcctggtgcatgttgaagagcctcacacggagaccgtacgaaagtacttccctgag

SEQ ID NO: 13699 - DNA, 201 bp, Homo sapiens
ccagatgccctatggctgtggagagcagaatatggtcctctttgctcctaacatctatgtactggattatctaaatgaaacacagcagcttactccagagrtcaagtccaaggccattggctatctcaacactggttaccagagacagttgaactacaaacactatgatggctcctacagcacctttggggagcgatatgg

SEQ ID NO: 13700 - DNA, 201 bp, Homo sapiens
aactcgcttggatctatccaaaaatcagattcgtagcctttaccttcatccttcatttgggaagttgaattccttaaagtccatagatttttcctccaacmaaatattccttgtatgtgaacatgagctcgagcccctacaagggaaaacgctctccttttttagcctcgcagctaatagcttgtatagcagagtctcagt

SEQ ID NO: 13701 - DNA, 201 bp, Homo sapiens
gtggcaataaactagtgactttgccaaagatcaaccttacagcgaacctcatccacttatcagaaaacaggctagaaaatctagatattctctactttctyctacgggtacctcatctccagattctcattttaaatcaaaatcgcttctcctcctgtagtggagatcaaaccccttcagagaatcccagcttagaacagc

SEQ ID NO: 13702 - DNA, 201 bp, Homo sapiens
cagctcctagctcctaatcctgatgtatttgtatcacttagtgtcttggatataactcataacaagttcatttgtgaatgtgaacttagcacttttatcarttggcttaatcacaccaatgtcactatagctgggcctcctgcagacatatattgtgtgtaccctgactcgttctctggggtttccctcttctctctttcc

SEQ ID NO: 13703 - DNA, 201 bp, Homo sapiens
actacctaaggtagcctacattgatttgcaaaagaatcacattgcaataattcaagaccaaacattcaaattcctggaaaaattacagaccttggatctcygagacaatgctcttacaaccattcattttattccaagcatacccgatatcttcttgagtggcaataaactagtgactttgccaaagatcaaccttacagc

SEQ ID NO: 13704 - DNA, 201 bp, Homo sapiens
gccgaatagccttttatcgtttctgcaacctcacccaggtcccccaggtcctcaacaccactgagaggctcctgctgagcttcaactatatcaggacagtyactgcttcatccttcccctttctggaacagctgcagctgctggagctcgggagccagtatacccccttgactattgacaaggaggccttcagaaacctgc

SEQ ID NO: 13705 - DNA, 201 bp, Homo sapiens
gaatcttggacctgggaagtagtaagatatacttcttgcatccagatgcttttcagggactgttccatctgtttgaacttagactgtatttctgtggtctytctgatgctgtattgaaagatggttatttcagaaatttaaaggctttaactcgcttggatctatccaaaaatcagattcgtagcctttaccttcatcctt

SEQ ID NO: 13706 - DNA, 201 bp, Homo sapiens
gctttgtacagaaacagcagtatttgaggtggcctgaggatctccaggatgttggctggtttcttcataaactctctcaacagatactaaagaaagaaaargaaaagaagaaagacaataacattccgttgcaaactgtagcaaccatctcctaatcaaaggagcaatttccaacttatctcaagccacaaataactcttc

SEQ ID NO: 13707 - DNA, 201 bp, Homo sapiens
gagccagtatacccccttgactattgacaaggaggccttcagaaacctgcccaaccttagaatcttggacctgggaagtagtaagatatacttcttgcatscagatgcttttcagggactgttccatctgtttgaacttagactgtatttctgtggtctctctgatgctgtattgaaagatggttatttcagaaatttaaa

SEQ ID NO: 13708 - DNA, 201 bp, Homo sapiens
ttgtgaatgtgaacttagcacttttatcaattggcttaatcacaccaatgtcactatagctgggcctcctgcagacatatattgtgtgtaccctgactcgytctctggggtttccctcttctctctttccacggaaggttgtgatgaagaggaagtcttaaagtccctaaagttctcccttttcattgtatgcactgtcac

SEQ ID NO: 13709 - DNA, 201 bp, Homo sapiens
gaagttgaattccttaaagtccatagatttttcctccaaccaaatattccttgtatgtgaacatgagctcgagcccctacaagggaaaacgctctcctttyttagcctcgcagctaatagcttgtatagcagagtctcagtggactggggaaaatgtatgaacccattcagaaacatggtgctggagatactagatgtttc

SEQ ID NO: 13710 - DNA, 201 bp, Homo sapiens
gagaggctcctgctgagcttcaactatatcaggacagtcactgcttcatccttcccctttctggaacagctgcagctgctggagctcgggagccagtatayccccttgactattgacaaggaggccttcagaaacctgcccaaccttagaatcttggacctgggaagtagtaagatatacttcttgcatccagatgctttt

SEQ ID NO: 13711 - DNA, 201 bp, Homo sapiens; identical to SEQ ID NO: 13708

SEQ ID NO: 13712 - DNA, 201 bp, Homo sapiens
ttgagaatgttggcgctgtccgaacctggagacaggaaaacaaaaagtcctttctcctgattcaccaaaaaataaaatactgactaccatcactgtgatgwgattcctatagtctcaggaactgaagtctttaaacaaccagggaccctctgcccctagaataagaacatactagaagtcccttctgctaggacaacgagg

SEQ ID NO: 13713 - DNA, 112 bp, Homo sapiens
ggttttcaggakcccgagcgagggcgccgcttttgcgtccgggaggagccaaccgtggcgcaggcggcgcggggaggcgtcccagagtctcactctgccgcccaggctggac

SEQ ID NO: 13714 - DNA, 201 bp, Homo sapiens; identical to SEQ ID NO: 13709

SEQ ID NO: 13715 - DNA, 201 bp, Homo sapiens; identical to SEQ ID NO: 13700

SEQ ID NO: 13716 - DNA, 201 bp, Homo sapiens; identical to SEQ ID NO: 13710

SEQ ID NO: 13717 - DNA, 201 bp, Homo sapiens; identical to SEQ ID NO: 13701

SEQ ID NO: 13718 - DNA, 201 bp, Homo sapiens; identical to SEQ ID NO: 13702

SEQ ID NO: 13719 - DNA, 201 bp, Homo sapiens; identical to SEQ ID NO: 13703

SEQ ID NO: 13720 - DNA, 201 bp, Homo sapiens; identical to SEQ ID NO: 13704

SEQ ID NO: 13721 - DNA, 201 bp, Homo sapiens; identical to SEQ ID NO: 13705

SEQ ID NO: 13722 - DNA, 201 bp, Homo sapiens; identical to SEQ ID NO: 13706

SEQ ID NO: 13723 - DNA, 201 bp, Homo sapiens; identical to SEQ ID NO: 13707

SEQ ID NO: 13724 - DNA, 201 bp, Homo sapiens
ggcatcctctctggccacgataacagggtgagctgcctgggagtcacagctgacgggatggctgtggccacaggttcctgggacagcttcctcaaaatctkgaactgaggaggctggagaaagggaagtggaaggcagtgaacacactcagcagccccctgcccgaccccatctcattcaggtgttctcttctatattccg

SEQ ID NO: 13725 - DNA, 201 bp, Homo sapiens
agaggccatctgcacgggctcggatgacgcttcctgccgcttgtttgacctgcgggcagaccaggagctgatctgcttctcccacgagagcatcatctgcrgcatcacgtccgtggccttctccctcagtggccgcctactattcgctggctacgacgacttcaactgcaatgtctgggactccatgaagtctgagcgtgt

SEQ ID NO: 13726 - DNA, 201 bp, Homo sapiens
taatctcagctcctgcctgtaccctcccatactcaccaaaccctcttccccaccaccctgagctgaggagcacagtttgaggcccccccaaccccccgccrgtcggggccaggccaggccaggccagctcctctggcagcagagcctgggcaggtgacgggcgggcgcgggcgtcgcagctgagggagtaaggaggctccc

SEQ ID NO: 13727 - DNA, 201 bp, Homo sapiens
gcacgggctcggatgacgcttcctgccgcttgtttgacctgcgggcagaccaggagctgatctgcttctcccacgagagcatcatctgcggcatcacgtcygtggccttctccctcagtggccgcctactattcgctggctacgacgacttcaactgcaatgtctgggactccatgaagtctgagcgtgtgggcatcctct

SEQ ID NO: 13728 - DNA, 201 bp, Homo sapiens
tctcctaagacacctgcaataaagtgtagcaccctggtacatctgtgatgtttgccttctactctcttctgttccaaaaagacccaggtcccatttaaggscagtaatgtgttacaggtgctgtgataaaggctgggtactggatagcttgtgggcttatgggaggaggcctgagatgggtcagggggagaaggtattcag

SEQ ID NO: 13729 - DNA, 201 bp, Homo sapiens
tctgaggccccaggccctaggattcctcccccagagccactacctttgtccaggcctgggtggtatagggcgtttggccctgtgactatggctctggcacyactagggtcctggccctcttcttattcatgctttctcctttttctacctttttttctctcctaagacacctgcaataaagtgtagcaccctggtacatct

SEQ ID NO: 13730 - DNA, 201 bp, Homo sapiens
atgacctgtgcctatgccccatcagggaactttgtggcatgtggggggctggacaacatgtgttccatctacaacctcaaatcccgtgagggcaatgtcarggtcagccgggagctttctgctcacacaggttatctctcctgctgccgcttcctggatgacaacaatattgtgaccagctcgggggacaccacgtgtgcc

SEQ ID NO: 13731 - DNA, 201 bp, Homo sapiens
ctttcactggccacgagtcggacatcaacgccatctgtttcttccccaatggagaggccatctgcacgggctcggatgacgcttcctgccgcttgtttgayctgcgggcagaccaggagctgatctgcttctcccacgagagcatcatctgcggcatcacgtccgtggccttctccctcagtggccgcctactattcgctg

SEQ ID NO: 13732 - DNA, 201 bp, Homo sapiens
agtccagatgcggacgcggcggacgttaaggggacacctggccaagatttacgccatgcactgggccactgattctaagctgctggtaagtgcctcgcaaratgggaagctgatcgtgtgggacagctacaccaccaacaaggtgcacgccatcccactgcgctcctcctgggtcatgacctgtgcctatgccccatcagg

SEQ ID NO: 13733 - DNA, 201 bp, Homo sapiens
aagtggaaggcagtgaacacactcagcagccccctgcccgaccccatctcattcaggtgttctcttctatattccgggtgccattcccactaagctttctyctttgagggcagtggggagcatgggactgtgcctttgggaggcagcatcagggacacaggggcaaagaactgccccatctcctcccatggccttccctcc

SEQ ID NO: 13734 - DNA, 201 bp, Homo sapiens
  misc_feature (1)...(201): n = A,T,C or G, or insertion/deletion polymorphism (see Tables 1-2)
ggccgaagtctttcccggagcagctgccttgatggttactttgacaagtagtgactgaaaagagcagagatcattaaaaattaaacttacaaagctgctanagtgggaagaaggagaacttgaagccacaatttttgcacttgcttagaagccatctaatctcagttccaccaggtgagaagagtgatgaccatccttttc

SEQ ID NO: 13735 - DNA, 201 bp, Homo sapiens
agccatctaatctcagttccaccaggtgagaagagtgatgaccatccttttccttactatggttatttcatactttggttgcatgaaggctgcccccatgbaagaagcaaacatccgaggacaaggtggcttggcctacccaggtgtgcggacccatgggactctggagagcgtgaatgggcccaaggcaggttcaagagg

SEQ ID NO: 13736 - DNA, 201 bp, Homo sapiens
ctaatctcagttccaccaggtgagaagagtgatgaccatccttttccttactatggttatttcatactttggttgcatgaaggctgcccccatgaaagaabcaaacatccgaggacaaggtggcttggcctacccaggtgtgcggacccatgggactctggagagcgtgaatgggcccaaggcaggttcaagaggcttgac

SEQ ID NO: 13737 - DNA, 201 bp, Homo sapiens
gaaaaaataatagagtgtgggagttttggggccgaagtctttcccggagcagctgccttgatggttactttgacaagtagtgactgaaaagagcagagatrattaaaaattaaacttacaaagctgctaaagtgggaagaaggagaacttgaagccacaatttttgcacttgcttagaagccatctaatctcagttccacc

SEQ ID NO: 13738 - DNA, 201 bp, Homo sapiens
aactacccagtcgtacgtgcgggcccttaccatggatagcaaaaagagaattggctggcgattcataaggatagacacttcttgtgtatgtacattgaccmttaaaaggggaagatagtggatttatgttgtatagattagattatattgagacaaaaattatctatttgtatatatacataacagggtaaattattcagt

SEQ ID NO: 13739 - DNA, 201 bp, Homo sapiens
ggttgcatgaaggctgcccccatgaaagaagcaaacatccgaggacaaggtggcttggcctacccaggtgtgcggacccatgggactctggagagcgtgartgggcccaaggcaggttcaagaggcttgacatcattggctgacactttcgaacacgtgatagaagagctgttggatgaggaccagaaagttcggcccaat

SEQ ID NO: 13740 - DNA, 201 bp, Homo sapiens
tcataaggatagacacttcttgtgtatgtacattgaccattaaaaggggaagatagtggatttatgttgtatagattagattatattgagacaaaaattamctatttgtatatatacataacagggtaaattattcagttaagaaaaaaataattttatgaactgcatgtataaatgaagtttatacagtacagtggttct

SEQ ID NO: 13741 - DNA, 201 bp, Homo sapiens
  misc_feature (1)...(201): n = A,T,C or G, or insertion/deletion polymorphism (see Tables 1-2)
ctctggagagcgtgaatgggcccaaggcaggttcaagaggcttgacatcattggctgacactttcgaacacgtgatagaagagctgttggatgaggaccanaaagttcggcccaatgaagaaaacaataaggacgcagacttgtacacgtccagggtgatgctcagtagtcaagtgcctttggagcctcctcttctctttc

SEQ ID NO: 13742 - DNA, 201 bp, Homo sapiens
tccagggtgatgctcagtagtcaagtgcctttggagcctcctcttctctttctgctggaggaatacaaaaattacctagatgctgcaaacatgtccatgabggtccggcgccactctgaccctgcccgccgaggggagctgagcgtgtgtgacagtattagtgagtgggtaacggcggcagacaaaaagactgcagtggac

SEQ ID NO: 13743 - DNA, 201 bp, Homo sapiens
gtgatgctcagtagtcaagtgcctttggagcctcctcttctctttctgctggaggaatacaaaaattacctagatgctgcaaacatgtccatgagggtccbgcgccactctgaccctgcccgccgaggggagctgagcgtgtgtgacagtattagtgagtgggtaacggcggcagacaaaaagactgcagtggacatgtcg

SEQ ID NO: 13744 - DNA, 201 bp, Homo sapiens
ggcctacccaggtgtgcggacccatgggactctggagagcgtgaatgggcccaaggcaggttcaagaggcttgacatcattggctgacactttcgaacacrtgatagaagagctgttggatgaggaccagaaagttcggcccaatgaagaaaacaataaggacgcagacttgtacacgtccagggtgatgctcagtagtca

SEQ ID NO: 13745 - DNA, 201 bp, Homo sapiens
ttgcgcacaacttaaaaagtctgcattacattccttgataatgttgtggtttgttgccgttgccaagaactgaaaacataaaaagttaaaaaaaataatamattgcatgctgctttaattgtgaattgataataaactgtcctctttcagaaaacagaaaaaaacacacacacacacaacaaaaatttgaaccaaaacatt

SEQ ID NO: 13746 - DNA, 201 bp, Homo sapiens
tagatgctgcaaacatgtccatgagggtccggcgccactctgaccctgcccgccgaggggagctgagcgtgtgtgacagtattagtgagtgggtaacggcrgcagacaaaaagactgcagtggacatgtcgggcgggacggtcacagtccttgaaaaggtccctgtatcaaaaggccaactgaagcaatacttctacgaga

SEQ ID NO: 13747 - DNA, 201 bp, Homo sapiens
ccaagaactgaaaacataaaaagttaaaaaaaataataaattgcatgctgctttaattgtgaattgataataaactgtcctctttcagaaaacagaaaaamacacacacacacacaacaaaaatttgaaccaaaacattccgtttacattttagacagtaagtatcttcgttcttgttagtactatatctgttttactgct

SEQ ID NO: 13748 - DNA, 201 bp, Homo sapiens; identical to SEQ ID NO: 13741
  misc_feature (1)...(201): n = A,T,C or G, or insertion/deletion polymorphism (see Tables 1-2)

SEQ ID NO: 13749 - DNA, 201 bp, Homo sapiens; identical to SEQ ID NO: 13742

SEQ ID NO: 13750 - DNA, 201 bp, Homo sapiens; identical to SEQ ID NO: 13743

SEQ ID NO: 13751 - DNA, 201 bp, Homo sapiens; identical to SEQ ID NO: 13744

SEQ ID NO: 13752 - DNA, 201 bp, Homo sapiens; identical to SEQ ID NO: 13745

SEQ ID NO: 13753 - DNA, 201 bp, Homo sapiens; identical to SEQ ID NO: 13746

SEQ ID NO: 13754 - DNA, 201 bp, Homo sapiens; identical to SEQ ID NO: 13747

SEQ ID NO: 13755 - DNA, 201 bp, Homo sapiens
aagctgcaacatcaactggcatacacatccctgtgatcatgagtctggctcaaagccaatttatagcaaatcatccatttctgtttattatgaagcataayccaacagaatcaattctgtttatgggaagagtgacaaatcctgacacccaggagataaaaggaagagatttagattcactgtgaatgaaaagcacagcct

SEQ ID NO: 13756 - DNA, 201 bp, Homo sapiens
ataaatggagttggccttgatcgctcaggtgtttatgtacaagagttttccagcaagcgtattttagttgtaacattccagtgaataatcagaagtcagtytgggagaagtcaaaatggacacaatcttcttgtggagtcttctattgctgttttttggaagtcaagcctcaagatgctcagctcaaaaaaataccgaatt

SEQ ID NO: 13757 - DNA, 201 bp, Homo sapiens
gaaggattcactgtgaaagaacagtatctccatggcaacaaggaattttttcagagtgctataaaactggtggattttcaagatgcaaaggcttgtgcagrgatgataagtacctgggtagaaagaaaaacagatggaaaaattaaagacatgttttcaggggaagaatttggccctctgactcggcttgtcctggtgaat

SEQ ID NO: 13758 - DNA, 201 bp, Homo sapiens
aggagataaaaggaagagatttagattcactgtgaatgaaaagcacagcctcagaataaaagatgatttctcaaaaatagctgattggcaaaatatcgtcrtcttgacaatatttgctctatatcttatgtcttttctgttttaaactgtgcctgtagtaatagatatctgtcttgatgaataagtaaaattaggtatgca

SEQ ID NO: 13759 - DNA, 201 bp, Homo sapiens
cccaggagataaaaggaagagatttagattcactgtgaatgaaaagcacagcctcagaataaaagatgatttctcaaaaatagctgattggcaaaatatcrtcatcttgacaatatttgctctatatcttatgtcttttctgttttaaactgtgcctgtagtaatagatatctgtcttgatgaataagtaaaattaggtat

SEQ ID NO: 13760 - DNA, 201 bp, Homo sapiens
ttaaagtagaacaaaaagtagacttcaaagacgttttgtattctttgaacataaccgagatatttagtggtggctgcgacctttctggaataacagattcwtctgaagtgtatgtttcccaagtgacgcaaaaagttttctttgagataaatgaagatggtagtgaagctgcaacatcaactggcatacacatccctgtga

SEQ ID NO: 13761 - DNA, 152 bp, Homo sapiens
tttccccactgatccgtccatccctcatgaattaatcaagcaatggtcaagrtaaatggagttggccttgatcgctcaggtgtttatgtacaagagttttccagcaagcgtattttagttgtaacattccagtgaataatcagaagtcagtt

SEQ ID NO: 13762 - DNA, 201 bp, Homo sapiens
aatcaattctgtttatgggaagagtgacaaatcctgacacccaggagataaaaggaagagatttagattcactgtgaatgaaaagcacagcctcagaataraagatgatttctcaaaaatagctgattggcaaaatatcgtcatcttgacaatatttgctctatatcttatgtcttttctgttttaaactgtgcctgtagt

SEQ ID NO: 13763 - DNA, 201 bp, Homo sapiens
gtttatgtacaagagttttccagcaagcgtattttagttgtaacattccagtgaataatcagaagtcagtttgggagaagtcaaaatggacacaatcttcktgtggagtcttctattgctgttttttggaagtcaagcctcaagatgctcagctcaaaaaaataccgaatttgcagtggatctttatcaagaggtttcctt

SEQ ID NO: 13764 - DNA, 201 bp, Homo sapiens; identical to SEQ ID NO: 13755

SEQ ID NO: 13765 - DNA, 201 bp, Homo sapiens; identical to SEQ ID NO: 13758

SEQ ID NO: 13766 - DNA, 201 bp, Homo sapiens; identical to SEQ ID NO: 13759

SEQ ID NO: 13767 - DNA, 201 bp, Homo sapiens; identical to SEQ ID NO: 13760

SEQ ID NO: 13768 - DNA, 201 bp, Homo sapiens; identical to SEQ ID NO: 13762

SEQ ID NO: 13769 - DNA, 201 bp, Homo sapiens; identical to SEQ ID NO: 13757

SEQ ID NO: 13770 - DNA, 126 bp, Homo sapiens
agaagtcaaaatggacacaatcttcktgtggagtcttctattgctgttttttggaagtcaagcctcaagatgctcagctcaaaaaaataccgaatttgcagtggatctttatcaagaggtttcctt

SEQ ID NO: 13771 - DNA, 201 bp, Homo sapiens
tcctcagcatttattaaggactctctgctccagcctctcactctcactctcctccgctcaaactcagctcacttgagagtctcctcccgccagctgtggaragaactttgcgtctctccagcaatgcatctccttgcgattctgttttgtgctctctggtctgcagtgttggccgagaactcggatgattatgatctcatg

SEQ ID NO: 13772 - DNA, 201 bp, Homo sapiens
ttctgttttgtgctctctggtctgcagtgttggccgagaactcggatgattatgatctcatgtatgtgaatttggacaacgaaatagacaatggactccakcccactgaggaccccacgccgtgcgcctgcggtcaggagcactcggaatgggacaagctcttcatcatgctggagaactcgcagatgagagagcgcatgc

SEQ ID NO: 13773 - DNA, 201 bp, Homo sapiens
ctttatttgtactggccaaatactgaataaacagttgaaggaaagacattggaaaaagcttttgaggataatgttactagactttatgccatggtgctttyagtttaatgctgtgtctctgtcagataaactctcaaataattaaaaaggactgtattgttgaacagagggacaattgttttacttttctttggttaattt

SEQ ID NO: 13774 - DNA, 201 bp, Homo sapiens
tgcatccagtgagaccaatgaggcttgagtcttttagtgcctgcatttgggtcaaagccacagatgtattaaacaaaaccatcctgttttcctatggcacwaagaggaatccatatgaaatccagctgtatctcagctaccaatccatagtgtttgtggtgggtggagaggagaacaaactggttgctgaagccatggttt

SEQ ID NO: 13775 - DNA, 201 bp, Homo sapiens
tcacttgagagtctcctcccgccagctgtggaaagaactttgcgtctctccagcaatgcatctccttgcgattctgttttgtgctctctggtctgcagtgytggccgagaactcggatgattatgatctcatgtatgtgaatttggacaacgaaatagacaatggactccatcccactgaggaccccacgccgtgcgcctg

SEQ ID NO: 13776 - DNA, 201 bp, Homo sapiens
gttgctgaagccatggtttccctgggaaggtggacccacctgtgcggcacctggaattcagaggaagggctcacatccttgtgggtaaatggtgaactggyggctaccactgttgagatggccacaggtcacattgttcctgagggaggaatcctgcagattggccaagaaaagaatggctgctgtgtgggtggtggcttt

SEQ ID NO: 13777 - DNA, 201 bp, Homo sapiens
ggctcacatccttgtgggtaaatggtgaactggcggctaccactgttgagatggccacaggtcacattgttcctgagggaggaatcctgcagattggccargaaaagaatggctgctgtgtgggtggtggctttgatgaaacattagccttctctgggagactcacaggcttcaatatctgggatagtgttcttagcaatg

SEQ ID NO: 13778 - DNA, 201 bp, Homo sapiens
gtgttggccgagaactcggatgattatgatctcatgtatgtgaatttggacaacgaaatagacaatggactccatcccactgaggaccccacgccgtgcgmctgcggtcaggagcactcggaatgggacaagctcttcatcatgctggagaactcgcagatgagagagcgcatgctgctgcaagccacggacgacgtcctg

SEQ ID NO: 13779 - DNA, 201 bp, Homo sapiens
gctcacatccttgtgggtaaatggtgaactggcggctaccactgttgagatggccacaggtcacattgttcctgagggaggaatcctgcagattggccaaraaaagaatggctgctgtgtgggtggtggctttgatgaaacattagccttctctgggagactcacaggcttcaatatctgggatagtgttcttagcaatga

SEQ ID NO: 13780 - DNA, 201 bp, Homo sapiens
tcccatttccgtctttttgatgagaacaatgatgctgccattctcattcttctggagcccattgagaaaaaagccattccccagcgcttctgcaagctgcrgaagataatgaacaccaagacctacctggagtggcccatggacgaggctcagcgggaaggattttgggtaaatctgagagctgcgataaagtcctaggtt

SEQ ID NO: 13781 - DNA, 201 bp, Homo sapiens
ttcttctggagcccattgagaaaaaagccattccccagcgcttctgcaagctgcggaagataatgaacaccaagacctacctggagtggcccatggacgakgctcagcgggaaggattttgggtaaatctgagagctgcgataaagtcctaggttcccatatttaagaccagtctttgtctagttgggatctttatgtcac

SEQ ID NO: 13782 - DNA, 201 bp, Homo sapiens
acattgatatcagtaagaatagttttcattctatgcctgaaacttgtcagtggccagaaaagatgaaatatttgaacttatccagcacacgaatacacagygtaacaggctgcattcccaagacactggaaattttagatgttagcaacaacaatctcaatttattttctttgaatttgccgcaactcaaagaactttata

SEQ ID NO: 13783 - DNA, 201 bp, Homo sapiens
ggaatgcaataactacgttttctaaggagcaacttgactcatttcacacactgaagactttggaagctggtggcaataacttcatttgctcctgtgaattyctctccttcactcaggagcagcaagcactggccaaagtcttgattgattggccagcaaattacctgtgtgactctccatcccatgtgcgtggccagcagg

SEQ ID NO: 13784 - DNA, 201 bp, Homo sapiens
ctgttcctgctgatcctgctcacgggggtcctgtgccaccgtttccatggcctgtggtatatgaaaatgatgtgggcctggctccaggccaaaaggaagcmcaggaaagctcccagcaggaacatctgctatgatgcatttgtttcttacagtgagcgggatgcctactgggtggagaaccttatggtccaggagctggag

SEQ ID NO: 13785 - DNA, 201 bp, Homo sapiens
agccacaaaactgtctttgtgctttctgaaaactttgtgaagagtgagtggtgcaagtatgaactggacttctcccatttccgtctttttgatgagaacartgatgctgccattctcattcttctggagcccattgagaaaaaagccattccccagcgcttctgcaagctgcggaagataatgaacaccaagacctacctg

SEQ ID NO: 13786 - DNA, 201 bp, Homo sapiens
tcctgtgaattcctctccttcactcaggagcagcaagcactggccaaagtcttgattgattggccagcaaattacctgtgtgactctccatcccatgtgcrtggccagcaggttcaggatgtccgcctctcggtgtcggaatgtcacaggacagcactggtgtctggcatgtgctgtgctctgttcctgctgatcctgctc

SEQ ID NO: 13787 - DNA, 201 bp, Homo sapiens
gcttctgcaagctgcggaagataatgaacaccaagacctacctggagtggcccatggacgaggctcagcgggaaggattttgggtaaatctgagagctgcrataaagtcctaggttcccatatttaagaccagtctttgtctagttgggatctttatgtcactagttatagttaagttcattcagacataattatataaaa

SEQ ID NO: 13788 - DNA, 201 bp, Homo sapiens
aaaaattcagcctgtgaggatgcctggccctctctacaaactttaattttaaggcaaaatcatttggcatcattggaaaaaaccggagagactttgctcaytctgaaaaacttgactaacattgatatcagtaagaatagttttcattctatgcctgaaacttgtcagtggccagaaaagatgaaatatttgaacttatcc

SEQ ID NO: 13789 - DNA, 201 bp, Homo sapiens
aaagaaaagattttgctggacttaccttccttgaggaacttgagattgatgcttcagatctacagagctatgagccaaaaagtttgaagtcaattcagaaygtaagtcatctgatccttcatatgaagcagcatattttactgctggagatttttgtagatgttacaagttccgtggaatgtttggaactgcgagatactg

SEQ ID NO: 13790 - DNA, 201 bp, Homo sapiens; identical to SEQ ID NO: 13780

SEQ ID NO: 13791 - DNA, 201 bp, Homo sapiens; identical to SEQ ID NO: 13781

SEQ ID NO: 13792 - DNA, 201 bp, Homo sapiens; identical to SEQ ID NO: 13782

SEQ ID NO: 13793 - DNA, 201 bp, Homo sapiens; identical to SEQ ID NO: 13783

SEQ ID NO: 13794 - DNA, 201 bp, Homo sapiens; identical to SEQ ID NO: 13784

SEQ ID NO: 13795 - DNA, 201 bp, Homo sapiens; identical to SEQ ID NO: 13785

SEQ ID NO: 13796 - DNA, 201 bp, Homo sapiens; identical to SEQ ID NO: 13786

SEQ ID NO: 13797 - DNA, 201 bp, Homo sapiens; identical to SEQ ID NO: 13787

SEQ ID NO: 13798 - DNA, 201 bp, Homo sapiens; identical to SEQ ID NO: 13788

SEQ ID NO: 13799 - DNA, 201 bp, Homo sapiens; identical to SEQ ID NO: 13789

SEQ ID NO: 13800 - DNA, 201 bp, Homo sapiens
aaaggagtcgaagaagccaccagccaagctgcagccccgagctctagcaggctggctccgcccggaagatggaggtcaagcagaaggggcagaggatgaamtggaagtccggttcaacgccccctttgatgttggaatcaagctgtcaggggttcagtaccagcagcacagccaggccctggggaagtttcttcaggacat

SEQ ID NO: 13801 - DNA, 201 bp, Homo sapiens
ctggacttggccatggcaggctccagcttcctgagccctgaacaccagagagtccagcagagaaaggagtcgaagaagccaccagccaagctgcagccccragctctagcaggctggctccgcccggaagatggaggtcaagcagaaggggcagaggatgaactggaagtccggttcaacgccccctttgatgttggaatc

SEQ ID NO: 13802 - DNA, 130 bp, Homo sapiens
tagacagcactgaaagagctgcattctccttcctcccttctccactactgagaaggcctgacaaagcaaatgcctcacatgggcaaggctggccgtcgccrtggttcccttactgataccaggtgggatc

SEQ ID NO: 13803 - DNA, 201 bp, Homo sapiens
ctccgcccggaagatggaggtcaagcagaaggggcagaggatgaactggaagtccggttcaacgccccctttgatgttggaatcaagctgtcaggggttcwgtaccagcagcacagccaggccctggggaagtttcttcaggacatcctctgggaagaggccaaagaggccccagccgacaagtgatcgcccacaagcctt

SEQ ID NO: 13804 - DNA, 201 bp, Homo sapiens; identical to SEQ ID NO: 13801

SEQ ID NO: 13805 - DNA, 201 bp, Homo sapiens; identical to SEQ ID NO: 13803

SEQ ID NO: 13806 - DNA, 201 bp, Homo sapiens; identical to SEQ ID NO: 13800

SEQ ID NO: 13807 - DNA, 201 bp, Homo sapiens
ggatcagaagatatcttttgtgcctagattgcaaaatctccaatccacacatattgttttaaaataagaatgttatccaactattaagatatctcaatgtrcaataacttgtgtattagatatcaatgttaatgatatgtcttggccactatggaccagggagcttatttttcttgtcatgtactgacaactgtttaattg

SEQ ID NO: 13808 - DNA, 201 bp, Homo sapiens
aatcatctattgaagaatgtaaaattcggcaatgggggacaagagcctgttcacattctgaagatgctggagtcacttgcactttataatgcatcatattktcattcacaactatgaaatcgctgctcaaaaatgattttattaccttgttcctgtaaaatccatttaatcaatatttaagagattaagaatattgcccaa

SEQ ID NO: 13809 - DNA, 201 bp, Homo sapiens
ataatatgttcaccaggagattacaattttttgctcttcttgtctttgtaatctatttagttgattttaattactttctgaataacggaagggatcagaaratatcttttgtgcctagattgcaaaatctccaatccacacatattgttttaaaataagaatgttatccaactattaagatatctcaatgtgcaataactt

SEQ ID NO: 13810 - DNA, 201 bp, Homo sapiens
ttatgaagtcagtcaacatttacaaccaaagggcgggggggggggtggggggtgcgtctttagtcctaaagggacaataactctgagcatgccccaaaaargtagtttagcaaccttttgttggtagtcaacccatccccagggccatagtgtagagtgtgaaaagctaccctgaaacccagtaattctaccctgaaagtg

SEQ ID NO: 13811 - DNA, 201 bp, Homo sapiens
aggagaagtgaaagtactgaataacatcactaatgatctcagactgaaagattgggaacattctcagaccttgagaaatatcactttaattcaaggtcctsctggacccccgggtgaaaaaggagatcgaggtcccactggagaaagtggtccacgaggatttccaggtccaataggtcctccgggtcttaaaggtgatcg

SEQ ID NO: 13812 - DNA, 201 bp, Homo sapiens
taagaatattgcccaaataatattttagattacaggattaatatattgaacaccttcatgcttactattttatgtctatatttaaatcattttaacttctrtaggtttttaaatggaattttctaatataatgacttatatgctgaattgaacattttgaagtttatagcttccagattacaaaggccaagggtaatagaa

SEQ ID NO: 13813 - DNA, 201 bp, Homo sapiens
atcgctgctcaaaaatgattttattaccttgttcctgtaaaatccatttaatcaatatttaagagattaagaatattgcccaaataatattttagattacrggattaatatattgaacaccttcatgcttactattttatgtctatatttaaatcattttaacttctataggtttttaaatggaattttctaatataatga

SEQ ID NO: 13814 - DNA, 201 bp, Homo sapiens
tgcagctcaacatagaaaatctgaatggcaaaatccaagagaataccttcaaacaacaagaggaaatcagtaaattagaggagcgtgtttacaatgtatcrgcagaaattatggctatgaaagaagaacaagtgcatttggaacaggaaataaaaggagaagtgaaagtactgaataacatcactaatgatctcagactga

SEQ ID NO: 13815 - DNA, 201 bp, Homo sapiens
aggacactgatagctgctccgaatctgtgaaatttgatgctcgctcaatgacagctttgcttcctccgaatcctaaaaacagcccttcccttcaagagaarctgaagtccttcaaagctgcactgattgccctttacctcctcgtgtttgcagttctcatccctctcattggaatagtggcagctcaactcctgaagtggg

SEQ ID NO: 13816 - DNA, 201 bp, Homo sapiens; identical to SEQ ID NO: 13807

SEQ ID NO: 13817 - DNA, 201 bp, Homo sapiens; identical to SEQ ID NO: 13808

SEQ ID NO: 13818 - DNA, 201 bp, Homo sapiens; identical to SEQ ID NO: 13809

SEQ ID NO: 13819 - DNA, 201 bp, Homo sapiens; identical to SEQ ID NO: 13810

SEQ ID NO: 13820 - DNA, 201 bp, Homo sapiens; identical to SEQ ID NO: 13811

SEQ ID NO: 13821 - DNA, 201 bp, Homo sapiens; identical to SEQ ID NO: 13812

SEQ ID NO: 13822 - DNA, 201 bp, Homo sapiens; identical to SEQ ID NO: 13813

SEQ ID NO: 13823 - DNA, 201 bp, Homo sapiens; identical to SEQ ID NO: 13814

SEQ ID NO: 13824 - DNA, 201 bp, Homo sapiens; identical to SEQ ID NO: 13815

SEQ ID NO: 13825 - DNA, 201 bp, Homo sapiens; identical to SEQ ID NO: 13807

SEQ ID NO: 13826 - DNA, 201 bp, Homo sapiens; identical to SEQ ID NO: 13808

SEQ ID NO: 13827 - DNA, 201 bp, Homo sapiens; identical to SEQ ID NO: 13809

SEQ ID NO: 13828 - DNA, 201 bp, Homo sapiens; identical to SEQ ID NO: 13810

SEQ ID NO: 13829 - DNA, 201 bp, Homo sapiens; identical to SEQ ID NO: 13811

SEQ ID NO: 13830 - DNA, 201 bp, Homo sapiens; identical to SEQ ID NO: 13812

SEQ ID NO: 13831 - DNA, 201 bp, Homo sapiens; identical to SEQ ID NO: 13813

SEQ ID NO: 13832 - DNA, 201 bp, Homo sapiens; identical to SEQ ID NO: 13814

SEQ ID NO: 13833 - DNA, 201 bp, Homo sapiens; identical to SEQ ID NO: 13815

SEQ ID NO: 13834 - DNA, 201 bp, Homo sapiens; identical to SEQ ID NO: 13807

SEQ ID NO: 13835 - DNA, 201 bp, Homo sapiens; identical to SEQ ID NO: 13808

SEQ ID NO: 13836 - DNA, 201 bp, Homo sapiens; identical to SEQ ID NO: 13809

SEQ ID NO: 13837 - DNA, 201 bp, Homo sapiens; identical to SEQ ID NO: 13810

SEQ ID NO: 13838 - DNA, 201 bp, Homo sapiens; identical to SEQ ID NO: 13811

SEQ ID NO: 13839 - DNA, 201 bp, Homo sapiens; identical to SEQ ID NO: 13812

SEQ ID NO: 13840 - DNA, 201 bp, Homo sapiens; identical to SEQ ID NO: 13813

SEQ ID NO: 13841 - DNA, 121 bp, Homo sapiens
cattgatgagagtgctattgraacacattaagaaagattttcaacgcaggaatgtgtcatttcctttcttcatgtaccagatgctgaaatactatgagataaagattttaggtttcaattg

SEQ ID NO: 13842 - DNA, 201 bp, Homo sapiens; identical to SEQ ID NO: 13814

SEQ ID NO: 13843 - DNA, 137 bp, Homo sapiens
cattgatgagagtgctattgaaacacattaagaaagrttttcaacgcaggaatgtgtcatttcctttcttcatgtaccagatgctgaaatactatgagataaagattttaggtttcaattgtaaagagagagaagtg

SEQ ID NO: 13844 - DNA, 201 bp, Homo sapiens; identical to SEQ ID NO: 13815

SEQ ID NO: 13845 - DNA, 201 bp, Homo sapiens
ttctattgcacaggctggactacacgcattcacctagagtctagaacacaatttaatttattgggttctaggagaactgtcatgagtattgataatatgaragttctttatattcaaacattattctcaaccagagatagggatgtcatagaagaaaatccattcattcaatcattaattcacatgtccattatgtacctc

SEQ ID NO: 13846 - DNA, 201 bp, Homo sapiens
gagctggacataacagctaataagagataattgtctctggttttacagagctaattgtccctaagagatgtagacaaatgaacaagcaattacaatacatytaagctatactgggggaggaacagggctggataggtatgcagaggagataaaaaaattttaattccttagaatattttttaaaaattgattcttatttta

SEQ ID NO: 13847 - DNA, 201 bp, Homo sapiens
tcttctttcctttacgttttaacacacagacccaagattcatactattaagattctagtagaactctagatggtatgcctctgtgtatctcagcatttttrttcccactcttgtataatgaacatgttaacacctacctcacagggttgttgtgaggatcaagtaagatattgtgtgtgtgaagatgctctgtgaaatcat

SEQ ID NO: 13848 - DNA, 201 bp, Homo sapiens
gatcaaagtaaagactgagtcaagggctttttttttttctttttcttgttttaagagacagagccttgttctattgcacaggctggactacacgcattcamctagagtctagaacacaatttaatttattgggttctaggagaactgtcatgagtattgataatatgagagttctttatattcaaacattattctcaacca

SEQ ID NO: 13849 - DNA, 201 bp, Homo sapiens; identical to SEQ ID NO: 13811

SEQ ID NO: 13850 - DNA, 201 bp, Homo sapiens; identical to SEQ ID NO: 13814

SEQ ID NO: 13851 - DNA, 121 bp, Homo sapiens; identical to SEQ ID NO: 13841

SEQ ID NO: 13852 - DNA, 201 bp, Homo sapiens
atataacacttgtgtgaggctctgtcctaaatatctcaattaccaatatgtggtttggtagtatttctcgccatgctttgctcatgcgcaatgagactacmactagggtgtaaattttaagtatcccatctaaaactcatacaatgataggaaaaatccatttgtttttcatttgatttttactgaggaatcagctcaatc

SEQ ID NO: 13853 - DNA, 137 bp, Homo sapiens; identical to SEQ ID NO: 13843

SEQ ID NO: 13854 - DNA, 201 bp, Homo sapiens; identical to SEQ ID NO: 13815

SEQ ID NO: 13855 - DNA, 201 bp, Homo sapiens
agtggcccatccagtgcccaggtgcggggctccccgtgtgcacccctgagaaagacttcgctgagcacctcctcatcccacgcaccaggggcctcctcagyggctgggcacgcaatggcactgacctgggcaactcgctgaccacgcggcctgtcacacttgtggagggggaggagtgcgggcaggtcctgaatgtgactg

SEQ ID NO: 13856 - DNA, 201 bp, Homo sapiens
gctcacatggtccttgtcaccaaggtctccaggtactcactctggtttaaacagatcatgaactaactgaaactcagctagccagaatgaacaacacaacyggaagcgggattccaagctggcactgccactgtggagggcgctgaaacttcatcacacactgagaggccgtcacagccccagaccacccgcttggcccac

SEQ ID NO: 13857 - DNA, 201 bp, Homo sapiens
gaaacttggaaaaagaatgttatgaagaaatctgtgtctatgaagaagcaagagaagtgtttgaaaatgaagtagtcactgatgaattctggagacgatayaagggcggctccccgtgcatctcccagccctgcctccacaacggctcttgccaggacagcatctggggctacacctgcacctgctcccccggctatgagg

SEQ ID NO: 13858 - DNA, 201 bp, Homo sapiens
ctgagaaagacttcgctgagcacctcctcatcccacgcaccaggggcctcctcagcggctgggcacgcaatggcactgacctgggcaactcgctgaccacrcggcctgtcacacttgtggagggggaggagtgcgggcaggtcctgaatgtgactgtcaccaccaggacctactgtgagagaagcagcgtggcggccatgc

SEQ ID NO: 13859 - DNA, 201 bp, Homo sapiens
gaggtggaagcgtgcgggctcctatcttctggaagaactcttcgagggaaacttggaaaaagaatgttatgaagaaatctgtgtctatgaagaagcaagaraagtgtttgaaaatgaagtagtcactgatgaattctggagacgatataagggcggctccccgtgcatctcccagccctgcctccacaacggctcttgcca

SEQ ID NO: 13860 - DNA, 118 bp, Homo sapiens
tgtagccctgtcccagcrctccgggtgggaatggcaggctgcgtcccactgctccagggcctggtcctggtcctcgccctccatcgtgtggagccctcagtatttctcccggcctcca

SEQ ID NO: 13861 - DNA, 201 bp, Homo sapiens
ctgtcactgctggagctggagtggcccatccagtgcccaggtgcggggctccccgtgtgcacccctgagaaagacttcgctgagcacctcctcatcccacrcaccaggggcctcctcagcggctgggcacgcaatggcactgacctgggcaactcgctgaccacgcggcctgtcacacttgtggagggggaggagtgcggg

SEQ ID NO: 13862 - DNA, 201 bp, Homo sapiens; identical to SEQ ID NO: 13856

SEQ ID NO: 13863 - DNA, 201 bp, Homo sapiens; identical to SEQ ID NO: 13857

SEQ ID NO: 13864 - DNA, 201 bp, Homo sapiens; identical to SEQ ID NO: 13859

SEQ ID NO: 13865 - DNA, 118 bp, Homo sapiens; identical to SEQ ID NO: 13860

SEQ ID NO: 13866 - DNA, 201 bp, Homo sapiens
gctgacctctgagaagcgtgcaccggatctacaggacctcccgtggcaggcctctaacacaattatctcctgcctgaactgaggtgcagccctcgtgtccmcaatgctccgtacccgagtgtggctgccgtgtggatggcacagcctcaggggccccccttgtaaagttaacaaattccgaaggaaaagacttctgtggtg

SEQ ID NO: 13867 - DNA, 201 bp, Homo sapiens; identical to SEQ ID NO: 13855

SEQ ID NO: 13868 - DNA, 201 bp, Homo sapiens; identical to SEQ ID NO: 13856

SEQ ID NO: 13869 - DNA, 201 bp, Homo sapiens; identical to SEQ ID NO: 13857

SEQ ID NO: 13870 - DNA, 201 bp, Homo sapiens; identical to SEQ ID NO: 13858

SEQ ID NO: 13871 - DNA, 201 bp, Homo sapiens; identical to SEQ ID NO: 13859

SEQ ID NO: 13872 - DNA, 201 bp, Homo sapiens; identical to SEQ ID NO: 13861

SEQ ID NO: 13873 - DNA, 201 bp, Homo sapiens
aatgtgaagcatgcctggtcccccatgaaggatggcagcagccccaaagtggaattcagcaatgcccacggctttctgctggacacgagtctggagcctcytctgtgcggacagacattgtgtgacaacacagaggtcattgccagctacaatcagctctcaagtttccgccagcccaaggtggtgcgctaccgcgtggtc

SEQ ID NO: 13874 - DNA, 201 bp, Homo sapiens
acacacggttcctccagcctgccctgagcctcaaggctgctacctcgagctggagttcctctaccccttggtccctgagtctctgaccatttgggtgaccyttgtctccactgactgggactctagtggagctgtcaatgacatcaaactgttggctgtcagtgggaagaacatctccctgggtcctcagaatgtcttctg

SEQ ID NO: 13875 - DNA, 201 bp, Homo sapiens
attcagcggatcagtcttaagaggagcttttttttggagcgagaaatcatataaaataaaatgaaataaaacaaggaggaaggcaaccagctgttaggggraaaataaggcagataaaggagcggggagagaaattaattgccaaccaggaggagttgggctgtatttttcaaaggtggggagagtggagcacacaccttg

SEQ ID NO: 13876 - DNA, 201 bp, Homo sapiens
cgaagaaagtcgaggcgccgaggctcccaaagctggcagctccgggtggcggtgcagggcgaaggggggcggggggaaccgtcggacatgcggctctggaktttggtgctgcacctggggctgctgagcgccgcgctgggctgcgggctggccgagcgtccccgccgggcccggagagacccgcgggccggccgacccccg

SEQ ID NO: 13877 - DNA, 201 bp, Homo sapiens
agaaagtcgaggcgccgaggctcccaaagctggcagctccgggtggcggtgcagggcgaaggggggcggggggaaccgtcggacatgcggctctggatttkggtgctgcacctggggctgctgagcgccgcgctgggctgcgggctggccgagcgtccccgccgggcccggagagacccgcgggccggccgacccccgcgc

SEQ ID NO: 13878 - DNA, 201 bp, Homo sapiens
gacaatgtgaagcatgcctggtcccccatgaaggatggcagcagccccaaagtggaattcagcaatgcccacggctttctgctggacacgagtctggagcytcctctgtgcggacagacattgtgtgacaacacagaggtcattgccagctacaatcagctctcaagtttccgccagcccaaggtggtgcgctaccgcgtg

SEQ ID NO: 13879 - DNA, 201 bp, Homo sapiens
acctgtggctttcatagcttcttcaacactccttacaacaacttcatgagctatgcagatgacgactgtacggactccttcacgcccaatcaagtcgccaraatgcactgttacctggacctggtctaccagggctggcagccctccaggaaaccagcgcctgttgccctcgccccccaagttctgggccacacaacggac

SEQ ID NO: 13880 - DNA, 201 bp, Homo sapiens
cccgccgggcccggagagacccgcgggccggccgacccccgcgccccgccgccgggcccggccacctgccccacccgggcgtgcccgacggcggccgcgcytcgccgccgccgccgccgccgccgggcggtgcctgggaagccgtgcgcgtcccccggcggcggcgcagcagcgggaggcgaggggcgccaccgaggagcc

SEQ ID NO: 13881 - DNA, 201 bp, Homo sapiens
cgagcgtccccgccgggcccggagagacccgcgggccggccgacccccgcgccccgccgccgggcccggccacctgccccacccgggcgtgcccgacggcsgccgcgcttcgccgccgccgccgccgccgccgggcggtgcctgggaagccgtgcgcgtcccccggcggcggcgcagcagcgggaggcgaggggcgccacc

SEQ ID NO: 13882 - DNA, 201 bp, Homo sapiens
ggactccttcacgcccaatcaagtcgccagaatgcactgttacctggacctggtctaccagggctggcagccctccaggaaaccagcgcctgttgccctcsccccccaagttctgggccacacaacggactctgtgacactggagtggttcccacctatagatggccatttctttgaaagagaattgggatcagcatgtca

SEQ ID NO: 13883 - DNA, 201 bp, Homo sapiens
gtgcgcgtcccccggcggcggcgcagcagcgggaggcgaggggcgccaccgaggagccgagcccgccgagccggatatatttcagcgggcgaggcgagcasctgcgcctccgggccgacctcgagctgccccgggacgcgttcacgctgcaagtgtggctgcgagcggaggggggccagaggtctccggcagtgatcacag

SEQ ID NO: 13884 - DNA, 201 bp, Homo sapiens
cgccagaatgcactgttacctggacctggtctaccagggctggcagccctccaggaaaccagcgcctgttgccctcgccccccaagttctgggccacacarcggactctgtgacactggagtggttcccacctatagatggccatttctttgaaagagaattgggatcagcatgtcatctttgcctggaagggagaatcct

SEQ ID NO: 13885 - DNA, 201 bp, Homo sapiens
gccgcgctgggctgcgggctggccgagcgtccccgccgggcccggagagacccgcgggccggccgacccccgcgccccgccgccgggcccggccacctgcsccacccgggcgtgcccgacggcggccgcgcttcgccgccgccgccgccgccgccgggcggtgcctgggaagccgtgcgcgtcccccggcggcggcgcagc

SEQ ID NO: 13886 - DNA, 201 bp, Homo sapiens
tgggccacacaacggactctgtgacactggagtggttcccacctatagatggccatttctttgaaagagaattgggatcagcatgtcatctttgcctggargggagaatcctggtgcagtatgcttccaacgcttcctccccaatgccctgcagcccatcaggacactggagccctcgtgaagcagaaggtcatcctgatg

SEQ ID NO: 13887 - DNA, 201 bp, Homo sapiens
cctaaacacaagtcctgtggtgacccagggccaggaaatgacacctgtggctttcatagcttcttcaacactccttacaacaacttcatgagctatgcagrtgacgactgtacggactccttcacgcccaatcaagtcgccagaatgcactgttacctggacctggtctaccagggctggcagccctccaggaaaccagcg

SEQ ID NO: 13888 - DNA, 201 bp, Homo sapiens; identical to SEQ ID NO: 13875

SEQ ID NO: 13889 - DNA, 201 bp, Homo sapiens; identical to SEQ ID NO: 13876

SEQ ID NO: 13890 - DNA, 201 bp, Homo sapiens; identical to SEQ ID NO: 13877

SEQ ID NO: 13891 - DNA, 201 bp, Homo sapiens; identical to SEQ ID NO: 13878

SEQ ID NO: 13892 - DNA, 201 bp, Homo sapiens; identical to SEQ ID NO: 13879

SEQ ID NO: 13893 - DNA, 201 bp, Homo sapiens
agctgccagagaggggagacctacagccctgccgagcagagctgcgtgcacttcgcatgtgagaaaactgactgtccagagctggctgtggagaatgcttmtctcaattgctccagcagcgaccgctaccacggtgcccagtgtactgtgagctgccggacaggctacgtgctccagatacggcgggatgatgagctgatc

SEQ ID NO: 13894 - DNA, 201 bp, Homo sapiens; identical to SEQ ID NO: 13880

SEQ ID NO: 13895 - DNA, 201 bp, Homo sapiens
ccacatccctttggtattgatttcacagtcagctgctcaacggaatggcctctccacaccagggatccttagcacccaaccggtctgcctttaattttacscaggaaggactcacattggggcgaatgaaccaagtttcgccatgctggatgatgaaatggattcccatcccaaagtctgagatggattgcatatacagtg

SEQ ID NO: 13896 - DNA, 201 bp, Homo sapiens
gcatggaggatgggctgtggtccttcccagaggccctgtgtgagctcatgtgcctcgctccaccccctgtgcccaatgcagacctccagaccgcccggtgycgagagaataagcacaaggtgggctccttctgcaaatacaaatgcaagcctggataccatgtgcctggatcctctcggaagtcaaagaaacgggccttca

SEQ ID NO: 13897 - DNA, 201 bp, Homo sapiens; identical to SEQ ID NO: 13886

SEQ ID NO: 13898 - DNA, 201 bp, Homo sapiens
aatgtaatatttacaaaataaaactgtgatctcgtctagagaaaatgtattcatattacaaactgctcttccatatttatgtaccatattatacctttttwttattgttataattattatgggtatttctaattaatatgatgttgaaacctgtttggcaccttctggaagctaccaaaaaaatgacactccattgaagtg

SEQ ID NO: 13899 - DNA, 201 bp, Homo sapiens
aagtgagaaaataaaaaaaaatggtgacaaagctgtacagatagagataatagaagacaaagagattaaaaggaaataaaaatgcatgattaaaaactaaraataaaaaacctatttttatgtttcctaaaggaaattgtttattctacagactcagtaggtagacacaaacataaagatttccctagaagacatagagtg

SEQ ID NO: 13900 - DNA, 201 bp, Homo sapiens
tgtgatctacaaggtgactgtgcttgtcgggacccccaggcccaagaacacagccggaaagacctccggggatacagccatggctaaggaaggacaagaakttgtcaaagaattcccaacgccaggacccacatccctttggtattgatttcacagtcagctgctcaacggaatggcctctccacaccagggatccttagc

SEQ ID NO: 13901 - DNA, 201 bp, Homo sapiens
tgagaaaataaaaaaaaatggtgacaaagctgtacagatagagataatagaagacaaagagattaaaaggaaataaaaatgcatgattaaaaactaagaawaaaaaacctatttttatgtttcctaaaggaaattgtttattctacagactcagtaggtagacacaaacataaagatttccctagaagacatagagtggga

SEQ ID NO: 13902 - DNA, 201 bp, Homo sapiens
gtaatatttacaaaataaaactgtgatctcgtctagagaaaatgtattcatattacaaactgctcttccatatttatgtaccatattatacctttttattrttgttataattattatgggtatttctaattaatatgatgttgaaacctgtttggcaccttctggaagctaccaaaaaaatgacactccattgaagtgctt

SEQ ID NO: 13903 - DNA, 201 bp, Homo sapiens; identical to SEQ ID NO: 13885

SEQ ID NO: 13904 - DNA, 201 bp, Homo sapiens; identical to SEQ ID NO: 13887

SEQ ID NO: 13905 - DNA, 201 bp, Homo sapiens; identical to SEQ ID NO: 13873

SEQ ID NO: 13906 - DNA, 201 bp, Homo sapiens
atgccatcaacaaccgagccttttgcaactatgacggtggggattgctgcacctccacagtgaagaccaaaaaggtcaccccattccctatgtcctgtgayctacaaggtgactgtgcttgtcgggacccccaggcccaagaacacagccggaaagacctccggggatacagccatggctaaggaaggacaagaagttgtc

SEQ ID NO: 13907 - DNA, 201 bp, Homo sapiens
acggtggggattgctgcacctccacagtgaagaccaaaaaggtcaccccattccctatgtcctgtgatctacaaggtgactgtgcttgtcgggacccccasgcccaagaacacagccggaaagacctccggggatacagccatggctaaggaaggacaagaagttgtcaaagaattcccaacgccaggacccacatccctt

SEQ ID NO: 13908 - DNA, 201 bp, Homo sapiens
atgcacgtgtgcagccccacctaattcctgcatccaaggcaggtgttgttaatctatcatagcacttaaaaaaaaaaaaaaaaaagagaccaaaaataacyttaggaaccaccatattatatcactcccaatagcactgacctggtgatcaaaaacacttgagaagacatctattggccatctctggccaattacactaag

SEQ ID NO: 13909 - DNA, 201 bp, Homo sapiens; identical to SEQ ID NO: 13882

SEQ ID NO: 13910 - DNA, 201 bp, Homo sapiens
tgaacccctctccagtatcttcacactcttgtcaactctccaggcctctctcttgccctgagttatcagcctgtgtggtgttaactaccttagaaggtacragctaagaaatgtaacagtatcaaccctcccagttgcttaattatacccataggtaatacaaaaagctctgaagacccaaagatgacattactaatgatg

SEQ ID NO: 13911 - DNA, 201 bp, Homo sapiens
aagaccaaggtgaacaatgcgacgacatgaataagatcaatggtgatggctgctcccttttctgccgacaagaagtctccttcaattgtattgatgaaccyagccggtgctatttccatgatggtgatggggtatgtgaggagtttgaacaaaaaaccagcattaaggactgtggtgtctacacgccccagggattcctgg

SEQ ID NO: 13912 - DNA, 201 bp, Homo sapiens; identical to SEQ ID NO: 13884

SEQ ID NO: 13913 - DNA, 201 bp, Homo sapiens
agaagacaaagagattaaaaggaaataaaaatgcatgattaaaaactaagaataaaaaacctatttttatgtttcctaaaggaaattgtttattctacagmctcagtaggtagacacaaacataaagatttccctagaagacatagagtgggatttgataacactgtctgttattttctgtacattgtggtaggtccagga

SEQ ID NO: 13914 - DNA, 201 bp, Homo sapiens
tccaccttaaaagagagacctgtattggagaatattttatttttttggcaaatttgatcttaccctttaccagttctataatttggttaaaagctgattaygtcctacaatgtcaaagtcagctaactgtcgtctacttaagacttctggtcatttccaacttatagaggaagggagtctctaaaatctcttcttcagaag

SEQ ID NO: 13915 - DNA, 201 bp, Homo sapiens; identical to SEQ ID NO: 13874

SEQ ID NO: 13916 - DNA, 201 bp, Homo sapiens
caaggtgggctccttctgcaaatacaaatgcaagcctggataccatgtgcctggatcctctcggaagtcaaagaaacgggccttcaagactcagtgtaccmaggatggcagctggcaggagggagcttgtgttcctgtgacctgtgacccacctccaccaaaattccatgggctctaccagtgtactaatggcttccagtt

SEQ ID NO: 13917 - DNA, 201 bp, Homo sapiens
agcagtactcccttccatacctgtgactgggcagtgcttttctctctcccatgtctagcctccaaaagttaagtgaaaattagtcaactgcacgtggaagmccccaccactttggggatctctttatttcttttcagccagggacctgtccactccctttgaattaatatgggaagaaattaatacaggatgaactggaga

SEQ ID NO: 13918 - DNA, 201 bp, Homo sapiens
ggagctgggaattgcggagaagggaaggtctagactagttacatcacatagggattactgtaaatcaagtcatctcaagtctagtgaagacagccaacagraacaaaacctagcatagggatagaaaataccatgcacgtgtgcagccccacctaattcctgcatccaaggcaggtgttgttaatctatcatagcacttaa

SEQ ID NO: 13919 - DNA, 201 bp, Homo sapiens
ctaattaatatgatgttgaaacctgtttggcaccttctggaagctaccaaaaaaatgacactccattgaagtgcttaaaagctgttctcataagaattctwctggcctattgtaaaaaagaaaaaaaaaaagaaaaagaagaaagacacaaagaaaataatctaaacaccaaaaactaaacacaattccaatcctttttct

SEQ ID NO: 13920 - DNA, 201 bp, Homo sapiens
gacagccaacagaaacaaaacctagcatagggatagaaaataccatgcacgtgtgcagccccacctaattcctgcatccaaggcaggtgttgttaatctakcatagcacttaaaaaaaaaaaaaaaaaagagaccaaaaataactttaggaaccaccatattatatcactcccaatagcactgacctggtgatcaaaaaca

SEQ ID NO: 13921 - DNA, 201 bp, Homo sapiens; identical to SEQ ID NO: 13881

SEQ ID NO: 13922 - DNA, 201 bp, Homo sapiens; identical to SEQ ID NO: 13883

SEQ ID NO: 13923 - DNA, 201 bp, Homo sapiens
agtgtgccacctcgtgcctggaccacaacagcgagtccatcatcctgccaatgaacgtgaccgtgcgtgacatcccccactggctgaaccccacacgggtrgagagagttgtctgcactgctggtctcaagtggtatcctcaccctgctctgattcactgtgtcaaaggctgtgagcccttcatgggagacaattattgtg

SEQ ID NO: 13924 - DNA, 201 bp, Homo sapiens; identical to SEQ ID NO: 13875

SEQ ID NO: 13925 - DNA, 201 bp, Homo sapiens; identical to SEQ ID NO: 13876

SEQ ID NO: 13926 - DNA, 201 bp, Homo sapiens; identical to SEQ ID NO: 13877

SEQ ID NO: 13927 - DNA, 201 bp, Homo sapiens; identical to SEQ ID NO: 13878

SEQ ID NO: 13928 - DNA, 201 bp, Homo sapiens; identical to SEQ ID NO: 13879

SEQ ID NO: 13929 - DNA, 201 bp, Homo sapiens; identical to SEQ ID NO: 13893

SEQ ID NO: 13930 - DNA, 201 bp, Homo sapiens; identical to SEQ ID NO: 13880

SEQ ID NO: 13931 - DNA, 201 bp, Homo sapiens; identical to SEQ ID NO: 13895

SEQ ID NO: 13932 - DNA, 201 bp, Homo sapiens; identical to SEQ ID NO: 13896

SEQ ID NO: 13933 - DNA, 201 bp, Homo sapiens; identical to SEQ ID NO: 13886

SEQ ID NO: 13934 - DNA, 201 bp, Homo sapiens; identical to SEQ ID NO: 13898

SEQ ID NO: 13935 - DNA, 201 bp, Homo sapiens; identical to SEQ ID NO: 13899

SEQ ID NO: 13936 - DNA, 201 bp, Homo sapiens; identical to SEQ ID NO: 13901

SEQ ID NO: 13937 - DNA, 201 bp, Homo sapiens; identical to SEQ ID NO: 13902

SEQ ID NO: 13938 - DNA, 201 bp, Homo sapiens
cccttctgcaagagaaaaaccctcatgggtccacatggtgagaagttaagtttcctgtaagtgggcctctcaccctggaaaggagttgagggacatcagaygctggaaccctcactgaaagtccagaatgtctaagccagtgttagattttgtaaacaagtggaacagtgttaaatttctatgatgttggagccatccaga

SEQ ID NO: 13939 - DNA, 201 bp, Homo sapiens; identical to SEQ ID NO: 13885

SEQ ID NO: 13940 - DNA, 201 bp, Homo sapiens; identical to SEQ ID NO: 13887

SEQ ID NO: 13941 - DNA, 201 bp, Homo sapiens; identical to SEQ ID NO: 13873

SEQ ID NO: 13942 - DNA, 201 bp, Homo sapiens; identical to SEQ ID NO: 13908

SEQ ID NO: 13943 - DNA, 201 bp, Homo sapiens; identical to SEQ ID NO: 13882

SEQ ID NO: 13944 - DNA, 201 bp, Homo sapiens; identical to SEQ ID NO: 13910

SEQ ID NO: 13945 - DNA, 201 bp, Homo sapiens; identical to SEQ ID NO: 13911

SEQ ID NO: 13946 - DNA, 201 bp, Homo sapiens; identical to SEQ ID NO: 13884

SEQ ID NO: 13947 - DNA, 201 bp, Homo sapiens; identical to SEQ ID NO: 13913

SEQ ID NO: 13948 - DNA, 201 bp, Homo sapiens; identical to SEQ ID NO: 13914

SEQ ID NO: 13949 - DNA, 201 bp, Homo sapiens; identical to SEQ ID NO: 13874

SEQ ID NO: 13950 - DNA, 201 bp, Homo sapiens
caaggtgggctccttctgcaaatacaaatgcaagcctggataccatgtgcctggatcctctcggaagtcaaagaaacgggccttcaagactcagtgtaccmaggatggcagctggcaggagggagcttgtgttcctgtgacctgtgacccacatccctttggtattgatttcacagtcagctgctcaacggaatggcctct

SEQ ID NO: 13951 - DNA, 201 bp, Homo sapiens; identical to SEQ ID NO: 13917

SEQ ID NO: 13952 - DNA, 201 bp, Homo sapiens; identical to SEQ ID NO: 13918

SEQ ID NO: 13953 - DNA, 201 bp, Homo sapiens; identical to SEQ ID NO: 13920

SEQ ID NO: 13954 - DNA, 201 bp, Homo sapiens; identical to SEQ ID NO: 13919

SEQ ID NO: 13955 - DNA, 201 bp, Homo sapiens; identical to SEQ ID NO: 13881

SEQ ID NO: 13956 - DNA, 201 bp, Homo sapiens; identical to SEQ ID NO: 13883

SEQ ID NO: 13957 - DNA, 201 bp, Homo sapiens; identical to SEQ ID NO: 13875

SEQ ID NO: 13958 - DNA, 201 bp, Homo sapiens; identical to SEQ ID NO: 13876

SEQ ID NO: 13959 - DNA, 201 bp, Homo sapiens; identical to SEQ ID NO: 13877

SEQ ID NO: 13960 - DNA, 201 bp, Homo sapiens; identical to SEQ ID NO: 13878

SEQ ID NO: 13961 - DNA, 201 bp, Homo sapiens; identical to SEQ ID NO: 13879

SEQ ID NO: 13962 - DNA, 201 bp, Homo sapiens; identical to SEQ ID NO: 13893

SEQ ID NO: 13963 - DNA, 201 bp, Homo sapiens; identical to SEQ ID NO: 13880

SEQ ID NO: 13964 - DNA, 201 bp, Homo sapiens; identical to SEQ ID NO: 13895

SEQ ID NO: 13965 - DNA, 201 bp, Homo sapiens; identical to SEQ ID NO: 13896

SEQ ID NO: 13966 - DNA, 201 bp, Homo sapiens; identical to SEQ ID NO: 13886

SEQ ID NO: 13967 - DNA, 201 bp, Homo sapiens; identical to SEQ ID NO: 13898

SEQ ID NO: 13968 - DNA, 201 bp, Homo sapiens; identical to SEQ ID NO: 13899

SEQ ID NO: 13969 - DNA, 201 bp, Homo sapiens; identical to SEQ ID NO: 13900

SEQ ID NO: 13970 - DNA, 201 bp, Homo sapiens; identical to SEQ ID NO: 13901

SEQ ID NO: 13971 - DNA, 201 bp, Homo sapiens; identical to SEQ ID NO: 13902

SEQ ID NO: 13972 - DNA, 201 bp, Homo sapiens; identical to SEQ ID NO: 13938

SEQ ID NO: 13973 - DNA, 201 bp, Homo sapiens; identical to SEQ ID NO: 13885

SEQ ID NO: 13974 - DNA, 201 bp, Homo sapiens; identical to SEQ ID NO: 13887

SEQ ID NO: 13975 - DNA, 201 bp, Homo sapiens; identical to SEQ ID NO: 13873

SEQ ID NO: 13976 - DNA, 201 bp, Homo sapiens; identical to SEQ ID NO: 13906

SEQ ID NO: 13977 - DNA, 201 bp, Homo sapiens; identical to SEQ ID NO: 13907

SEQ ID NO: 13978 - DNA, 201 bp, Homo sapiens; identical to SEQ ID NO: 13908

SEQ ID NO: 13979 - DNA, 201 bp, Homo sapiens; identical to SEQ ID NO: 13882

SEQ ID NO: 13980 - DNA, 201 bp, Homo sapiens; identical to SEQ ID NO: 13910

SEQ ID NO: 13981 - DNA, 201 bp, Homo sapiens; identical to SEQ ID NO: 13911

SEQ ID NO: 13982 - DNA, 201 bp, Homo sapiens; identical to SEQ ID NO: 13884

SEQ ID NO: 13983 - DNA, 201 bp, Homo sapiens; identical to SEQ ID NO: 13913

SEQ ID NO: 13984 - DNA, 201 bp, Homo sapiens; identical to SEQ ID NO: 13914

SEQ ID NO: 13985 - DNA, 201 bp, Homo sapiens; identical to SEQ ID NO: 13874

SEQ ID NO: 13986 - DNA, 201 bp, Homo sapiens; identical to SEQ ID NO: 13916

SEQ ID NO: 13987 - DNA, 201 bp, Homo sapiens; identical to SEQ ID NO: 13917

SEQ ID NO: 13988 - DNA, 201 bp, Homo sapiens; identical to SEQ ID NO: 13918

SEQ ID NO: 13989 - DNA, 201 bp, Homo sapiens; identical to SEQ ID NO: 13919

SEQ ID NO: 13990 - DNA, 201 bp, Homo sapiens; identical to SEQ ID NO: 13920

SEQ ID NO: 13991 - DNA, 201 bp, Homo sapiens; identical to SEQ ID NO: 13881

SEQ ID NO: 13992 - DNA, 201 bp, Homo sapiens; identical to SEQ ID NO: 13883

SEQ ID NO: 13993 - DNA, 201 bp, Homo sapiens; identical to SEQ ID NO: 13923

SEQ ID NO: 13994 - DNA, 201 bp, Homo sapiens; identical to SEQ ID NO: 13895

SEQ ID NO: 13995 - DNA, 201 bp, Homo sapiens; identical to SEQ ID NO: 13887

SEQ ID NO: 13996 - DNA, 201 bp, Homo sapiens; identical to SEQ ID NO: 13893

SEQ ID NO: 13997 - DNA, 201 bp, Homo sapiens; identical to SEQ ID NO: 13906

SEQ ID NO: 13998 - DNA, 201 bp, Homo sapiens; identical to SEQ ID NO: 13884

SEQ ID NO: 13999 - DNA, 201 bp, Homo sapiens
tgtgacctacaaggtgactgtgcttgtcgggacccccaggcccaagaacacagccggaaagacctccggggatacagccatggctaaggaaggacaagaakttgtcaaagaattcccaacgccaggacccacatccctttggtattgatttcacagtcagctgctcaacggaatggcctctccacaccagggatccttagc

SEQ ID NO: 14000 - DNA, 201 bp, Homo sapiens; identical to SEQ ID NO: 13882

SEQ ID NO: 14001 - DNA, 201 bp, Homo sapiens; identical to SEQ ID NO: 13875

SEQ ID NO: 14002 - DNA, 201 bp, Homo sapiens
cgaagaaagtcgaggcgccgaggctcccaaagctggcagctccgggtggcggtgcaggggcgaaggggggggcggggggaacgtcggacatgcggctctgkagttgggtgctgcacctggggctgctgagcgccgcgctgggctgcgggctggccgagcgtccccgccgggcccggagagacccgcgggccggccgacccc

SEQ ID NO: 14003 - DNA, 201 bp, Homo sapiens
agaaagtcgaggcgccgaggctcccaaagctggcagctccgggtggcggtgcaggggcgaaggggggggcggggggaacgtcggacatgcggctctggagktgggtgctgcacctggggctgctgagcgccgcgctgggctgcgggctggccgagcgtccccgccgggcccggagagacccgcgggccggccgacccccgc

SEQ ID NO: 14004 - DNA, 201 bp, Homo sapiens; identical to SEQ ID NO: 13878

SEQ ID NO: 14005 - DNA, 201 bp, Homo sapiens; identical to SEQ ID NO: 13873

SEQ ID NO: 14006 - DNA, 201 bp, Homo sapiens; identical to SEQ ID NO: 13879

SEQ ID NO: 14007 - DNA, 201 bp, Homo sapiens; identical to SEQ ID NO: 13896

SEQ ID NO: 14008 - DNA, 201 bp, Homo sapiens; identical to SEQ ID NO: 13923

SEQ ID NO: 14009 - DNA, 201 bp, Homo sapiens
acggtggggattgctgcacctccacagtgaagaccaaaaaggtcaccccattccctatgtcctgtgacctacaaggtgactgtgcttgtcgggacccccasgcccaagaacacagccggaaagacctccggggatacagccatggctaaggaaggacaagaagttgtcaaagaattcccaacgccaggacccacatccctt

SEQ ID NO: 14010 - DNA, 201 bp, Homo sapiens; identical to SEQ ID NO: 13916

SEQ ID NO: 14011 - DNA, 201 bp, Homo sapiens; identical to SEQ ID NO: 13874

SEQ ID NO: 14012 - DNA, 201 bp, Homo sapiens; identical to SEQ ID NO: 13886

SEQ ID NO: 14013 - DNA, 201 bp, Homo sapiens; identical to SEQ ID NO: 13911

SEQ ID NO: 14014 - DNA, 201 bp, Homo sapiens
acgaagagaaatgatgcctgtagcatggcaaagtcggactacactcaaacttcaaggccagatgatctggatggagtccatgtggtgcatggtgtacctgygctctccgaagctccgcagcctgcaagagctggaagaactcaatatgcatctttctgacatcgccccccacgacaccaccagggatctcatcctcctgaa

SEQ ID NO: 14015 - DNA, 201 bp, Homo sapiens
cttctcttgcatcctggttattatgacgttctttgagctgggccgatagatccagctgaagagttctacatacattagtcttcaaggttcttctctgggcrtttcccatgcagctctctggtagctggggaatgatttgtaatgagtacatgaaacacgttaaatgtccttcagcctccctaccacgacatccaacagctg

SEQ ID NO: 14016 - DNA, 201 bp, Homo sapiens
agagaaatgatgcctgtagcatggcaaagtcggactacactcaaacttcaaggccagatgatctggatggagtccatgtggtgcatggtgtacctgtgctytccgaagctccgcagcctgcaagagctggaagaactcaatatgcatctttctgacatcgccccccacgacaccaccagggatctcatcctcctgaaccag

SEQ ID NO: 14017 - DNA, 201 bp, Homo sapiens
tgcacgattcttttcagcgatgtagtgacatttactaacatctgtactgcctgtgaacctatacaaatagtgaacgtgctgaattccatgtactccaagtktgacagattaaccagtgtgcacgcagtctataaagtagaaacaataggagatgcttatatggtggtaggaggtgtaccagtgcctattggaaaccatgct

SEQ ID NO: 14018 - DNA, 201 bp, Homo sapiens
ctggatgccctccacagttacctggcactctcttatcaggagatgaatgcaccatcgtttcgtgtggagagaggagcagatgggaaaatgtttctccattrctactcggatagaagtggtctgtgccacattgtaccaggtatcattgaggctgtggccaaagacttctttgatattgatgtaatcatggacattcttgac

SEQ ID NO: 14019 - DNA, 201 bp, Homo sapiens
gatggagtccatgtggtgcatggtgtacctgtgctctccgaagctccgcagcctgcaagagctggaagaactcaatatgcatctttctgacatcgcccccmacgacaccaccagggatctcatcctcctgaaccagcagcggctggctgagatagagctgtccaaccagctggaaaggaagaaggaggagctacaggtcct

SEQ ID NO: 14020 - DNA, 201 bp, Homo sapiens
aatagtgaacgtgctgaattccatgtactccaagtttgacagattaaccagtgtgcacgcagtctataaagtagaaacaataggagatgcttatatggtgrtaggaggtgtaccagtgcctattggaaaccatgctcaaagagtggctaattttgccttggggatgagaatttctgcaaaggaagtgacgaatcctgttac

SEQ ID NO: 14021 - DNA, 193 bp, Homo sapiens
gtctacagctcccagcgtgagcgacgcagaagacgggtgatttctgcatttccatctgaggtgactgaggacccaacagtgtgctccttgctyggaggctagtgatgagctcctaatttcactgtggactgcccagatttctacaagacaggcttctggagacgctgtggattctctcctgagtgactagggg

SEQ ID NO: 14022 - DNA, 201 bp, Homo sapiens
gcagatttatcaacagtcaatttgtcctgaagacacgaagagaaatgatgcctgtagcatggcaaagtcggactacactcaaacttcaaggccagatgatytggatggagtccatgtggtgcatggtgtacctgtgctctccgaagctccgcagcctgcaagagctggaagaactcaatatgcatctttctgacatcgccc

SEQ ID NO: 14023 - DNA, 201 bp, Homo sapiens
ctcacggttttttgcagaagcaagtgctcagggaaatgaagacaggagaactgctgccgtcatgagctatgccgacagtcagcagctgatccccgacagaracgcagcagatgcagacgctcctgatgaaatcatccctgtggggagtgcagggccagatggggactccatggagacagccgaccggcgacagccttcagc

SEQ ID NO: 14024 - DNA, 200 bp, Homo sapiens
gtctacagctcccagcgtgagcgacgcagaagacgggtgatttctgcatttccatctgaggtgactgaggacccaacagtgtgctccttgcttggaggcyagtgatgagctcctaatttcactgtggactgcccagatttctacaagacaggcttctggagacgctgtggattctctcctgagtgactaggggctggcag

SEQ ID NO: 14025 - DNA, 201 bp, Homo sapiens
tcattgagaggggtgaaattgaagtgaaaggtaaagggagaatgaccacatactttttgatccagaacttgaatgccacagaggatgagatcatggggagrtctaaaaccccagttgatcacaaggggtcaacacagaaagcatccttgcccaccaccaagctccagggctcagttcaaccatcttgccctgaacactctt

SEQ ID NO: 14026 - DNA, 201 bp, Homo sapiens
ggacagggaagaaggagcatgttgtgtttctgattgtacagaaggctcacaggaagatgagaaagacaaagccaaaaaggttacaagacagtcagggcatsgagagagaccaagaggccctccaggcagctttcctcaagatgaaggagaaatatttgaatgtctctgcttgtcctgtgaaaaaatcccactgggatgttg

SEQ ID NO: 14027 - DNA, 201 bp, Homo sapiens
atccttgcccaccaccaagctccagggctcagttcaaccatcttgccctgaacactcttctcttgcatcctggttattatgacgttctttgagctgggccratagatccagctgaagagttctacatacattagtcttcaaggttcttctctgggcgtttcccatgcagctctctggtagctggggaatgatttgtaatga

SEQ ID NO: 14028 - DNA, 201 bp, Homo sapiens
aaggtaaagggagaatgaccacatactttttgatccagaacttgaatgccacagaggatgagatcatggggagatctaaaaccccagttgatcacaagggktcaacacagaaagcatccttgcccaccaccaagctccagggctcagttcaaccatcttgccctgaacactcttctcttgcatcctggttattatgacgtt

SEQ ID NO: 14029 - DNA, 201 bp, Homo sapiens
aggagatgaatgcaccatcgtttcgtgtggagagaggagcagatgggaaaatgtttctccattgctactcggatagaagtggtctgtgccacattgtaccrggtatcattgaggctgtggccaaagacttctttgatattgatgtaatcatggacattcttgacatgaatgaagaagtggagaggacagggaagaaggagc

SEQ ID NO: 14030 - DNA, 201 bp, Homo sapiens
attcttgacatgaatgaagaagtggagaggacagggaagaaggagcatgttgtgtttctgattgtacagaaggctcacaggaagatgagaaagacaaagcyaaaaaggttacaagacagtcagggcatggagagagaccaagaggccctccaggcagctttcctcaagatgaaggagaaatatttgaatgtctctgcttgt

SEQ ID NO: 14031 - DNA, 201 bp, Homo sapiens; identical to SEQ ID NO: 14014

SEQ ID NO: 14032 - DNA, 201 bp, Homo sapiens; identical to SEQ ID NO: 14015

SEQ ID NO: 14033 - DNA, 201 bp, Homo sapiens; identical to SEQ ID NO: 14016

SEQ ID NO: 14034 - DNA, 201 bp, Homo sapiens; identical to SEQ ID NO: 14017

SEQ ID NO: 14035 - DNA, 201 bp, Homo sapiens; identical to SEQ ID NO: 14018

SEQ ID NO: 14036 - DNA, 201 bp, Homo sapiens; identical to SEQ ID NO: 14019

SEQ ID NO: 14037 - DNA, 201 bp, Homo sapiens; identical to SEQ ID NO: 14020

SEQ ID NO: 14038 - DNA, 133 bp, Homo sapiens
gtgactgaggacccaacagtgtgctccttgctyggaggctagtgatgagctcctaatttcactgtggactgcccagatttctacaagacaggcttctggagacgctgtggattctctcctgagtgactagggg

SEQ ID NO: 14039 - DNA, 201 bp, Homo sapiens; identical to SEQ ID NO: 14022

SEQ ID NO: 14040 - DNA, 201 bp, Homo sapiens; identical to SEQ ID NO: 14023

SEQ ID NO: 14041 - DNA, 140 bp, Homo sapiens
gtgactgaggacccaacagtgtgctccttgcttggaggcyagtgatgagctcctaatttcactgtggactgcccagatttctacaagacaggcttctggagacgctgtggattctctcctgagtgactaggggctggcag

SEQ ID NO: 14042 - DNA, 201 bp, Homo sapiens; identical to SEQ ID NO: 14025

SEQ ID NO: 14043 - DNA, 201 bp, Homo sapiens; identical to SEQ ID NO: 14026

SEQ ID NO: 14044 - DNA, 201 bp, Homo sapiens; identical to SEQ ID NO: 14027

SEQ ID NO: 14045 - DNA, 201 bp, Homo sapiens; identical to SEQ ID NO: 14028

SEQ ID NO: 14046 - DNA, 201 bp, Homo sapiens; identical to SEQ ID NO: 14029

SEQ ID NO: 14047 - DNA, 201 bp, Homo sapiens; identical to SEQ ID NO: 14030

SEQ ID NO: 14048 - DNA, 201 bp, Homo sapiens
ggatgtcagtgcacggttagtgtttgagcagagggcagacttgtaaagtacctgtagtgaaaagaatgtggggacccgattagcagaaaggtgtttgcacrtactttatacaaaatacagaatactttatattggaagtgaaagaaatgaacgtggacttttacacatgtgcatatttttctggaggctatatggattatt

SEQ ID NO: 14049 - DNA, 191 bp, Homo sapiens
tggattcaaacctatgaaaattcctcaacttaagagtatttggacagatagcacagaagtcgtggcttttagaccttagcttttccctacyggctttctgtttgcattaagctagtatttgacacttgatgtctagggattcttacctcctttggccaatggtacttcacacccatatgctagtcctttta

SEQ ID NO: 14050 - DNA, 201 bp, Homo sapiens
atgggttgagtgtgtcagtatgtggttggttactgtgtattcgccaggaatcaccccgataggctgccaccctattaggtgatacctgtttaatatgttgyccaggtagactagtagttgcatcagtttgctgtaacaagtaaccagtgaggtaacacagtggtgaagcaggtcaggggaggtcaggaggatgtctgagag

SEQ ID NO: 14051 - DNA, 201 bp, Homo sapiens
atgaaaattcctcaacttaagagtatttggacagatagcacagaagtcgtggcttttagaccttagcttttccctaccggctttctgtttgcattaagctrgtatttgacacttgatgtctagggattcttacctcctttggccaatggtacttcacacccatatgctagtccttttatgctaaatgtgggttttcctgtt

SEQ ID NO: 14052 - DNA, 201 bp, Homo sapiens
ataaagttgcagaaatttggtgtacataaaactgtctccatataattgattattaggatatattcccatgaaggattctttttttaaaaaaatgtgaaatrtcatcttgtacttacacctttcatgcaaagggatttcctgcttttgtactgcatgggtggcagttgtgaggaaaagccagtcaaatgacctttttacaaa

SEQ ID NO: 14053 - DNA, 201 bp, Homo sapiens
taaaactgtctccatataattgattattaggatatattcccatgaaggattctttttttaaaaaaatgtgaaatatcatcttgtacttacacctttcatgmaaagggatttcctgcttttgtactgcatgggtggcagttgtgaggaaaagccagtcaaatgacctttttacaaaagaaatgcagtggtcacttcagttga

SEQ ID NO: 14054 - DNA, 201 bp, Homo sapiens
attacctaatggctaatctggctgctgcagacttctttgctgggttggcctacttctatctcatgttcaacacaggacccaatactcggagactgactgtyagcacatggctccttcgtcagggcctcattgacaccagcctgacggcatctgtggccaacttactggctattgcaatcgagaggcacattacggttttcc

SEQ ID NO: 14055 - DNA, 201 bp, Homo sapiens
tatttaaaatacccaagtacattctaattaccagtatatcagaggaaaattttcgtagtctttgtaaaataatatactcatcatagaaaacttgaaaaatrcagaaatgtataaaaaagcaaaaatgattactgataatatcacaacccagaagtaaccacctttaaaaagcaacccccatgtatgcctatatgtgtattg

SEQ ID NO: 14056 - DNA, 201 bp, Homo sapiens
cttcctccctcaaccacaccatcttggctggagttcacagcaatgaccactctgtggtttagaacggaaactgagatgaggaaccagccgtcctctcttgkaggataaacagcctccccctacccaattgccagggcaaggtggggtgtgagagaggagaaaagtcaactcatgtacttaaacactaaccaatgacagtat

SEQ ID NO: 14057 - DNA, 201 bp, Homo sapiens
gtatttgttcctggaccccacaagacttgatatatattgaaaattagcttatgtgacaaccctcatcttgatccccatcccttctgaaagtaggaagttgsagctcttgcaatggaattcaagaacagactctggagtgtccatttagactacactaactagacttttaaaagattttgtgtggtttggtgcaagtcagaa

SEQ ID NO: 14058 - DNA, 201 bp, Homo sapiens
atctggctgctgcagacttctttgctgggttggcctacttctatctcatgttcaacacaggacccaatactcggagactgactgttagcacatggctcctkcgtcagggcctcattgacaccagcctgacggcatctgtggccaacttactggctattgcaatcgagaggcacattacggttttccgcatgcagctccaca

SEQ ID NO: 14059 - DNA, 201 bp, Homo sapiens
acgtgtgctgtccacagtgcgacgtgctggcctatgagaaattcttccttctccttgctgaattcaactctgccatgaaccccatcatttactcctaccgygacaaagaaatgagcgccacctttaggcagatcctctgctgccagcgcagtgagaaccccaccggccccacagaaggctcagaccgctcggcttcctccc

SEQ ID NO: 14060 - DNA, 201 bp, Homo sapiens
cctacaaccacagagctgtcatggctgccatctctacttccatccctgtaatttcacagccccagttcacagccatgaatgaaccacagtgcttctacaaygagtccattgccttcttttataaccgaagtggaaagcatcttgccacagaatggaacacagtcagcaagctggtgatgggacttggaatcactgtttgta

SEQ ID NO: 14061 - DNA, 201 bp, Homo sapiens
agtgcgacgtgctggcctatgagaaattcttccttctccttgctgaattcaactctgccatgaaccccatcatttactcctaccgcgacaaagaaatgagygccacctttaggcagatcctctgctgccagcgcagtgagaaccccaccggccccacagaaggctcagaccgctcggcttcctccctcaaccacaccatct

SEQ ID NO: 14062 - DNA, 201 bp, Homo sapiens
gaaccccatcatttactcctaccgcgacaaagaaatgagcgccacctttaggcagatcctctgctgccagcgcagtgagaaccccaccggccccacagaargctcagaccgctcggcttcctccctcaaccacaccatcttggctggagttcacagcaatgaccactctgtggtttagaacggaaactgagatgaggaacc

SEQ ID NO: 14063 - DNA, 201 bp, Homo sapiens; identical to SEQ ID NO: 14048

SEQ ID NO: 14064 - DNA, 201 bp, Homo sapiens; identical to SEQ ID NO: 14050

SEQ ID NO: 14065 - DNA, 201 bp, Homo sapiens; identical to SEQ ID NO: 14054

SEQ ID NO: 14066 - DNA, 201 bp, Homo sapiens; identical to SEQ ID NO: 14053

SEQ ID NO: 14067 - DNA, 201 bp, Homo sapiens; identical to SEQ ID NO: 14052

SEQ ID NO: 14068 - DNA, 201 bp, Homo sapiens; identical to SEQ ID NO: 14055

SEQ ID NO: 14069 - DNA, 201 bp, Homo sapiens; identical to SEQ ID NO: 14056

SEQ ID NO: 14070 - DNA, 201 bp, Homo sapiens; identical to SEQ ID NO: 14057

SEQ ID NO: 14071 - DNA, 201 bp, Homo sapiens; identical to SEQ ID NO: 14058

SEQ ID NO: 14072 - DNA, 201 bp, Homo sapiens; identical to SEQ ID NO: 14059

SEQ ID NO: 14073 - DNA, 201 bp, Homo sapiens; identical to SEQ ID NO: 14060

SEQ ID NO: 14074 - DNA, 201 bp, Homo sapiens; identical to SEQ ID NO: 14061

SEQ ID NO: 14075 - DNA, 201 bp, Homo sapiens; identical to SEQ ID NO: 14062

SEQ ID NO: 14076 - DNA, 201 bp, Homo sapiens; identical to SEQ ID NO: 14048

SEQ ID NO: 14077 - DNA, 201 bp, Homo sapiens; identical to SEQ ID NO: 14050

SEQ ID NO: 14078 - DNA, 201 bp, Homo sapiens; identical to SEQ ID NO: 14054

SEQ ID NO: 14079 - DNA, 201 bp, Homo sapiens; identical to SEQ ID NO: 14053

SEQ ID NO: 14080 - DNA, 201 bp, Homo sapiens; identical to SEQ ID NO: 14052

SEQ ID NO: 14081 - DNA, 201 bp, Homo sapiens; identical to SEQ ID NO: 14055

SEQ ID NO: 14082 - DNA, 201 bp, Homo sapiens; identical to SEQ ID NO: 14056

SEQ ID NO: 14083 - DNA, 201 bp, Homo sapiens; identical to SEQ ID NO: 14057

SEQ ID NO: 14084 - DNA, 201 bp, Homo sapiens; identical to SEQ ID NO: 14058

SEQ ID NO: 14085 - DNA, 201 bp, Homo sapiens; identical to SEQ ID NO: 14059

SEQ ID NO: 14086 - DNA, 201 bp, Homo sapiens; identical to SEQ ID NO: 14060

SEQ ID NO: 14087 - DNA, 201 bp, Homo sapiens; identical to SEQ ID NO: 14061

SEQ ID NO: 14088 - DNA, 201 bp, Homo sapiens; identical to SEQ ID NO: 14062

SEQ ID NO: 14089 - DNA, 201 bp, Homo sapiens; identical to SEQ ID NO: 14050

SEQ ID NO: 14090 - DNA, 201 bp, Homo sapiens; identical to SEQ ID NO: 14054

SEQ ID NO: 14091 - DNA, 201 bp, Homo sapiens; identical to SEQ ID NO: 14053

SEQ ID NO: 14092 - DNA, 201 bp, Homo sapiens; identical to SEQ ID NO: 14052

SEQ ID NO: 14093 - DNA, 201 bp, Homo sapiens; identical to SEQ ID NO: 14055

SEQ ID NO: 14094 - DNA, 201 bp, Homo sapiens; identical to SEQ ID NO: 14056

SEQ ID NO: 14095 - DNA, 201 bp, Homo sapiens; identical to SEQ ID NO: 14057

SEQ ID NO: 14096 - DNA, 201 bp, Homo sapiens; identical to SEQ ID NO: 14058

SEQ ID NO: 14097 - DNA, 201 bp, Homo sapiens; identical to SEQ ID NO: 14059

SEQ ID NO: 14098 - DNA, 201 bp, Homo sapiens; identical to SEQ ID NO: 14060

SEQ ID NO: 14099 - DNA, 201 bp, Homo sapiens; identical to SEQ ID NO: 14061

SEQ ID NO: 14100 - DNA, 201 bp, Homo sapiens; identical to SEQ ID NO: 14062

SEQ ID NO: 14101 - DNA, 201 bp, Homo sapiens; identical to SEQ ID NO: 14048

SEQ ID NO: 14102 - DNA, 201 bp, Homo sapiens; identical to SEQ ID NO: 14050

SEQ ID NO: 14103 - DNA, 201 bp, Homo sapiens; identical to SEQ ID NO: 14054

SEQ ID NO: 14104 - DNA, 201 bp, Homo sapiens; identical to SEQ ID NO: 14053

SEQ ID NO: 14105 - DNA, 201 bp, Homo sapiens; identical to SEQ ID NO: 14052

SEQ ID NO: 14106 - DNA, 201 bp, Homo sapiens; identical to SEQ ID NO: 14055

SEQ ID NO: 14107 - DNA, 201 bp, Homo sapiens; identical to SEQ ID NO: 14056

SEQ ID NO: 14108 - DNA, 201 bp, Homo sapiens; identical to SEQ ID NO: 14057

SEQ ID NO: 14109 - DNA, 201 bp, Homo sapiens; identical to SEQ ID NO: 14058

SEQ ID NO: 14110 - DNA, 201 bp, Homo sapiens; identical to SEQ ID NO: 14059

SEQ ID NO: 14111 - DNA, 201 bp, Homo sapiens; identical to SEQ ID NO: 14060

SEQ ID NO: 14112 - DNA, 201 bp, Homo sapiens; identical to SEQ ID NO: 14061

SEQ ID NO: 14113 - DNA, 201 bp, Homo sapiens; identical to SEQ ID NO: 14062

SEQ ID NO: 14114 - DNA, 201 bp, Homo sapiens
gaaatgaggtgtagggaattttgcctgccttcctgcagacctgagctggctttggaatgaggttaaagtgtcagggacgttgcctgagcccaaatgtgtaktgtggtctgggcaggcagacctttaggttttgctgcttagtcctgaggaagtggccactcttgtggcaggtgtagtatctggggcgagtgttgggggtaa

SEQ ID NO: 14115 - DNA, 201 bp, Homo sapiens
ctgggcaggcagacctttaggttttgctgcttagtcctgaggaagtggccactcttgtggcaggtgtagtatctggggcgagtgttgggggtaaaagcccmccctacagaaagtggaacagcccggagcctgatgtgaaaggaccacgggtgttgtaagctgggacacggaagccaaactggaatcaaacgccgactgtaa

SEQ ID NO: 14116 - DNA, 201 bp, Homo sapiens
aaactggctagcctgagctgctggttcactcttcagcatttatgaaacaaggctaggggaagatgggcagagaaaaaggggacacctagtttggttgtcayttggcaaaggagatgacttaaaatccgcttaatctcttccagtgtccgtgttaatgtatttggctattagatcactagcactgctttaccgctcctcatc

SEQ ID NO: 14117 - DNA, 201 bp, Homo sapiens
tgctgcttagtcctgaggaagtggccactcttgtggcaggtgtagtatctggggcgagtgttgggggtaaaagcccaccctacagaaagtggaacagcccrgagcctgatgtgaaaggaccacgggtgttgtaagctgggacacggaagccaaactggaatcaaacgccgactgtaaattgtatcttataacttattaaat

SEQ ID NO: 14118 - DNA, 199 bp, Homo sapiens
tggccactcttgtggcaggtgtagtatctggggcgagtgttgggggtaaaagcccaccctacagaaagtggaacagcccggagcctgatgtgaaaggaccmcgggtgttgtaagctgggacacggaagccaaactggaatcaaacgccgactgtaaattgtatcttataacttattaaataaaacatttgctccgtaaa

SEQ ID NO: 14119 - DNA, 201 bp, Homo sapiens
caggtctcgagcacgggaaggtgggtgaagctggcctccttagcgtcgactgctcggaagcgggaccgggggccctgggcctggaagctgtctcggactcrggaacaaaagccgaagtcagtattcagaacaacaaagatggcacctacgcggtgacctacgtgcccctgacggccggcatgtacacgttgaccatgaagt

SEQ ID NO: 14120 - DNA, 201 bp, Homo sapiens
atgaggttaaagtgtcagggacgttgcctgagcccaaatgtgtagtgtggtctgggcaggcagacctttaggttttgctgcttagtcctgaggaagtggcyactcttgtggcaggtgtagtatctggggcgagtgttgggggtaaaagcccaccctacagaaagtggaacagcccggagcctgatgtgaaaggaccacggg

SEQ ID NO: 14121 - DNA, 201 bp, Homo sapiens
caggagaaggtggtctggacttggctattgagggcccctcaaaagcagaaatcagctgcattgacaataaagatgggacatgcacagtgacctacctgccractctgccaggcgactacagcattctggtcaagtacaatgacaagcacatccctggcagccccttcacagccaagatcacagatgacagcaggcggtgct

SEQ ID NO: 14122 - DNA, 201 bp, Homo sapiens
cccagccaacttcatgggtcactttttctggaaaataatgatctgtacagacaggacagaatgaaactcctgcgggtctttggcctgaaagttgggaatgrttgggggagagaagggcagcagcttattggtggtcttttcaccattggcagaaacagtgagagctgtgtggtgcagaaatccagaaatgaggtgtaggga

SEQ ID NO: 14123 - DNA, 201 bp, Homo sapiens
gaacatctggtcagcatcaagaaaaatggcaaccatgtggccaacagccccgtgtctatcatggtggtccagtcggagattggtgacgcccgccgagccaragtctatggccgcggcctgtcagaaggccggactttcgagatgtctgacttcatcgtggacacaagggatgcaggttatggtggcatatccttggcggtg

SEQ ID NO: 14124 - DNA, 201 bp, Homo sapiens
ctcaggcaaagattgagtacaacgaccagaatgatggatcgtgtgatgtcaaatactggcccaaggagcctggcgaatatgctgttcacatcatgtgtgaygacgaagacatcaaggacagcccgtacatggccttcatccacccagccacgggaggctacaaccctgatctggttcgagcatacgggccaggtttggaga

SEQ ID NO: 14125 - DNA, 201 bp, Homo sapiens
agtggccgaggcctacaacccaaaggcgtccgtatccgggagaccacagatttcaaggttgacaccaaagctgcaggaagtggggagctcggtgtaaccaygaagggtcctaagggtctggaggagctggtgaagcagaaagactttctggatggggtctacgcattcgagtattaccccagcaccccggggagatacagc

SEQ ID NO: 14126 - DNA, 201 bp, Homo sapiens
aaatactggcccaaggagcctggcgaatatgctgttcacatcatgtgtgacgacgaagacatcaaggacagcccgtacatggccttcatccacccagccaygggaggctacaaccctgatctggttcgagcatacgggccaggtttggagaaatctggatgcattgtcaacaacctggccgagttcactgtggatcctaag

SEQ ID NO: 14127 - DNA, 201 bp, Homo sapiens
ctctcggaaggtcgtgccatgcctagtgacacctgtgacaggccgggagaacagcacggccaagttcatccctcgggaggaggggctgtatgctgtagacrtgacctacgatggacaccctgtgcccgggagcccctacacagtggaggcctcgctgccaccagatcccagcaaggtgaaggcccacggtcccggcctcga

SEQ ID NO: 14128 - DNA, 201 bp, Homo sapiens
ccctgtgcccgggagcccctacacagtggaggcctcgctgccaccagatcccagcaaggtgaaggcccacggtcccggcctcgaaggtggtctcgtgggcmagcctgccgagttcaccatcgataccaaaggagctggtactggaggtctgggcttaacggtggaaggtccgtgcgaggccaaaatcgagtgctccgacaa

SEQ ID NO: 14129 - DNA, 201 bp, Homo sapiens
tcatcgcgctgctcgaggtgctcagccagaagcgcatgtaccgcaagtaccatcagcggcccacctttcgccagatgcagctcgagaatgtgtccgtggcrctcgagttcctggaccgtgagagcatcaagctcgtgtccatcgatagcaaagccattgtggatgggaacctgaagctcatcttgggtctggtgtggacgc

SEQ ID NO: 14130 - DNA, 201 bp, Homo sapiens
gccgtggctccggtagcagcaagttcgaaccccgctcccgctccgcttcggttctcgctccttcggcccttgggcctccaaacaccagtccccggcagctygttgcgcattgcgctctccccgccaccaggatgccggtaaccgagaaggatctagctgaggacgcgccttggaagaagatccagcagaacacgttcacac

SEQ ID NO: 14131 - DNA, 201 bp, Homo sapiens
tggacaccctgtgcccgggagcccctacacagtggaggcctcgctgccaccagatcccagcaaggtgaaggcccacggtcccggcctcgaaggtggtctcrtgggcaagcctgccgagttcaccatcgataccaaaggagctggtactggaggtctgggcttaacggtggaaggtccgtgcgaggccaaaatcgagtgctc

SEQ ID NO: 14132 - DNA, 201 bp, Homo sapiens
caaagctgacattgaaatgccctttgacccctctaaagtcgtggcatcggggccaggtctcgagcacgggaaggtgggtgaagctggcctccttagcgtcractgctcggaagcgggaccgggggccctgggcctggaagctgtctcggactcgggaacaaaagccgaagtcagtattcagaacaacaaagatggcaccta

SEQ ID NO: 14133 - DNA, 201 bp, Homo sapiens
cgggaaggtgggtgaagctggcctccttagcgtcgactgctcggaagcgggaccgggggccctgggcctggaagctgtctcggactcgggaacaaaagccraagtcagtattcagaacaacaaagatggcacctacgcggtgacctacgtgcccctgacggccggcatgtacacgttgaccatgaagtatggtggcgaact

SEQ ID NO: 14134 - DNA, 201 bp, Homo sapiens
gaccgtgagagcatcaagctcgtgtccatcgatagcaaagccattgtggatgggaacctgaagctcatcttgggtctggtgtggacgctgatcctccactwctccatctccatgcccgtgtgggaggatgaaggggatgatgatgccaagaagcagacgccaaagcagaggctgctggggtggattcagaacaagatcccc

SEQ ID NO: 14135 - DNA, 201 bp, Homo sapiens
gttgactctcggccgctgacccaggttgggggtgaccacatcaaggcccacattgccaacccctcaggggcctccaccgagtgctttgtcacagacaatgyggatgggacctaccaggtggaatacacaccctttgagaaaggtctccatgtagtggaggtgacatatgatgacgtgcctatcccaaacagtcccttcaag

SEQ ID NO: 14136 - DNA, 201 bp, Homo sapiens
tgggcaagcctgccgagttcaccatcgataccaaaggagctggtactggaggtctgggcttaacggtggaaggtccgtgcgaggccaaaatcgagtgctcygacaatggtgatgggacctgctccgtctcttaccttcccacaaaacccggggagtacttcgtcaacatcctctttgaagaagtccacatacctgggtctc

SEQ ID NO: 14137 - DNA, 201 bp, Homo sapiens
ttggtgggcttggcataactgttgagggaccatcagagtcgaagataaattgcagagacaacaaggatggcagctgcagtgctgagtacattcctttcgcrccgggggattacgatgttaatatcacatatggaggagcccacatccccggcagccccttcagggttcctgtgaaggatgttgtggaccccagcaaggtca

SEQ ID NO: 14138 - DNA, 201 bp, Homo sapiens
agatcactagcactgctttaccgctcctcatcgccaacacccccatgctctgtggccttcttacacttctcagagggcagagtggcagccgggcaccctasagaaactcagagggcagagtggcagccaggcccacatgtctctcaagtacctgtcccctcgctctggtgattatttcttgcagaatcaccacacgagacc

SEQ ID NO: 14139 - DNA, 201 bp, Homo sapiens
cttctcagagggcagagtggcagccgggcaccctacagaaactcagagggcagagtggcagccaggcccacatgtctctcaagtacctgtcccctcgctcyggtgattatttcttgcagaatcaccacacgagaccatcccggcagtcatggttttgctttagttttccaagtccgtttcagtcccttccttggtctgaag

SEQ ID NO: 14140 - DNA, 201 bp, Homo sapiens
ccatgacataacactccacacccgccccagccaacttcatgggtcactttttctggaaaataatgatctgtacagacaggacagaatgaaactcctgcggstctttggcctgaaagttgggaatggttgggggagagaagggcagcagcttattggtggtcttttcaccattggcagaaacagtgagagctgtgtggtgca

SEQ ID NO: 14141 - DNA, 201 bp, Homo sapiens
agccaacttcatgggtcactttttctggaaaataatgatctgtacagacaggacagaatgaaactcctgcgggtctttggcctgaaagttgggaatggttkggggagagaagggcagcagcttattggtggtcttttcaccattggcagaaacagtgagagctgtgtggtgcagaaatccagaaatgaggtgtagggaatt

SEQ ID NO: 14142 - DNA, 201 bp, Homo sapiens
ccttcaaagtgcgcgttggggagcctggacaagcggggaaccctgccctggtgtccgcctatggcacgggactcgaagggggcaccacaggtatccagtcrgaattctttattaacaccacccgagcaggtccagggacattatccgtcaccatcgaaggcccatccaaggttaaaatggattgccaggaaacacctgaag

SEQ ID NO: 14143 - DNA, 201 bp, Homo sapiens
tcctgcgggtctttggcctgaaagttgggaatggttgggggagagaagggcagcagcttattggtggtcttttcaccattggcagaaacagtgagagctgygtggtgcagaaatccagaaatgaggtgtagggaattttgcctgccttcctgcagacctgagctggctttggaatgaggttaaagtgtcagggacgttgcc

SEQ ID NO: 14144 - DNA, 201 bp, Homo sapiens
attggcagaaacagtgagagctgtgtggtgcagaaatccagaaatgaggtgtagggaattttgcctgccttcctgcagacctgagctggctttggaatgargttaaagtgtcagggacgttgcctgagcccaaatgtgtagtgtggtctgggcaggcagacctttaggttttgctgcttagtcctgaggaagtggccactc

SEQ ID NO: 14145 - DNA, 201 bp, Homo sapiens
agctgtgtggtgcagaaatccagaaatgaggtgtagggaattttgcctgccttcctgcagacctgagctggctttggaatgaggttaaagtgtcagggacrttgcctgagcccaaatgtgtagtgtggtctgggcaggcagacctttaggttttgctgcttagtcctgaggaagtggccactcttgtggcaggtgtagtat

SEQ ID NO: 14146 - DNA, 201 bp, Homo sapiens
tgacttacctgtcccagttccccaaagccaagctcaagccgggggctcctctcaaacccaaactcaacccgaagaaagccagggcctatggcagaggaatygagcccactggaaacatggtgaagcagccagccaagttcactgtggacaccatcagcgccgggcaaggagacgtgatggtgtttgttgaggacccagaag

SEQ ID NO: 14147 - DNA, 201 bp, Homo sapiens
cattattcacaatgccaatgatacgttcacagtcaaatatgtgcctcctgctgctgggcgatacactatcaaagttctctttgcatctcaggaaatccccrccagccctttcagagtcaaagttgacccttcccacgatgccagcaaagtgaaggcagaaggcccagggctcagcaaagcaggtgtggaaaatgggaaacc

SEQ ID NO: 14148 - DNA, 201 bp, Homo sapiens
attgcagagacaacaaggatggcagctgcagtgctgagtacattcctttcgcgccgggggattacgatgttaatatcacatatggaggagcccacatcccyggcagccccttcagggttcctgtgaaggatgttgtggaccccagcaaggtcaagattgccggccccgggctgggctcaggcgtccgagcccgtgtcctgc

SEQ ID NO: 14149 - DNA, 201 bp, Homo sapiens
ccaccaaattcgctgacgagcacgtgcctgaaatcaacagcagtgatatgtcggcccacgtcaccagcccctctggccgtgtgactgaggcagagattgtrcccatggggaagaactcacactgcgtccggtttgtgccccaggagatgggcgtgcacacggtcagcgtcaagtaccgtgggcagcacgtcaccggcagcc

SEQ ID NO: 14150 - DNA, 201 bp, Homo sapiens
aaggtgcgggcaggaggccctggcctggagagaggagaagcgggagtcccagctgagttcagcatttggacccgggaagcaggcgctggaggcctctccaycgctgttgagggccccagtaaggccgagattacattcgatgaccataaaaatgggtcgtgcggtgtatcttatattgcccaagagcctggtaactacgag

SEQ ID NO: 14151 - DNA, 201 bp, Homo sapiens
gtcccggcctcgaaggtggtctcgtgggcaagcctgccgagttcaccatcgataccaaaggagctggtactggaggtctgggcttaacggtggaaggtccrtgcgaggccaaaatcgagtgctccgacaatggtgatgggacctgctccgtctcttaccttcccacaaaacccggggagtacttcgtcaacatcctctttg

SEQ ID NO: 14152 - DNA, 201 bp, Homo sapiens
gaggctgctggggtggattcagaacaagatcccctacttgcccatcaccaactttaaccagaactggcaagacggcaaagccctgggagccctggtagacrgctgtgctccaggtctgtgcccagactgggaatcctgggacccgcagaagcctgtggataatgcacgagaagccatgcagcaggcagatgactggctggg

SEQ ID NO: 14153 - DNA, 201 bp, Homo sapiens
tagtggaggtgacatatgatgacgtgcctatcccaaacagtcccttcaaggtggctgtcactgaaggctgccagccatctagggtgcaagcccaaggacckggattgaaagaggcctttaccaacaagcccaatgtcttcaccgtggttaccagaggcgcaggaattggtgggcttggcataactgttgagggaccatcag

SEQ ID NO: 14154 - DNA, 201 bp, Homo sapiens
agctggagccagataagtatgctgttcgcttcatccctcatgagaatggtgtccacaccatcgatgtcaagttcaatgggagccacgtggttggaagcccyttcaaagtgcgcgttggggagcctggacaagcggggaaccctgccctggtgtccgcctatggcacgggactcgaagggggcaccacaggtatccagtcgg

SEQ ID NO: 14155 - DNA, 201 bp, Homo sapiens
agttcactgtggacaccatcagcgccgggcaaggagacgtgatggtgtttgttgaggacccagaagggaacaaagaggaggcacaagtgacccctgacagygacaagaacaagacatactctgtggagtatctgcccaaggtcaccgggctacacaaagtcacagtcctctttgcaggacagcacatctccaagagcccat

SEQ ID NO: 14156 - DNA, 201 bp, Homo sapiens
gacgcccgccgcctcactgttatgagccttcaggaatcgggattaaaagttaaccagccagcatcctttgctataaggttgaatggcgcaaaaggcaagaytgatgcaaaggtgcacagcccctctggagccgtggaggagtgccacgtgtctgagctggagccagataagtatgctgttcgcttcatccctcatgagaat

SEQ ID NO: 14157 - DNA, 201 bp, Homo sapiens
ccagaagcgcatgtaccgcaagtaccatcagcggcccacctttcgccagatgcagctcgagaatgtgtccgtggcgctcgagttcctggaccgtgagagcrtcaagctcgtgtccatcgatagcaaagccattgtggatgggaacctgaagctcatcttgggtctggtgtggacgctgatcctccactactccatctccat

SEQ ID NO: 14158 - DNA, 201 bp, Homo sapiens
ccatcgaaggcccatccaaggttaaaatggattgccaggaaacacctgaagggtacaaagtcatgtacacccccatggctcctggtaactacctgatcagygtcaaatacggtgggcccaaccacatcgtgggcagtcccttcaaggccaaggtgacaggccagcgtctagttagccctggctcagccaacgaggctctca

SEQ ID NO: 14159 - DNA, 201 bp, Homo sapiens; identical to SEQ ID NO: 14114

SEQ ID NO: 14160 - DNA, 201 bp, Homo sapiens; identical to SEQ ID NO: 14115

SEQ ID NO: 14161 - DNA, 201 bp, Homo sapiens; identical to SEQ ID NO: 14116

SEQ ID NO: 14162 - DNA, 201 bp, Homo sapiens; identical to SEQ ID NO: 14117

SEQ ID NO: 14163 - DNA, 199 bp, Homo sapiens; identical to SEQ ID NO: 14118

SEQ ID NO: 14164 - DNA, 201 bp, Homo sapiens; identical to SEQ ID NO: 14119

SEQ ID NO: 14165 - DNA, 201 bp, Homo sapiens; identical to SEQ ID NO: 14120

SEQ ID NO: 14166 - DNA, 201 bp, Homo sapiens; identical to SEQ ID NO: 14121

SEQ ID NO: 14167 - DNA, 201 bp, Homo sapiens; identical to SEQ ID NO: 14122

SEQ ID NO: 14168 - DNA, 201 bp, Homo sapiens; identical to SEQ ID NO: 14123

SEQ ID NO: 14169 - DNA, 201 bp, Homo sapiens; identical to SEQ ID NO: 14124

SEQ ID NO: 14170 - DNA, 201 bp, Homo sapiens; identical to SEQ ID NO: 14125

SEQ ID NO: 14171 - DNA, 201 bp, Homo sapiens; identical to SEQ ID NO: 14126

SEQ ID NO: 14172 - DNA, 201 bp, Homo sapiens; identical to SEQ ID NO: 14127

SEQ ID NO: 14173 - DNA, 201 bp, Homo sapiens; identical to SEQ ID NO: 14128

SEQ ID NO: 14174 - DNA, 201 bp, Homo sapiens; identical to SEQ ID NO: 14129

SEQ ID NO: 14175 - DNA, 201 bp, Homo sapiens; identical to SEQ ID NO: 14130

SEQ ID NO: 14176 - DNA, 201 bp, Homo sapiens; identical to SEQ ID NO: 14131

SEQ ID NO: 14177 - DNA, 201 bp, Homo sapiens; identical to SEQ ID NO: 14132

SEQ ID NO: 14178 - DNA, 201 bp, Homo sapiens; identical to SEQ ID NO: 14133

SEQ ID NO: 14179 - DNA, 201 bp, Homo sapiens; identical to SEQ ID NO: 14134

SEQ ID NO: 14180 - DNA, 201 bp, Homo sapiens; identical to SEQ ID NO: 14135

SEQ ID NO: 14181 - DNA, 201 bp, Homo sapiens; identical to SEQ ID NO: 14136

SEQ ID NO: 14182 - DNA, 201 bp, Homo sapiens; identical to SEQ ID NO: 14137

SEQ ID NO: 14183 - DNA, 201 bp, Homo sapiens; identical to SEQ ID NO: 14138

SEQ ID NO: 14184 - DNA, 201 bp, Homo sapiens; identical to SEQ ID NO: 14139

SEQ ID NO: 14185 - DNA, 201 bp, Homo sapiens; identical to SEQ ID NO: 14140

SEQ ID NO: 14186 - DNA, 201 bp, Homo sapiens; identical to SEQ ID NO: 14141

SEQ ID NO: 14187 - DNA, 201 bp, Homo sapiens; identical to SEQ ID NO: 14142

SEQ ID NO: 14188 - DNA, 201 bp, Homo sapiens; identical to SEQ ID NO: 14143

SEQ ID NO: 14189 - DNA, 201 bp, Homo sapiens; identical to SEQ ID NO: 14144

SEQ ID NO: 14190 - DNA, 201 bp, Homo sapiens; identical to SEQ ID NO: 14145

SEQ ID NO: 14191 - DNA, 201 bp, Homo sapiens; identical to SEQ ID NO: 14146

SEQ ID NO: 14192 - DNA, 201 bp, Homo sapiens; identical to SEQ ID NO: 14147

SEQ ID NO: 14193 - DNA, 201 bp, Homo sapiens; identical to SEQ ID NO: 14148

SEQ ID NO: 14194 - DNA, 201 bp, Homo sapiens
gcatttgtgacctgaacctgaaaatcccagaaatcaacagcagtgatatgtcggcccacgtcaccagcccctctggccgtgtgactgaggcagagattgtrcccatggggaagaactcacactgcgtccggtttgtgccccaggagatgggcgtgcacacggtcagcgtcaagtaccgtgggcagcacgtcaccggcagcc

SEQ ID NO: 14195 - DNA, 201 bp, Homo sapiens; identical to SEQ ID NO: 14150

SEQ ID NO: 14196 - DNA, 201 bp, Homo sapiens; identical to SEQ ID NO: 14151

SEQ ID NO: 14197 - DNA, 201 bp, Homo sapiens; identical to SEQ ID NO: 14152

SEQ ID NO: 14198 - DNA, 201 bp, Homo sapiens; identical to SEQ ID NO: 14153

SEQ ID NO: 14199 - DNA, 201 bp, Homo sapiens; identical to SEQ ID NO: 14154

SEQ ID NO: 14200 - DNA, 201 bp, Homo sapiens; identical to SEQ ID NO: 14155

SEQ ID NO: 14201 - DNA, 201 bp, Homo sapiens; identical to SEQ ID NO: 14156

SEQ ID NO: 14202 - DNA, 201 bp, Homo sapiens; identical to SEQ ID NO: 14157

SEQ ID NO: 14203 - DNA, 201 bp, Homo sapiens
ccatcgaaggcccatccaaggttaaaatggattgccaggaaacacctgaagggtacaaagtcatgtacacccccatggctcctggtaactacctgatcagygtcaaatacggtgggcccaaccacatcgtgggcagtcccttcaaggccaaggtgacaggccagcgtctagttagccctggctcagccaacgagacctcat

SEQ ID NO: 14204 - DNA, 201 bp, Homo sapiens; identical to SEQ ID NO: 14119

SEQ ID NO: 14205 - DNA, 201 bp, Homo sapiens; identical to SEQ ID NO: 14121

SEQ ID NO: 14206 - DNA, 201 bp, Homo sapiens; identical to SEQ ID NO: 14123

SEQ ID NO: 14207 - DNA, 201 bp, Homo sapiens; identical to SEQ ID NO: 14146

SEQ ID NO: 14208 - DNA, 201 bp, Homo sapiens; identical to SEQ ID NO: 14147

SEQ ID NO: 14209 - DNA, 201 bp, Homo sapiens; identical to SEQ ID NO: 14124

SEQ ID NO: 14210 - DNA, 201 bp, Homo sapiens; identical to SEQ ID NO: 14148

SEQ ID NO: 14211 - DNA, 201 bp, Homo sapiens; identical to SEQ ID NO: 14125

SEQ ID NO: 14212 - DNA, 201 bp, Homo sapiens; identical to SEQ ID NO: 14126

SEQ ID NO: 14213 - DNA, 201 bp, Homo sapiens; identical to SEQ ID NO: 14151

SEQ ID NO: 14214 - DNA, 201 bp, Homo sapiens; identical to SEQ ID NO: 14127

SEQ ID NO: 14215 - DNA, 201 bp, Homo sapiens; identical to SEQ ID NO: 14128

SEQ ID NO: 14216 - DNA, 201 bp, Homo sapiens; identical to SEQ ID NO: 14129

SEQ ID NO: 14217 - DNA, 201 bp, Homo sapiens; identical to SEQ ID NO: 14130

SEQ ID NO: 14218 - DNA, 201 bp, Homo sapiens; identical to SEQ ID NO: 14153

SEQ ID NO: 14219 - DNA, 201 bp, Homo sapiens; identical to SEQ ID NO: 14152

SEQ ID NO: 14220 - DNA, 201 bp, Homo sapiens; identical to SEQ ID NO: 14131

SEQ ID NO: 14221 - DNA, 201 bp, Homo sapiens; identical to SEQ ID NO: 14132

SEQ ID NO: 14222 - DNA, 201 bp, Homo sapiens; identical to SEQ ID NO: 14133

SEQ ID NO: 14223 - DNA, 201 bp, Homo sapiens; identical to SEQ ID NO: 14134

SEQ ID NO: 14224 - DNA, 201 bp, Homo sapiens; identical to SEQ ID NO: 14155

SEQ ID NO: 14225 - DNA, 201 bp, Homo sapiens; identical to SEQ ID NO: 14135

SEQ ID NO: 14226 - DNA, 201 bp, Homo sapiens; identical to SEQ ID NO: 14136

SEQ ID NO: 14227 - DNA, 201 bp, Homo sapiens; identical to SEQ ID NO: 14157

SEQ ID NO: 14228 - DNA, 201 bp, Homo sapiens; identical to SEQ ID NO: 14137

SEQ ID NO: 14229 - DNA, 201 bp, Homo sapiens; identical to SEQ ID NO: 14114

SEQ ID NO: 14230 - DNA, 201 bp, Homo sapiens; identical to SEQ ID NO: 14115

SEQ ID NO: 14231 - DNA, 201 bp, Homo sapiens; identical to SEQ ID NO: 14116

SEQ ID NO: 14232 - DNA, 201 bp, Homo sapiens; identical to SEQ ID NO: 14117

SEQ ID NO: 14233 - DNA, 199 bp, Homo sapiens; identical to SEQ ID NO: 14118

SEQ ID NO: 14234 - DNA, 201 bp, Homo sapiens; identical to SEQ ID NO: 14119

SEQ ID NO: 14235 - DNA, 201 bp, Homo sapiens; identical to SEQ ID NO: 14120

SEQ ID NO: 14236 - DNA, 201 bp, Homo sapiens; identical to SEQ ID NO: 14121

SEQ ID NO: 14237 - DNA, 201 bp, Homo sapiens; identical to SEQ ID NO: 14122

SEQ ID NO: 14238 - DNA, 201 bp, Homo sapiens; identical to SEQ ID NO: 14123

SEQ ID NO: 14239 - DNA, 201 bp, Homo sapiens; identical to SEQ ID NO: 14124

SEQ ID NO: 14240 - DNA, 201 bp, Homo sapiens; identical to SEQ ID NO: 14125

SEQ ID NO: 14241 - DNA, 201 bp, Homo sapiens; identical to SEQ ID NO: 14126

SEQ ID NO: 14242 - DNA, 201 bp, Homo sapiens; identical to SEQ ID NO: 14127

SEQ ID NO: 14243 - DNA, 201 bp, Homo sapiens; identical to SEQ ID NO: 14128

SEQ ID NO: 14244 - DNA, 201 bp, Homo sapiens; identical to SEQ ID NO: 14129

SEQ ID NO: 14245 - DNA, 201 bp, Homo sapiens; identical to SEQ ID NO: 14130

SEQ ID NO: 14246 - DNA, 201 bp, Homo sapiens; identical to SEQ ID NO: 14131

SEQ ID NO: 14247 - DNA, 201 bp, Homo sapiens; identical to SEQ ID NO: 14132

SEQ ID NO: 14248 - DNA, 201 bp, Homo sapiens; identical to SEQ ID NO: 14133

SEQ ID NO: 14249 - DNA, 201 bp, Homo sapiens; identical to SEQ ID NO: 14134

SEQ ID NO: 14250 - DNA, 201 bp, Homo sapiens; identical to SEQ ID NO: 14135

SEQ ID NO: 14251 - DNA, 201 bp, Homo sapiens; identical to SEQ ID NO: 14136

SEQ ID NO: 14252 - DNA, 201 bp, Homo sapiens; identical to SEQ ID NO: 14137

SEQ ID NO: 14253 - DNA, 201 bp, Homo sapiens; identical to SEQ ID NO: 14138

SEQ ID NO: 14254 - DNA, 201 bp, Homo sapiens; identical to SEQ ID NO: 14139

SEQ ID NO: 14255 - DNA, 201 bp, Homo sapiens; identical to SEQ ID NO: 14140

SEQ ID NO: 14256 - DNA, 201 bp, Homo sapiens; identical to SEQ ID NO: 14141

SEQ ID NO: 14257 - DNA, 201 bp, Homo sapiens; identical to SEQ ID NO: 14142

SEQ ID NO: 14258 - DNA, 201 bp, Homo sapiens; identical to SEQ ID NO: 14143

SEQ ID NO: 14259 - DNA, 201 bp, Homo sapiens; identical to SEQ ID NO: 14144

SEQ ID NO: 14260 - DNA, 201 bp, Homo sapiens; identical to SEQ ID NO: 14145

SEQ ID NO: 14261 - DNA, 201 bp, Homo sapiens; identical to SEQ ID NO: 14146

SEQ ID NO: 14262 - DNA, 201 bp, Homo sapiens; identical to SEQ ID NO: 14147

SEQ ID NO: 14263 - DNA, 201 bp, Homo sapiens; identical to SEQ ID NO: 14148

SEQ ID NO: 14264 - DNA, 201 bp, Homo sapiens; identical to SEQ ID NO: 14194

SEQ ID NO: 14265 - DNA, 201 bp, Homo sapiens; identical to SEQ ID NO: 14150

SEQ ID NO: 14266 - DNA, 201 bp, Homo sapiens; identical to SEQ ID NO: 14151

SEQ ID NO: 14267 - DNA, 201 bp, Homo sapiens; identical to SEQ ID NO: 14152

SEQ ID NO: 14268 - DNA, 201 bp, Homo sapiens; identical to SEQ ID NO: 14153

SEQ ID NO: 14269 - DNA, 201 bp, Homo sapiens; identical to SEQ ID NO: 14154

SEQ ID NO: 14270 - DNA, 201 bp, Homo sapiens; identical to SEQ ID NO: 14155

SEQ ID NO: 14271 - DNA, 201 bp, Homo sapiens; identical to SEQ ID NO: 14156

SEQ ID NO: 14272 - DNA, 201 bp, Homo sapiens; identical to SEQ ID NO: 14157

SEQ ID NO: 14273 - DNA, 201 bp, Homo sapiens; identical to SEQ ID NO: 14158

SEQ ID NO: 14274 - DNA, 201 bp, Homo sapiens
gtcactttttctggaaaataatgatctgtacagacaggacagaagtggccactcttgtggcaggtgtagtatctggggcgagtgttgggggtaaaagcccmccctacagaaagtggaacagcccggagcctgatgtgaaaggaccacgggtgttgtaagctgggacacggaagccaaactggaatcaaacgccgactgtaa

SEQ ID NO: 14275 - DNA, 201 bp, Homo sapiens; identical to SEQ ID NO: 14116

SEQ ID NO: 14276 - DNA, 201 bp, Homo sapiens
tctgtacagacaggacagaagtggccactcttgtggcaggtgtagtatctggggcgagtgttgggggtaaaagcccaccctacagaaagtggaacagcccrgagcctgatgtgaaaggaccacgggtgttgtaagctgggacacggaagccaaactggaatcaaacgccgactgtaaattgtatcttataacttattaaat

SEQ ID NO: 14277 - DNA, 195 bp, Homo sapiens
tggccactcttgtggcaggtgtagtatctggggcgagtgttgggggtaaaagcccaccctacagaaagtggaacagcccggagcctgatgtgaaaggaccmcgggtgttgtaagctgggacacggaagccaaactggaatcaaacgccgactgtaaattgtatcttataacttattaaataaaacatttgctccg

SEQ ID NO: 14278 - DNA, 201 bp, Homo sapiens; identical to SEQ ID NO: 14119

SEQ ID NO: 14279 - DNA, 201 bp, Homo sapiens
aggtccgtcccatgacataacactccacacccgccccagccaacttcatgggtcactttttctggaaaataatgatctgtacagacaggacagaagtggcyactcttgtggcaggtgtagtatctggggcgagtgttgggggtaaaagcccaccctacagaaagtggaacagcccggagcctgatgtgaaaggaccacggg

SEQ ID NO: 14280 - DNA, 201 bp, Homo sapiens; identical to SEQ ID NO: 14121

SEQ ID NO: 14281 - DNA, 201 bp, Homo sapiens; identical to SEQ ID NO: 14123

SEQ ID NO: 14282 - DNA, 201 bp, Homo sapiens; identical to SEQ ID NO: 14124

SEQ ID NO: 14283 - DNA, 201 bp, Homo sapiens; identical to SEQ ID NO: 14125

SEQ ID NO: 14284 - DNA, 201 bp, Homo sapiens; identical to SEQ ID NO: 14126

SEQ ID NO: 14285 - DNA, 201 bp, Homo sapiens; identical to SEQ ID NO: 14127

SEQ ID NO: 14286 - DNA, 201 bp, Homo sapiens; identical to SEQ ID NO: 14128

SEQ ID NO: 14287 - DNA, 201 bp, Homo sapiens; identical to SEQ ID NO: 14129

SEQ ID NO: 14288 - DNA, 201 bp, Homo sapiens; identical to SEQ ID NO: 14130

SEQ ID NO: 14289 - DNA, 201 bp, Homo sapiens; identical to SEQ ID NO: 14131

SEQ ID NO: 14290 - DNA, 201 bp, Homo sapiens; identical to SEQ ID NO: 14132

SEQ ID NO: 14291 - DNA, 201 bp, Homo sapiens; identical to SEQ ID NO: 14133

SEQ ID NO: 14292 - DNA, 201 bp, Homo sapiens; identical to SEQ ID NO: 14134

SEQ ID NO: 14293 - DNA, 201 bp, Homo sapiens; identical to SEQ ID NO: 14135

SEQ ID NO: 14294 - DNA, 201 bp, Homo sapiens; identical to SEQ ID NO: 14136

SEQ ID NO: 14295 - DNA, 201 bp, Homo sapiens; identical to SEQ ID NO: 14137

SEQ ID NO: 14296 - DNA, 201 bp, Homo sapiens; identical to SEQ ID NO: 14138

SEQ ID NO: 14297 - DNA, 201 bp, Homo sapiens; identical to SEQ ID NO: 14139

SEQ ID NO: 14298 - DNA, 201 bp, Homo sapiens; identical to SEQ ID NO: 14142

SEQ ID NO: 14299 - DNA, 201 bp, Homo sapiens; identical to SEQ ID NO: 14146

SEQ ID NO: 14300 - DNA, 201 bp, Homo sapiens; identical to SEQ ID NO: 14194

SEQ ID NO: 14301 - DNA, 201 bp, Homo sapiens; identical to SEQ ID NO: 14148

SEQ ID NO: 14302 - DNA, 201 bp, Homo sapiens; identical to SEQ ID NO: 14147

SEQ ID NO: 14303 - DNA, 201 bp, Homo sapiens; identical to SEQ ID NO: 14150

SEQ ID NO: 14304 - DNA, 201 bp, Homo sapiens; identical to SEQ ID NO: 14151

SEQ ID NO: 14305 - DNA, 201 bp, Homo sapiens; identical to SEQ ID NO: 14153

SEQ ID NO: 14306 - DNA, 201 bp, Homo sapiens; identical to SEQ ID NO: 14152

SEQ ID NO: 14307 - DNA, 201 bp, Homo sapiens; identical to SEQ ID NO: 14155

SEQ ID NO: 14308 - DNA, 201 bp, Homo sapiens; identical to SEQ ID NO: 14154

SEQ ID NO: 14309 - DNA, 201 bp, Homo sapiens; identical to SEQ ID NO: 14156

SEQ ID NO: 14310 - DNA, 201 bp, Homo sapiens; identical to SEQ ID NO: 14157

SEQ ID NO: 14311 - DNA, 201 bp, Homo sapiens; identical to SEQ ID NO: 14203

SEQ ID NO: 14312 - DNA, 201 bp, Homo sapiens; identical to SEQ ID NO: 14274

SEQ ID NO: 14313 - DNA, 201 bp, Homo sapiens; identical to SEQ ID NO: 14116

SEQ ID NO: 14314 - DNA, 201 bp, Homo sapiens; identical to SEQ ID NO: 14276

SEQ ID NO: 14315 - DNA, 195 bp, Homo sapiens; identical to SEQ ID NO: 14277

SEQ ID NO: 14316 - DNA, 201 bp, Homo sapiens; identical to SEQ ID NO: 14119

SEQ ID NO: 14317 - DNA, 201 bp, Homo sapiens; identical to SEQ ID NO: 14279

SEQ ID NO: 14318 - DNA, 201 bp, Homo sapiens; identical to SEQ ID NO: 14121

SEQ ID NO: 14319 - DNA, 201 bp, Homo sapiens; identical to SEQ ID NO: 14123

SEQ ID NO: 14320 - DNA, 201 bp, Homo sapiens; identical to SEQ ID NO: 14124

SEQ ID NO: 14321 - DNA, 201 bp, Homo sapiens; identical to SEQ ID NO: 14125

SEQ ID NO: 14322 - DNA, 201 bp, Homo sapiens; identical to SEQ ID NO: 14126

SEQ ID NO: 14323 - DNA, 201 bp, Homo sapiens; identical to SEQ ID NO: 14127

SEQ ID NO: 14324 - DNA, 201 bp, Homo sapiens; identical to SEQ ID NO: 14128

SEQ ID NO: 14325 - DNA, 201 bp, Homo sapiens; identical to SEQ ID NO: 14129

SEQ ID NO: 14326 - DNA, 201 bp, Homo sapiens; identical to SEQ ID NO: 14130

SEQ ID NO: 14327 - DNA, 201 bp, Homo sapiens; identical to SEQ ID NO: 14131

SEQ ID NO: 14328 - DNA, 201 bp, Homo sapiens; identical to SEQ ID NO: 14132

SEQ ID NO: 14329 - DNA, 201 bp, Homo sapiens; identical to SEQ ID NO: 14133

SEQ ID NO: 14330 - DNA, 201 bp, Homo sapiens; identical to SEQ ID NO: 14134

SEQ ID NO: 14331 - DNA, 201 bp, Homo sapiens; identical to SEQ ID NO: 14135

SEQ ID NO: 14332 - DNA, 201 bp, Homo sapiens; identical to SEQ ID NO: 14136

SEQ ID NO: 14333 - DNA, 201 bp, Homo sapiens; identical to SEQ ID NO: 14137

SEQ ID NO: 14334 - DNA, 201 bp, Homo sapiens; identical to SEQ ID NO: 14138

SEQ ID NO: 14335 - DNA, 201 bp, Homo sapiens; identical to SEQ ID NO: 14139

SEQ ID NO: 14336 - DNA, 201 bp, Homo sapiens; identical to SEQ ID NO: 14142

SEQ ID NO: 14337 - DNA, 201 bp, Homo sapiens; identical to SEQ ID NO: 14146

SEQ ID NO: 14338 - DNA, 201 bp, Homo sapiens; identical to SEQ ID NO: 14194

SEQ ID NO: 14339 - DNA, 201 bp, Homo sapiens; identical to SEQ ID NO: 14148

SEQ ID NO: 14340 - DNA, 201 bp, Homo sapiens; identical to SEQ ID NO: 14147

SEQ ID NO: 14341 - DNA, 201 bp, Homo sapiens; identical to SEQ ID NO: 14150

SEQ ID NO: 14342 - DNA, 201 bp, Homo sapiens; identical to SEQ ID NO: 14151

SEQ ID NO: 14343 - DNA, 201 bp, Homo sapiens; identical to SEQ ID NO: 14153

SEQ ID NO: 14344 - DNA, 201 bp, Homo sapiens; identical to SEQ ID NO: 14152

SEQ ID NO: 14345 - DNA, 201 bp, Homo sapiens; identical to SEQ ID NO: 14155

SEQ ID NO: 14346 - DNA, 201 bp, Homo sapiens; identical to SEQ ID NO: 14154

SEQ ID NO: 14347 - DNA, 201 bp, Homo sapiens; identical to SEQ ID NO: 14156

SEQ ID NO: 14348 - DNA, 201 bp, Homo sapiens; identical to SEQ ID NO: 14157

SEQ ID NO: 14349 - DNA, 201 bp, Homo sapiens; identical to SEQ ID NO: 14203

SEQ ID NO: 14350 - DNA, 201 bp, Homo sapiens
atgaggttaaagtgtcagggacgttgcctgagcccaaatgtgtagtgtggtctgggcaggcagacctttaggttttgctgcttagtcctgaggaagtggcyactcttgtggcaggtgtagtatctggggcgagtgttgggggtaaaagcccaccctacagaaagtggaacagcccggacctgatgtgaaaggaccacgggt

SEQ ID NO: 14351 - DNA, 201 bp, Homo sapiens
cccagccaacttcatgggtcactttttctggaaaataatgatctgtacagacaggacagaatgaaactcctgcggctctttggcctgaaagttgggaatgrttgggggagagaagggcagcagcttattggtggtcttttcaccattggcagaaacagtgagagctgtgtggtgcagaaatccagaaatgaggtgtaggga

SEQ ID NO: 14352 - DNA, 201 bp, Homo sapiens
ttggtgggcttggcataactgttgagggaccatcagagtcgaagataaattgcagagacaacaaggatggcagctgcagtgctgagtacattcctttcgcrccgggggattacgatgttaatatcacatatggaggagcccacatccctggcagccccttcagggttcctgtgaaggatgttgtggaccccagcaaggtca

SEQ ID NO: 14353 - DNA, 201 bp, Homo sapiens; identical to SEQ ID NO: 14123

SEQ ID NO: 14354 - DNA, 201 bp, Homo sapiens; identical to SEQ ID NO: 14121

SEQ ID NO: 14355 - DNA, 201 bp, Homo sapiens; identical to SEQ ID NO: 14124

SEQ ID NO: 14356 - DNA, 201 bp, Homo sapiens; identical to SEQ ID NO: 14146

SEQ ID NO: 14357 - DNA, 201 bp, Homo sapiens; identical to SEQ ID NO: 14150

SEQ ID NO: 14358 - DNA, 201 bp, Homo sapiens; identical to SEQ ID NO: 14153

SEQ ID NO: 14359 - DNA, 201 bp, Homo sapiens; identical to SEQ ID NO: 14135

SEQ ID NO: 14360 - DNA, 201 bp, Homo sapiens; identical to SEQ ID NO: 14136

SEQ ID NO: 14361 - DNA, 201 bp, Homo sapiens; identical to SEQ ID NO: 14194

SEQ ID NO: 14362 - DNA, 201 bp, Homo sapiens; identical to SEQ ID NO: 14151

SEQ ID NO: 14363 - DNA, 201 bp, Homo sapiens; identical to SEQ ID NO: 14155

SEQ ID NO: 14364 - DNA, 201 bp, Homo sapiens; identical to SEQ ID NO: 14128

SEQ ID NO: 14365 - DNA, 201 bp, Homo sapiens; identical to SEQ ID NO: 14131

SEQ ID NO: 14366 - DNA, 201 bp, Homo sapiens
cgggaaggtgggtgaagctggcctccttagcgtcaactgctcggaagcgggaccgggggccctgggcctggaagctgtctcggactcgggaacaaaagccraagtcagtattcagaacaacaaagatggcacctacgcggtgacctacgtgcccctgacggccggcatgtacacgttgaccatgaagtatggtggcgaact

SEQ ID NO: 14367 - DNA, 201 bp, Homo sapiens; identical to SEQ ID NO: 14132

SEQ ID NO: 14368 - DNA, 201 bp, Homo sapiens; identical to SEQ ID NO: 14142

SEQ ID NO: 14369 - DNA, 201 bp, Homo sapiens
caggtctcgagcacgggaaggtgggtgaagctggcctccttagcgtcaactgctcggaagcgggaccgggggccctgggcctggaagctgtctcggactcrggaacaaaagccgaagtcagtattcagaacaacaaagatggcacctacgcggtgacctacgtgcccctgacggccggcatgtacacgttgaccatgaagt

SEQ ID NO: 14370 - DNA, 201 bp, Homo sapiens; identical to SEQ ID NO: 14147

SEQ ID NO: 14371 - DNA, 201 bp, Homo sapiens; identical to SEQ ID NO: 14126

SEQ ID NO: 14372 - DNA, 201 bp, Homo sapiens; identical to SEQ ID NO: 14127

SEQ ID NO: 14373 - DNA, 201 bp, Homo sapiens
agtggccgaggcctacaacccaaaggcgtccgtatccgggagaccacagatttcaaggttgacaccaaagctgcaggaagtggggagctcggggtaaccaygaagggtcctaagggtctggaggagctggtgaagcagaaagactttctggatggggtctacgcattcgagtattaccccagcaccccggggagatacagc

SEQ ID NO: 14374 - DNA, 201 bp, Homo sapiens; identical to SEQ ID NO: 14152

SEQ ID NO: 14375 - DNA, 201 bp, Homo sapiens; identical to SEQ ID NO: 14134

SEQ ID NO: 14376 - DNA, 201 bp, Homo sapiens; identical to SEQ ID NO: 14157

SEQ ID NO: 14377 - DNA, 201 bp, Homo sapiens; identical to SEQ ID NO: 14129

SEQ ID NO: 14378 - DNA, 201 bp, Homo sapiens; identical to SEQ ID NO: 14130

SEQ ID NO: 14379 - DNA, 201 bp, Homo sapiens; identical to SEQ ID NO: 14154

SEQ ID NO: 14380 - DNA, 201 bp, Homo sapiens; identical to SEQ ID NO: 14156

SEQ ID NO: 14381 - DNA, 201 bp, Homo sapiens; identical to SEQ ID NO: 14203

SEQ ID NO: 14382 - DNA, 201 bp, Homo sapiens; identical to SEQ ID NO: 14116

SEQ ID NO: 14383 - DNA, 201 bp, Homo sapiens; identical to SEQ ID NO: 14138

SEQ ID NO: 14384 - DNA, 201 bp, Homo sapiens; identical to SEQ ID NO: 14139

SEQ ID NO: 14385 - DNA, 201 bp, Homo sapiens; identical to SEQ ID NO: 14140

SEQ ID NO: 14386 - DNA, 201 bp, Homo sapiens
agccaacttcatgggtcactttttctggaaaataatgatctgtacagacaggacagaatgaaactcctgcggctctttggcctgaaagttgggaatggttkggggagagaagggcagcagcttattggtggtcttttcaccattggcagaaacagtgagagctgtgtggtgcagaaatccagaaatgaggtgtagggaatt

SEQ ID NO: 14387 - DNA, 201 bp, Homo sapiens
tcctgcggctctttggcctgaaagttgggaatggttgggggagagaagggcagcagcttattggtggtcttttcaccattggcagaaacagtgagagctgygtggtgcagaaatccagaaatgaggtgtagggaattttgcctgccttcctgcagacctgagctggctttggaatgaggttaaagtgtcagggacgttgcc

SEQ ID NO: 14388 - DNA, 201 bp, Homo sapiens; identical to SEQ ID NO: 14144

SEQ ID NO: 14389 - DNA, 201 bp, Homo sapiens; identical to SEQ ID NO: 14145

SEQ ID NO: 14390 - DNA, 201 bp, Homo sapiens; identical to SEQ ID NO: 14114

SEQ ID NO: 14391 - DNA, 201 bp, Homo sapiens
ctgggcaggcagacctttaggttttgctgcttagtcctgaggaagtggccactcttgtggcaggtgtagtatctggggcgagtgttgggggtaaaagcccmccctacagaaagtggaacagcccggacctgatgtgaaaggaccacgggtgttgtaagctgggaccggaaccaaactggaatcaaacgcgactgtaaattg

SEQ ID NO: 14392 - DNA, 201 bp, Homo sapiens
tgctgcttagtcctgaggaagtggccactcttgtggcaggtgtagtatctggggcgagtgttgggggtaaaagcccaccctacagaaagtggaacagcccrgacctgatgtgaaaggaccacgggtgttgtaagctgggaccggaaccaaactggaatcaaacgcgactgtaaattgtatcttataacttattaaataaaa

SEQ ID NO: 14393 - DNA, 201 bp, Homo sapiens; identical to SEQ ID NO: 14148

SEQ ID NO: 14394 - DNA, 201 bp, Homo sapiens
acaaacttctttccacttttgacttaataaagtatgactttcagaaagatgaacccatgagaaatgagcagggttggtgtattcatgtgaaaaaaggagarcctggacttctcatttctcgagtgaatgcaaaaaatcccttctttggctatgctgggccttataagcacacaaaagacaaattgctttgtgatgttttta

SEQ ID NO: 14395 - DNA, 201 bp, Homo sapiens
cccagcttttcccggctcgaattcagcctccaactcaagctcgcgggaaagactacctgagaggagaaaagcttctgtccctggaccttcttctgagggtrgagtcggaggctccctgctctccagccgcccagtgacccaagcttaatcttcagcaccacttggggcgaccttttcggtgcaaacctacgattctgtttc

SEQ ID NO: 14396 - DNA, 201 bp, Homo sapiens
cggtgcaaacctacgattctgtttctcaggattcctccccatcccgcttcgccccggaaaagctgacaagaacttcaggtgtaagccctgagtagtgaggmtctgcggtctccgtggagagctgtgcctggaagagaaggacgctggtgggggctgagatcagagctgtcttctggcccagtagcccccatgcttctgtca

SEQ ID NO: 14397 - DNA, 201 bp, Homo sapiens
ctggtgggggctgagatcagagctgtcttctggcccagtagcccccatgcttctgtcatggctaacagttctaggggctggaatggtcgtcctgcacttcktgcagaaactcctgttcccttacttttgggatgacttctggttcgtgttgaaggtggtgctcattataattcggctgaagaagtacgaaaagagagggga

SEQ ID NO: 14398 - DNA, 201 bp, Homo sapiens
aagccctgagtagtgaggctctgcggtctccgtggagagctgtgcctggaagagaaggacgctggtgggggctgagatcagagctgtcttctggcccagtwgcccccatgcttctgtcatggctaacagttctaggggctggaatggtcgtcctgcacttcgtgcagaaactcctgttcccttacttttgggatgacttct

SEQ ID NO: 14399 - DNA, 201 bp, Homo sapiens
agggagctaacattaattatgcatgtactatatttccttaatatgagagataattttttaattgcataagaattttaatttcttttaattgatataaacaktagttgattattctttttatctatttggagattcagtgcataactaagtattttccttaatactaaagattttaaataataaatagtggctagcggtttg

SEQ ID NO: 14400 - DNA, 201 bp, Homo sapiens
tctccagccgcccagtgacccaagcttaatcttcagcaccacttggggcgaccttttcggtgcaaacctacgattctgtttctcaggattcctccccatcycgcttcgccccggaaaagctgacaagaacttcaggtgtaagccctgagtagtgaggctctgcggtctccgtggagagctgtgcctggaagagaaggacgc

SEQ ID NO: 14401 - DNA, 201 bp, Homo sapiens
attcagcctccaactcaagctcgcgggaaagactacctgagaggagaaaagcttctgtccctggaccttcttctgagggtggagtcggaggctccctgctytccagccgcccagtgacccaagcttaatcttcagcaccacttggggcgaccttttcggtgcaaacctacgattctgtttctcaggattcctccccatccc

SEQ ID NO: 14402 - DNA, 201 bp, Homo sapiens
gcaggaatggcttctattattttaaaaccaaatacatctttagatttggaaaaagtttatgaacaagttgtaacatttctaccagcttatgcttgtccackatttttaagaattcaggaaaaaatggaagcaacaggaacattcaaactattgaagcatcagttggtggaagatggatttaatccactgaaaatttctgaa

SEQ ID NO: 14403 - DNA, 201 bp, Homo sapiens
atataacccttcctctgtatcatagttcagcagctatcctgggaatttctggatgtgttgagttgggtgccacttgtgtgttaaagaagaaattttcagcragccagttttggagtgactgcaagaagtatgatgtgactgtgtttcagtatattggagaactttgtcgctacctttgcaaacaatctaagagagaaggag

SEQ ID NO: 14404 - DNA, 201 bp, Homo sapiens
atcgctgcgcttctcagtcatcatcatcccagcttttcccggctcgaattcagcctccaactcaagctcgcgggaaagactacctgagaggagaaaagctkctgtccctggaccttcttctgagggtggagtcggaggctccctgctctccagccgcccagtgacccaagcttaatcttcagcaccacttggggcgacctt

SEQ ID NO: 14405 - DNA, 201 bp, Homo sapiens
tcgtcctgcacttcgtgcagaaactcctgttcccttacttttgggatgacttctggttcgtgttgaaggtggtgctcattataattcggctgaagaagtaygaaaagagaggggagctggtgactgtgctggataaattcttgagtcatgccaaaagacaacctcggaaacctttcatcatctatgagggagacatctaca

SEQ ID NO: 14406 - DNA, 201 bp, Homo sapiens
agccctgagtagtgaggctctgcggtctccgtggagagctgtgcctggaagagaaggacgctggtgggggctgagatcagagctgtcttctggcccagtarcccccatgcttctgtcatggctaacagttctaggggctggaatggtcgtcctgcacttcgtgcagaaactcctgttcccttacttttgggatgacttctg

SEQ ID NO: 14407 - DNA, 201 bp, Homo sapiens
cgattctgtttctcaggattcctccccatcccgcttcgccccggaaaagctgacaagaacttcaggtgtaagccctgagtagtgaggctctgcggtctccrtggagagctgtgcctggaagagaaggacgctggtgggggctgagatcagagctgtcttctggcccagtagcccccatgcttctgtcatggctaacagttc

SEQ ID NO: 14408 - DNA, 201 bp, Homo sapiens
agttcagcagctatcctgggaatttctggatgtgttgagttgggtgccacttgtgtgttaaagaagaaattttcagcaagccagttttggagtgactgcargaagtatgatgtgactgtgtttcagtatattggagaactttgtcgctacctttgcaaacaatctaagagagaaggagaaaaggatcataaggtgcgtttg

SEQ ID NO: 14409 - DNA, 201 bp, Homo sapiens
tgactttcagaaagatgaacccatgagaaatgagcagggttggtgtattcatgtgaaaaaaggagaacctggacttctcatttctcgagtgaatgcaaaamatcccttctttggctatgctgggccttataagcacacaaaagacaaattgctttgtgatgtttttaagaagggagatgtttaccttaatactggagactt

SEQ ID NO: 14410 - DNA, 201 bp, Homo sapiens; identical to SEQ ID NO: 14394

SEQ ID NO: 14411 - DNA, 201 bp, Homo sapiens; identical to SEQ ID NO: 14396

SEQ ID NO: 14412 - DNA, 201 bp, Homo sapiens; identical to SEQ ID NO: 14397

SEQ ID NO: 14413 - DNA, 201 bp, Homo sapiens; identical to SEQ ID NO: 14398

SEQ ID NO: 14414 - DNA, 201 bp, Homo sapiens; identical to SEQ ID NO: 14399

SEQ ID NO: 14415 - DNA, 201 bp, Homo sapiens; identical to SEQ ID NO: 14400

SEQ ID NO: 14416 - DNA, 120 bp, Homo sapiens
gagtcggaggctccctgctytccagccgcccagtgacccaagcttaatcttcagcaccacttggggcgaccttttcggtgcaaacctacgattctgtttctcaggattcctccccatccc

SEQ ID NO: 14417 - DNA, 201 bp, Homo sapiens; identical to SEQ ID NO: 14402

SEQ ID NO: 14418 - DNA, 201 bp, Homo sapiens; identical to SEQ ID NO: 14403

SEQ ID NO: 14419 - DNA, 201 bp, Homo sapiens; identical to SEQ ID NO: 14405

SEQ ID NO: 14420 - DNA, 201 bp, Homo sapiens; identical to SEQ ID NO: 14406

SEQ ID NO: 14421 - DNA, 201 bp, Homo sapiens; identical to SEQ ID NO: 14407

SEQ ID NO: 14422 - DNA, 201 bp, Homo sapiens; identical to SEQ ID NO: 14408

SEQ ID NO: 14423 - DNA, 201 bp, Homo sapiens; identical to SEQ ID NO: 14409

SEQ ID NO: 14424 - DNA, 201 bp, Homo sapiens
tcatggctaccagcacctgaaagcttcctcgacatctgttaataaagccgtaggcccttgtctaagtgcaaccgcctagactttctttcagatacatgtcyacatgtccatttttcaggttctctaagttggagtggagtctgggaagggttgtgaatgaggcttctgggctatgggtgaggttccaatggcaggttagag

SEQ ID NO: 14425 - DNA, 201 bp, Homo sapiens
cctttccttaaaggccatccttaaaaccagaccctcatggctaccagcacctgaaagcttcctcgacatctgttaataaagccgtaggcccttgtctaagygcaaccgcctagactttctttcagatacatgtccacatgtccatttttcaggttctctaagttggagtggagtctgggaagggttgtgaatgaggcttct

SEQ ID NO: 14426 - DNA, 201 bp, Homo sapiens
attaacccttggtgaatttttgaaactggacagagaaagagccaagaacaaaattgcaaaggaaaccaacaataagaagaaagaatttgaggaaactgcgragaaagtgcgccgtgccatcgagcagctggctgccatggattgaggcctctggccggagctgcctggtcccagagtggctgcaccacttccagggtttat

SEQ ID NO: 14427 - DNA, 201 bp, Homo sapiens
tgtctgtcagcccaaccttcacatctgtcacgttctccacacgggggagagacgcagtccgcccaggtccccgctttctttggaggcagcagctcccgcasggctgaagtctggcgtaagatgatggatttgattcgccctcctccctgtcatagagctgcagggtggattgttacagcttcgctggaaacctctggaggt

SEQ ID NO: 14428 - DNA, 201 bp, Homo sapiens
agcctgtgctgtgggcagggctgagctggagccgcccctctcagcccgcctgccacggcctttccttaaaggccatccttaaaaccagaccctcatggctrccagcacctgaaagcttcctcgacatctgttaataaagccgtaggcccttgtctaagtgcaaccgcctagactttctttcagatacatgtccacatgtcc

SEQ ID NO: 14429 - DNA, 201 bp, Homo sapiens
tctgtcacacctgtgcctcctcagaggacatgtttttttgtttttttttttttggtagatgcatgacttgtgtgtgatgagagaatggagacagagtcccyggctcctctactgtttaacaacatggctttcttattttgtttgaattgttaattcacagaatagcacaaactacaattaaaactaagcacaaagccattc

SEQ ID NO: 14430 - DNA, 201 bp, Homo sapiens
tggaaaaaaatggttttgtcttcaactcctttgcatgccaggcggtgatgtggatctcggcttctgtgagcctgtgctgtgggcagggctgagctggagcmgcccctctcagcccgcctgccacggcctttccttaaaggccatccttaaaaccagaccctcatggctaccagcacctgaaagcttcctcgacatctgtta

SEQ ID NO: 14431 - DNA, 201 bp, Homo sapiens
ctctggccggagctgcctggtcccagagtggctgcaccacttccagggtttattccctggtgccaccagccttcctgtgggccccttagcaatgtcttagraaaggagatcaacattttcaaattagatgtttcaactgtgctcttgttttgtcttgaaagtggcaccagaggtgcttctgcctgtgcagcgggtgctgct

SEQ ID NO: 14432 - DNA, 201 bp, Homo sapiens
ttgaggctgtcacagtcctgagtgtggacttggcaggtgcctgttgaatctgagctgcaggttccttatctgtcacacctgtgcctcctcagaggacatgtttttttgtttttttttttttggtagatgcatgacttgtgtgtgatgagagaatggagacagagtccctggctcctctactgtttaacaacatggctttct

SEQ ID NO: 14433 - DNA, 201 bp, Homo sapiens
tgtcacagtcctgagtgtggacttggcaggtgcctgttgaatctgagctgcaggttccttatctgtcacacctgtgcctcctcagaggacatgtttttttgtttttttttttttggtagatgcatgacttgtgtgtgatgagagaatggagacagagtccctggctcctctactgtttaacaacatggctttcttattttg

SEQ ID NO: 14434 - DNA, 201 bp, Homo sapiens
tctgggcgcttgccagagccacgaaccccagacctgtttgtatcatccgggctccttccgggcagaaacaactgaaaatgcacttcagacccacttatttmtgccacatctgagtcggcctgagatagacttttccctctaaactgggagaatatcacagtggtttttgttagcagaaaatgcactccagcctctgtactc

SEQ ID NO: 14435 - DNA, 144 bp, Homo sapiens
gacatgccccgcggcgcgccattaaccgccagatttgaatcgcsggacccgttggcagaggtggcggcggcggcatgggtgccccgacgttgccccctgcctggcagccctttctcaaggaccaccgcatctctacattcaaga

SEQ ID NO: 14436 - DNA, 201 bp, Homo sapiens
agggtttattccctggtgccaccagccttcctgtgggccccttagcaatgtcttaggaaaggagatcaacattttcaaattagatgtttcaactgtgctcytgttttgtcttgaaagtggcaccagaggtgcttctgcctgtgcagcgggtgctgctggtaacagtggctgcttctctctctctctctcttttttgggggc

SEQ ID NO: 14437 - DNA, 201 bp, Homo sapiens; identical to SEQ ID NO: 14424

SEQ ID NO: 14438 - DNA, 201 bp, Homo sapiens; identical to SEQ ID NO: 14425

SEQ ID NO: 14439 - DNA, 201 bp, Homo sapiens
agtgtttcttctgcttcaaggagctggaaggctgggagccagatgacgaccccatgcaaaggaaaccaacaataagaagaaagaatttgaggaaactgcgragaaagtgcgccgtgccatcgagcagctggctgccatggattgaggcctctggccggagctgcctggtcccagagtggctgcaccacttccagggtttat

SEQ ID NO: 14440 - DNA, 201 bp, Homo sapiens; identical to SEQ ID NO: 14427

SEQ ID NO: 14441 - DNA, 201 bp, Homo sapiens; identical to SEQ ID NO: 14428

SEQ ID NO: 14442 - DNA, 201 bp, Homo sapiens; identical to SEQ ID NO: 14429

SEQ ID NO: 14443 - DNA, 201 bp, Homo sapiens; identical to SEQ ID NO: 14430

SEQ ID NO: 14444 - DNA, 201 bp, Homo sapiens; identical to SEQ ID NO: 14431

SEQ ID NO: 14445 - DNA, 201 bp, Homo sapiens; identical to SEQ ID NO: 14432

SEQ ID NO: 14446 - DNA, 201 bp, Homo sapiens; identical to SEQ ID NO: 14433

SEQ ID NO: 14447 - DNA, 201 bp, Homo sapiens; identical to SEQ ID NO: 14434

SEQ ID NO: 14448 - DNA, 144 bp, Homo sapiens; identical to SEQ ID NO: 14435

SEQ ID NO: 14449 - DNA, 201 bp, Homo sapiens; identical to SEQ ID NO: 14436

SEQ ID NO: 14450 - DNA, 201 bp, Homo sapiens; identical to SEQ ID NO: 14424

SEQ ID NO: 14451 - DNA, 201 bp, Homo sapiens; identical to SEQ ID NO: 14425

SEQ ID NO: 14452 - DNA, 201 bp, Homo sapiens; identical to SEQ ID NO: 14426

SEQ ID NO: 14453 - DNA, 201 bp, Homo sapiens; identical to SEQ ID NO: 14427

SEQ ID NO: 14454 - DNA, 201 bp, Homo sapiens; identical to SEQ ID NO: 14428

SEQ ID NO: 14455 - DNA, 201 bp, Homo sapiens
cctcctcagaggacagtttttttgttgttgtgtttttttgtttttttttttttggtagatgcatgacttgtgtgtgatgagagaatggagacagagtcccyggctcctctactgtttaacaacatggctttcttattttgtttgaattgttaattcacagaatagcacaaactacaattaaaactaagcacaaagccattc

SEQ ID NO: 14456 - DNA, 201 bp, Homo sapiens; identical to SEQ ID NO: 14430

SEQ ID NO: 14457 - DNA, 201 bp, Homo sapiens; identical to SEQ ID NO: 14431

SEQ ID NO: 14458 - DNA, 201 bp, Homo sapiens
ctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaaca

SEQ ID NO: 14459 - DNA, 201 bp, Homo sapiens
tcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttct

SEQ ID NO: 14460 - DNA, 201 bp, Homo sapiens
tgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttg

SEQ ID NO: 14461 - DNA, 201 bp, Homo sapiens; identical to SEQ ID NO: 14434

SEQ ID NO: 14462 - DNA, 144 bp, Homo sapiens; identical to SEQ ID NO: 14435

SEQ ID NO: 14463 - DNA, 201 bp, Homo sapiens; identical to SEQ ID NO: 14436

SEQ ID NO: 14464 - DNA, 144 bp, Homo sapiens; identical to SEQ ID NO: 14435

SEQ ID NO: 14465 - DNA, 201 bp, Homo sapiens; identical to SEQ ID NO: 14424

SEQ ID NO: 14466 - DNA, 201 bp, Homo sapiens; identical to SEQ ID NO: 14425

SEQ ID NO: 14467 - DNA, 201 bp, Homo sapiens; identical to SEQ ID NO: 14439

SEQ ID NO: 14468 - DNA, 201 bp, Homo sapiens; identical to SEQ ID NO: 14427

SEQ ID NO: 14469 - DNA, 201 bp, Homo sapiens; identical to SEQ ID NO: 14428

SEQ ID NO: 14470 - DNA, 201 bp, Homo sapiens; identical to SEQ ID NO: 14455

SEQ ID NO: 14471 - DNA, 201 bp, Homo sapiens; identical to SEQ ID NO: 14430

SEQ ID NO: 14472 - DNA, 201 bp, Homo sapiens; identical to SEQ ID NO: 14431

SEQ ID NO: 14473 - DNA, 201 bp, Homo sapiens; identical to SEQ ID NO: 14458

SEQ ID NO: 14474 - DNA, 201 bp, Homo sapiens; identical to SEQ ID NO: 14459

SEQ ID NO: 14475 - DNA, 201 bp, Homo sapiens; identical to SEQ ID NO: 14460

SEQ ID NO: 14476 - DNA, 201 bp, Homo sapiens; identical to SEQ ID NO: 14434

SEQ ID NO: 14477 - DNA, 144 bp, Homo sapiens; identical to SEQ ID NO: 14435

SEQ ID NO: 14478 - DNA, 201 bp, Homo sapiens; identical to SEQ ID NO: 14436

SEQ ID NO: 14479 - DNA, 201 bp, Homo sapiens; identical to SEQ ID NO: 14424

SEQ ID NO: 14480 - DNA, 201 bp, Homo sapiens; identical to SEQ ID NO: 14425

SEQ ID NO: 14481 - DNA, 201 bp, Homo sapiens; identical to SEQ ID NO: 14426

SEQ ID NO: 14482 - DNA, 201 bp, Homo sapiens; identical to SEQ ID NO: 14427

SEQ ID NO: 14483 - DNA, 201 bp, Homo sapiens; identical to SEQ ID NO: 14428

SEQ ID NO: 14484 - DNA, 201 bp, Homo sapiens; identical to SEQ ID NO: 14429

SEQ ID NO: 14485 - DNA, 201 bp, Homo sapiens; identical to SEQ ID NO: 14430

SEQ ID NO: 14486 - DNA, 201 bp, Homo sapiens; identical to SEQ ID NO: 14431

SEQ ID NO: 14487 - DNA, 201 bp, Homo sapiens; identical to SEQ ID NO: 14432

SEQ ID NO: 14488 - DNA, 201 bp, Homo sapiens; identical to SEQ ID NO: 14433

SEQ ID NO: 14489 - DNA, 201 bp, Homo sapiens; identical to SEQ ID NO: 14434

SEQ ID NO: 14490 - DNA, 144 bp, Homo sapiens; identical to SEQ ID NO: 14435

SEQ ID NO: 14491 - DNA, 201 bp, Homo sapiens; identical to SEQ ID NO: 14436

SEQ ID NO: 14492 - DNA, 201 bp, Homo sapiens; identical to SEQ ID NO: 14424

SEQ ID NO: 14493 - DNA, 201 bp, Homo sapiens; identical to SEQ ID NO: 14425

SEQ ID NO: 14494 - DNA, 201 bp, Homo sapiens; identical to SEQ ID NO: 14426

SEQ ID NO: 14495 - DNA, 201 bp, Homo sapiens; identical to SEQ ID NO: 14427

SEQ ID NO: 14496 - DNA, 201 bp, Homo sapiens; identical to SEQ ID NO: 14428

SEQ ID NO: 14497 - DNA, 201 bp, Homo sapiens; identical to SEQ ID NO: 14455

SEQ ID NO: 14498 - DNA, 201 bp, Homo sapiens; identical to SEQ ID NO: 14430

SEQ ID NO: 14499 - DNA, 201 bp, Homo sapiens; identical to SEQ ID NO: 14431

SEQ ID NO: 14500 - DNA, 201 bp, Homo sapiens; identical to SEQ ID NO: 14458

SEQ ID NO: 14501 - DNA, 201 bp, Homo sapiens; identical to SEQ ID NO: 14459

SEQ ID NO: 14502 - DNA, 201 bp, Homo sapiens; identical to SEQ ID NO: 14460

SEQ ID NO: 14503 - DNA, 201 bp, Homo sapiens; identical to SEQ ID NO: 14434

SEQ ID NO: 14504 - DNA, 144 bp, Homo sapiens; identical to SEQ ID NO: 14435

SEQ ID NO: 14505 - DNA, 201 bp, Homo sapiens; identical to SEQ ID NO: 14436

SEQ ID NO: 14506 - DNA, 201 bp, Homo sapiens
ctcttaaatgcttagggaatggcaaccctcccccagaggaatttttgttttacttaccaggacagcccgaaggaataagaagctcaaatacttacacactracggatgtgaggcgcaatgcaacaggagactacaagtgttccctgatagacaaaaaaagcatgattgcttcaacagccatcacagttcactatttggatt

SEQ ID NO: 14507 - DNA, 201 bp, Homo sapiens
gaagctcaaatacttacacactaacggatgtgaggcgcaatgcaacaggagactacaagtgttccctgatagacaaaaaaagcatgattgcttcaacagcyatcacagttcactatttggatttgtccttaaacccaagtggagaagtgactagacagattggtgatgccctacccgtgtcatgcacaatatctgctagca

SEQ ID NO: 14508 - DNA, 201 bp, Homo sapiens
tccacttgcaatggttaattaagtccaaaaacagctgtcagaacctcgagagcagaacatgagaaactcagagctctggaccgaaagcagaaagtttgccrggaaaaaaaaagacaacattattaccatcgattcagtgcctggataaagaggaaagcttacttgtttaatggcagccacatgcacgaagatgctaagaag

SEQ ID NO: 14509 - DNA, 201 bp, Homo sapiens
agcccaggggacggtgtgtctgggagaagacgctgcccctgcgtcgggacccgccagcgcgcgggcaccgcggggcccgggacgacgccccctcctgcggygtggactccgtcagtggcccaccaagaaggaggaggaatatggaatccaagggggccagttcctgccgtctgctcttctgcctcttgatctccgccaccg

SEQ ID NO: 14510 - DNA, 201 bp, Homo sapiens
gggccagttcctgccgtctgctcttctgcctcttgatctccgccaccgtcttcaggccaggccttggatggtatactgtaaattcagcatatggagatacmattatcataccttgccgacttgacgtacctcagaatctcatgtttggcaaatggaaatatgaaaagcccgatggctccccagtatttattgccttcagat

SEQ ID NO: 14511 - DNA, 201 bp, Homo sapiens
cttaaatgcttagggaatggcaaccctcccccagaggaatttttgttttacttaccaggacagcccgaaggaataagaagctcaaatacttacacactaayggatgtgaggcgcaatgcaacaggagactacaagtgttccctgatagacaaaaaaagcatgattgcttcaacagccatcacagttcactatttggatttg

SEQ ID NO: 14512 - DNA, 201 bp, Homo sapiens
cgtttaataaaagcttccgtagtgcattggtatggattaaatgcataaaatattcttagactcgatgctgtataaaatattatgggaaaaaaagaaaataygttattttgcctctaaacttttattgaagttttatttggcaggaaaaaaaattgaatcttggtcaacatttaaaccaaagtaaaaggggaaaaaccaaag

SEQ ID NO: 14513 - DNA, 201 bp, Homo sapiens
cggtgacatattatggaccatctggccagaaaacaattcattctgaacaggcagtatttgatatttactatcctacagagcaggtgacaatacaagtgctrccaccaaaaaatgccatcaaagaaggggataacatcactcttaaatgcttagggaatggcaaccctcccccagaggaatttttgttttacttaccaggac

SEQ ID NO: 14514 - DNA, 201 bp, Homo sapiens
tgtccttaaacccaagtggagaagtgactagacagattggtgatgccctacccgtgtcatgcacaatatctgctagcaggaatgcaactgtggtatggatkaaagataacatcaggcttcgatctagcccgtcattttctagtcttcattatcaggatgctggaaactatgtctgcgaaactgctctgcaggaggttgaag

SEQ ID NO: 14515 - DNA, 167 bp, Homo sapiens
caacttttgaggtttcggctctccaatttaactctttggcaacaggaaacaggttttgcaagttcaaggttcactccctatatgtgattataggaattgtwtgtggaaatggattaacatacccgtctatgcctaaaagataataaaactgaaatatgtcttcacag

SEQ ID NO: 14516 - DNA, 201 bp, Homo sapiens
ctgctctgcaggaggttgaaggactaaagaaaagagagtcattgactctcattgtagaaggcaaacctcaaataaaaatgacaaagaaaactgatcccagyggactatctaaaacaataatctgccatgtggaaggttttccaaagccagccattcaatggacaattactggcagtggaagcgtcataaaccaagcaaagg

SEQ ID NO: 14517 - DNA, 201 bp, Homo sapiens
ggcgcaatgcaacaggagactacaagtgttccctgatagacaaaaaaagcatgattgcttcaacagccatcacagttcactatttggatttgtccttaaayccaagtggagaagtgactagacagattggtgatgccctacccgtgtcatgcacaatatctgctagcaggaatgcaactgtggtatggatgaaagataaca

SEQ ID NO: 14518 - DNA, 201 bp, Homo sapiens
aatgcttagggaatggcaaccctcccccagaggaatttttgttttacttaccaggacagcccgaaggaataagaagctcaaatacttacacactaacggaygtgaggcgcaatgcaacaggagactacaagtgttccctgatagacaaaaaaagcatgattgcttcaacagccatcacagttcactatttggatttgtcct

SEQ ID NO: 14519 - DNA, 201 bp, Homo sapiens
aaagtttgccgggaaaaaaaaagacaacattattaccatcgattcagtgcctggataaagaggaaagcttacttgtttaatggcagccacatgcacgaagrtgctaagaagaaaaagaattccaaatcctcaacttttgaggtttcggctctccaatttaactctttggcaacaggaaacaggttttgcaagttcaaggtt

SEQ ID NO: 14520 - DNA, 201 bp, Homo sapiens
tatggaccatctggccagaaaacaattcattctgaacaggcagtatttgatatttactatcctacagagcaggtgacaatacaagtgctgccaccaaaaartgccatcaaagaaggggataacatcactcttaaatgcttagggaatggcaaccctcccccagaggaatttttgttttacttaccaggacagcccgaagga

SEQ ID NO: 14521 - DNA, 201 bp, Homo sapiens
aaggcaaacctcaaataaaaatgacaaagaaaactgatcccagtggactatctaaaacaataatctgccatgtggaaggttttccaaagccagccattcartggacaattactggcagtggaagcgtcataaaccaagcaaaggaatctccttatattaatggcaggtattatagtaaaattatcatttcccctgaagaga

SEQ ID NO: 14522 - DNA, 201 bp, Homo sapiens; identical to SEQ ID NO: 14506

SEQ ID NO: 14523 - DNA, 201 bp, Homo sapiens; identical to SEQ ID NO: 14507

SEQ ID NO: 14524 - DNA, 201 bp, Homo sapiens; identical to SEQ ID NO: 14508

SEQ ID NO: 14525 - DNA, 201 bp, Homo sapiens; identical to SEQ ID NO: 14509

SEQ ID NO: 14526 - DNA, 201 bp, Homo sapiens; identical to SEQ ID NO: 14510

SEQ ID NO: 14527 - DNA, 201 bp, Homo sapiens; identical to SEQ ID NO: 14511

SEQ ID NO: 14528 - DNA, 201 bp, Homo sapiens; identical to SEQ ID NO: 14512

SEQ ID NO: 14529 - DNA, 201 bp, Homo sapiens; identical to SEQ ID NO: 14513

SEQ ID NO: 14530 - DNA, 201 bp, Homo sapiens; identical to SEQ ID NO: 14514

SEQ ID NO: 14531 - DNA, 167 bp, Homo sapiens; identical to SEQ ID NO: 14515

SEQ ID NO: 14532 - DNA, 201 bp, Homo sapiens; identical to SEQ ID NO: 14516

SEQ ID NO: 14533 - DNA, 201 bp, Homo sapiens; identical to SEQ ID NO: 14517

SEQ ID NO: 14534 - DNA, 201 bp, Homo sapiens; identical to SEQ ID NO: 14518

SEQ ID NO: 14535 - DNA, 201 bp, Homo sapiens; identical to SEQ ID NO: 14519

SEQ ID NO: 14536 - DNA, 201 bp, Homo sapiens; identical to SEQ ID NO: 14520

SEQ ID NO: 14537 - DNA, 201 bp, Homo sapiens; identical to SEQ ID NO: 14521

SEQ ID NO: 14538 - DNA, 201 bp, Homo sapiens; identical to SEQ ID NO: 14506

SEQ ID NO: 14539 - DNA, 201 bp, Homo sapiens; identical to SEQ ID NO: 14507

SEQ ID NO: 14540 - DNA, 136 bp, Homo sapiens
gttctctctctctttctctcttcttccttttttttttcccccaaaggccttggatggtatactgtaaattcagcatatggagataccattatcataccttgccgacttgacgtacctcagaatctcatgtttggca

SEQ ID NO: 14541 - DNA, 201 bp, Homo sapiens; identical to SEQ ID NO: 14508

SEQ ID NO: 14542 - DNA, 137 bp, Homo sapiens
gttctctctctctttctctcttcttcctttttttttycccccaaaggccttggatggtatactgtaaattcagcatatggagataccattatcataccttgccgacttgacgtacctcagaatctcatgtttggcaa

SEQ ID NO: 14543 - DNA, 187 bp, Homo sapiens
gttctctctctctttctctcttcttccttttttttttcccccaaaggccttggatggtatactgtaaattcagcatatggagatacmattatcataccttgccgacttgacgtacctcagaatctcatgtttggcaaatggaaatatgaaaagcccgatggctccccagtatttattgccttcagat

SEQ ID NO: 14544 - DNA, 201 bp, Homo sapiens; identical to SEQ ID NO: 14511

SEQ ID NO: 14545 - DNA, 201 bp, Homo sapiens; identical to SEQ ID NO: 14512

SEQ ID NO: 14546 - DNA, 201 bp, Homo sapiens; identical to SEQ ID NO: 14513

SEQ ID NO: 14547 - DNA, 201 bp, Homo sapiens; identical to SEQ ID NO: 14514

SEQ ID NO: 14548 - DNA, 167 bp, Homo sapiens; identical to SEQ ID NO: 14515

SEQ ID NO: 14549 - DNA, 201 bp, Homo sapiens; identical to SEQ ID NO: 14516

SEQ ID NO: 14550 - DNA, 201 bp, Homo sapiens; identical to SEQ ID NO: 14517

SEQ ID NO: 14551 - DNA, 201 bp, Homo sapiens; identical to SEQ ID NO: 14518

SEQ ID NO: 14552 - DNA, 201 bp, Homo sapiens; identical to SEQ ID NO: 14519

SEQ ID NO: 14553 - DNA, 201 bp, Homo sapiens; identical to SEQ ID NO: 14520

SEQ ID NO: 14554 - DNA, 201 bp, Homo sapiens; identical to SEQ ID NO: 14521

SEQ ID NO: 14555 - DNA, 201 bp, Homo sapiens
gaagctcaaatacttacacactgatggatgtgaggcgcaatgcaacaggagactacaagtgttccctgatagacaaaaaaagcatgattgcttcaacagcyatcacagttcactatttggatttgtccttaaacccaagtggagaagtgactagacagattggtgatgccctacccgtgtcatgcacaatatctgctagca

SEQ ID NO: 14556 - DNA, 201 bp, Homo sapiens; identical to SEQ ID NO: 14520

SEQ ID NO: 14557 - DNA, 201 bp, Homo sapiens
cttaaatgcttagggaatggcaaccctcccccagaggaatttttgttttacttaccaggacagcccgaaggaataagaagctcaaatacttacacactgayggatgtgaggcgcaatgcaacaggagactacaagtgttccctgatagacaaaaaaagcatgattgcttcaacagccatcacagttcactatttggatttg

SEQ ID NO: 14558 - DNA, 201 bp, Homo sapiens
ctgctctgcaggaggttgaaggactaaagaaaagagagtcattgactctcattgtagaaggcaaacctcaaataaaaatgacaaagaaaactgatcccagyggactatctaaaacaataatctgccatgtggaaggttttccaaagccagccattcagtggacaattactggcagtggaagcgtcataaaccaaacagagg

SEQ ID NO: 14559 - DNA, 201 bp, Homo sapiens
aaggcaaacctcaaataaaaatgacaaagaaaactgatcccagtggactatctaaaacaataatctgccatgtggaaggttttccaaagccagccattcartggacaattactggcagtggaagcgtcataaaccaaacagaggaatctccttatattaatggcaggtattatagtaaaattatcatttcccctgaagaga

SEQ ID NO: 14560 - DNA, 201 bp, Homo sapiens; identical to SEQ ID NO: 14510

SEQ ID NO: 14561 - DNA, 201 bp, Homo sapiens; identical to SEQ ID NO: 14514

SEQ ID NO: 14562 - DNA, 201 bp, Homo sapiens; identical to SEQ ID NO: 14517

SEQ ID NO: 14563 - DNA, 201 bp, Homo sapiens
aatgcttagggaatggcaaccctcccccagaggaatttttgttttacttaccaggacagcccgaaggaataagaagctcaaatacttacacactgatggaygtgaggcgcaatgcaacaggagactacaagtgttccctgatagacaaaaaaagcatgattgcttcaacagccatcacagttcactatttggatttgtcct

SEQ ID NO: 14564 - DNA, 201 bp, Homo sapiens; identical to SEQ ID NO: 14513

SEQ ID NO: 14565 - DNA, 201 bp, Homo sapiens
ctcttaaatgcttagggaatggcaaccctcccccagaggaatttttgttttacttaccaggacagcccgaaggaataagaagctcaaatacttacacactratggatgtgaggcgcaatgcaacaggagactacaagtgttccctgatagacaaaaaaagcatgattgcttcaacagccatcacagttcactatttggatt

SEQ ID NO: 14566 - DNA, 201 bp, Homo sapiens
acccccttcgatgacctccagagcctcccaaacgacgtgatctcttccctgaagaacaggctgaaaaaggtctccacaaccactggggatggtgtggccaragcgttcctcaaggcccaggctgctttcttcggtagctaccgaaacgctctgaaaatcgagccggaggagccgatcactttctgtgaggaagccttcgtg

SEQ ID NO: 14567 - DNA, 201 bp, Homo sapiens
aagaacaggctgaaaaaggtctccacaaccactggggatggtgtggccagagcgttcctcaaggcccaggctgctttcttcggtagctaccgaaacgctcygaaaatcgagccggaggagccgatcactttctgtgaggaagccttcgtgtcccactaccgctccggagccatgaggcagttcctgcagaacgccacacag

SEQ ID NO: 14568 - DNA, 201 bp, Homo sapiens
ggcctggggaccatgggctccaggatcaagcagaatccagagaccacatttgaagtatatgttgaagtggcctatcccaggacaggtggcactctttcagrtcctgaggtgcagaggcaattcccggaggactacagtgaccaggaagttctacagactttgaccaagttttgtttccccttctatgtggacagcctcaca

SEQ ID NO: 14569 - DNA, 201 bp, Homo sapiens
atccacgggtctgcggcgatgctctaccccatgtactggcagcacgtgtacatccccgtgctgccgccgcatctgctggactactgctgtgctcccatgcrctacctcataggaatccatttaagtttaatggagaaagtcagaaacatggccctggatgatgtcgtgatcctgaatgtggacaccaacaccctggaaacc

SEQ ID NO: 14570 - DNA, 201 bp, Homo sapiens
atccccgtgctgccgccgcatctgctggactactgctgtgctcccatgccctacctcataggaatccatttaagtttaatggagaaagtcagaaacatggycctggatgatgtcgtgatcctgaatgtggacaccaacaccctggaaacccccttcgatgacctccagagcctcccaaacgacgtgatctcttccctgaag

SEQ ID NO: 14571 - DNA, 201 bp, Homo sapiens
gggctggagcgagtacattaacccctggaggcggcggcggcggcgagggagcgagcctcgagcgggcgggccccagcctgagggaagggaggaaggggcgrggagagcgccagagggaggccggtcggccgcgggcgggcgggcagcgcagcgccgagcggggcccgcgggcccatgaggaggcctggggaccatgggctc

SEQ ID NO: 14572 - DNA, 201 bp, Homo sapiens
ccgatcactttctgtgaggaagccttcgtgtcccactaccgctccggagccatgaggcagttcctgcagaacgccacacagctgcagctcttcaagcagtrtattgatggtcgattagatcttctcaattccggcgaaggtttcagtgatgtttttgaagaggaaatcaacatgggcgagtacgctggcagtgacaaactg

SEQ ID NO: 14573 - DNA, 201 bp, Homo sapiens
atgaggcagttcctgcagaacgccacacagctgcagctcttcaagcagtttattgatggtcgattagatcttctcaattccggcgaaggtttcagtgatgyttttgaagaggaaatcaacatgggcgagtacgctggcagtgacaaactgtaccatcagtggctctccactgtccggaaaggaagtggagcaattctgaat

SEQ ID NO: 14574 - DNA, 201 bp, Homo sapiens
tgtttccccttctatgtggacagcctcacagttagccaagttggccagaacttcacattcgtgctcactgacattgacagcaaacagagattcgggttctrccgcttatcttcaggagcgaagagctgcttctgtatcttaagctatctcccctggttcgaggtattttataagctgcttaacatcctggcagattacacg

SEQ ID NO: 14575 - DNA, 201 bp, Homo sapiens
ccactgggccaggccaagagcttagaggaccttcgtgcccccaaagacctgagggagcagccagggacctttgactatcagaggctggatctgggcgggartgagaggagccgcggggtgacagtggccttgaagcttacccacccgtacaacaagctctggagcctgggccaggacgacatggccatccccagcaagccc

SEQ ID NO: 14576 - DNA, 201 bp, Homo sapiens; identical to SEQ ID NO: 14566

SEQ ID NO: 14577 - DNA, 201 bp, Homo sapiens
agcatttcgacccgagctctcatttcctatttgtgaagggtcagacacagtctacccaggggtgtctgggggacaagggggtctctggagatgtcacccakggagccccctctatgtctgagaggctgccactgctgcacatgctcagtgaggcttggcggccatcctggcacatggctcttcctgggtcaaccgtgacct

SEQ ID NO: 14578 - DNA, 201 bp, Homo sapiens
gccaagagcttagaggaccttcgtgcccccaaagacctgagggagcagccagggacctttgactatcagaggctggatctgggcgggagtgagaggagccrcggggtgacagtggccttgaagcttacccacccgtacaacaagctctggagcctgggccaggacgacatggccatccccagcaagcccccagctgcctcc

SEQ ID NO: 14579 - DNA, 201 bp, Homo sapiens; identical to SEQ ID NO: 14567

SEQ ID NO: 14580 - DNA, 201 bp, Homo sapiens; identical to SEQ ID NO: 14568

SEQ ID NO: 14581 - DNA, 201 bp, Homo sapiens
aagactgcaccgtccccactggtggaggccaaggaccccaagctccgagaagaccggcggccaatcacagtccactttggacaggtgcgcccacctcgtcracatgttgttaagagaccaaagagcaacatcgcagtggaaggccggaggacgtctgtgccgagccctgagcagccgcagccgtatcggacactcagggag

SEQ ID NO: 14582 - DNA, 201 bp, Homo sapiens
ctcccaggccccctcaaggcctggagccaacactgcagccctctgctcctcaacaggccagagacccctttgaggatttgttacagaaaaccaagcaagaygtgagcccgagtccggccctggccccggccccagactcggtggagcagctcaggaagcagtgggagaccttcgagtgagccgggccctgagggtggggga

SEQ ID NO: 14583 - DNA, 201 bp, Homo sapiens; identical to SEQ ID NO: 14566

SEQ ID NO: 14584 - DNA, 201 bp, Homo sapiens; identical to SEQ ID NO: 14567

SEQ ID NO: 14585 - DNA, 201 bp, Homo sapiens; identical to SEQ ID NO: 14568

SEQ ID NO: 14586 - DNA, 201 bp, Homo sapiens
aagactgcaccgtccccactggtggaggccaaggaccccaagctccgagaagaccggcggccaatcacagtccactttggacaggtgcgcccacctcgtcracatgttgttaagagaccaaagagcaacatcgcagtggaaggccggaggacgtctgtgccgagccctgagcaaaacaccattgcaacaccagctacactc

SEQ ID NO: 14587 - DNA, 201 bp, Homo sapiens
ccatcgagcggcacttgacaatgatcaaaatgaggccttacgacgccaacaagaggcaccgcgtcttcctcctgatcgggatgtgctggctcattgccttyacgctgggcgccctgcccattctgggctggaactgcctgcacaatctccctgactgctctaccatcctgcccctctactccaagaagtacattgccttct

SEQ ID NO: 14588 - DNA, 201 bp, Homo sapiens
atcgagcggcacttgacaatgatcaaaatgaggccttacgacgccaacaagaggcaccgcgtcttcctcctgatcgggatgtgctggctcattgccttcaygctgggcgccctgcccattctgggctggaactgcctgcacaatctccctgactgctctaccatcctgcccctctactccaagaagtacattgccttctgc

SEQ ID NO: 14589 - DNA, 201 bp, Homo sapiens
actgcctgcacaatctccctgactgctctaccatcctgcccctctactccaagaagtacattgccttctgcatcagcatcttcacggccatcctggtgacsatcgtgatcctctacgcacgcatctacttcctggtgaagtccagcagccgtaaggtggccaaccacaacaactcggagcggtccatggcactgctgcgga

SEQ ID NO: 14590 - DNA, 201 bp, Homo sapiens
accatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatc

SEQ ID NO: 14591 - DNA, 201 bp, Homo sapiens; identical to SEQ ID NO: 14587

SEQ ID NO: 14592 - DNA, 201 bp, Homo sapiens; identical to SEQ ID NO: 14588

SEQ ID NO: 14593 - DNA, 201 bp, Homo sapiens; identical to SEQ ID NO: 14589

SEQ ID NO: 14594 - DNA, 201 bp, Homo sapiens; identical to SEQ ID NO: 14590

SEQ ID NO: 14595 - DNA, 201 bp, Homo sapiens
ggggttctgcatggctgttagggaacctgaccatctgcagcgcgtctcgttgccaaggatggtctacccccagccaaaggtgctgacaccgtgtaggaagkatgtcctcgtggtgaccccttggctggctcccattgtctgggagggcacattcaacatcgacatcctcaacgagcagttcaggctccagaacaccaccat

SEQ ID NO: 14596 - DNA, 201 bp, Homo sapiens
ggagacggcggagaagcacttcatggtgggccaccgtgtccactactatgtcttcaccgaccagccggccgcggtgccccgcgtgacgctggggaccggtsggcagctgtcagtgctggaggtgcgcgcctacaagcgctggcaggacgtgtccatgcgccgcatggagatgatcagtgacttctgcgagcggcgcttcct

SEQ ID NO: 14597 - DNA, 201 bp, Homo sapiens
ggtgggccaccgtgtccactactatgtcttcaccgaccagccggccgcggtgccccgcgtgacgctggggaccggtcggcagctgtcagtgctggaggtgsgcgcctacaagcgctggcaggacgtgtccatgcgccgcatggagatgatcagtgacttctgcgagcggcgcttcctcagcgaggtggattacctggtgtg

SEQ ID NO: 14598 - DNA, 201 bp, Homo sapiens
tgcgccgcatggagatgatcagtgacttctgcgagcggcgcttcctcagcgaggtggattacctggtgtgcgtggacgtggacatggagttccgcgaccaygtgggcgtggagatcctgactccgctgttcggcaccctgcaccccggcttctacggaagcagccgggaggccttcacctacgagcgccggccccagtccc

SEQ ID NO: 14599 - DNA, 201 bp, Homo sapiens
tcttgtttggttacggggtcctaagccccagaagtctaatgccaggaagcctggaacgggggttctgcatggctgttagggaacctgaccatctgcagcgygtctcgttgccaaggatggtctacccccagccaaaggtgctgacaccgtgtaggaaggatgtcctcgtggtgaccccttggctggctcccattgtctggg

SEQ ID NO: 14600 - DNA, 201 bp, Homo sapiens
gtcttgtttggttacggggtcctaagccccagaagtctaatgccaggaagcctggaacgggggttctgcatggctgttagggaacctgaccatctgcagcrcgtctcgttgccaaggatggtctacccccagccaaaggtgctgacaccgtgtaggaaggatgtcctcgtggtgaccccttggctggctcccattgtctgg

SEQ ID NO: 14601 - DNA, 201 bp, Homo sapiens
tttagcagaacgggtaaactctgtttcctttgtccgtcctgttgtgagtaactgaagcctaggccccgtccccacctcaaatcacacacaccccctccccrccacagagacaccattacatacacagacacacacagaaagacacacacagacacaaaatcacacacacaccctccccgccacagagacaccattacatac

SEQ ID NO: 14602 - DNA, 201 bp, Homo sapiens
ggacgtgtccatgcgccgcatggagatgatcagtgacttctgcgagcggcgcttcctcagcgaggtggattacctggtgtgcgtggacgtggacatggagwtccgcgaccacgtgggcgtggagatcctgactccgctgttcggcaccctgcaccccggcttctacggaagcagccgggaggccttcacctacgagcgccg

SEQ ID NO: 14603 - DNA, 201 bp, Homo sapiens
tgcagcggctcaccagggcctgccaccaggccatgatggtcgaccaggccaacggcatcgaggccgtgtggcacgacgagagccacctgaacaagtacctrctgcgccacaaacccaccaaggtgctctcccccgagtacttgtgggaccagcagctgctgggctggcccgccgtcctgaggaagctgaggttcactgcgg

SEQ ID NO: 14604 - DNA, 201 bp, Homo sapiens
gctttcctgaagctgttcctggagacggcggagaagcacttcatggtgggccaccgtgtccactactatgtcttcaccgaccagccggccgcggtgccccrcgtgacgctggggaccggtcggcagctgtcagtgctggaggtgcgcgcctacaagcgctggcaggacgtgtccatgcgccgcatggagatgatcagtgac

SEQ ID NO: 14605 - DNA, 201 bp, Homo sapiens
tggacgtggacatggagttccgcgaccacgtgggcgtggagatcctgactccgctgttcggcaccctgcaccccggcttctacggaagcagccgggaggcyttcacctacgagcgccggccccagtcccaggcctacatccccaaggacgagggcgatttctactacctgggggggttcttcggggggtcggtgcaagagg

SEQ ID NO: 14606 - DNA, 201 bp, Homo sapiens
agatcctgactccgctgttcggcaccctgcaccccggcttctacggaagcagccgggaggccttcacctacgagcgccggccccagtcccaggcctacatmcccaaggacgagggcgatttctactacctgggggggttcttcggggggtcggtgcaagaggtgcagcggctcaccagggcctgccaccaggccatgatgg

SEQ ID NO: 14607 - DNA, 201 bp, Homo sapiens
tgccaaggatggtctacccccagccaaaggtgctgacaccgtgtaggaaggatgtcctcgtggtgaccccttggctggctcccattgtctgggagggcacrttcaacatcgacatcctcaacgagcagttcaggctccagaacaccaccattgggttaactgtgtttgccatcaagaaatacgtggctttcctgaagctgt

SEQ ID NO: 14608 - DNA, 201 bp, Homo sapiens
aagtctaatgccaggaagcctggaacgggggttctgcatggctgttagggaacctgaccatctgcagcgcgtctcgttgccaaggatggtctacccccagycaaaggtgctgacaccgtgtaggaaggatgtcctcgtggtgaccccttggctggctcccattgtctgggagggcacattcaacatcgacatcctcaacga

SEQ ID NO: 14609 - DNA, 201 bp, Homo sapiens
agccaaaggtgctgacaccgtgtaggaaggatgtcctcgtggtgaccccttggctggctcccattgtctgggagggcacattcaacatcgacatcctcaaygagcagttcaggctccagaacaccaccattgggttaactgtgtttgccatcaagaaatacgtggctttcctgaagctgttcctggagacggcggagaagc

SEQ ID NO: 14610 - DNA, 157 bp, Homo sapiens
agacgcggagccatggccgaggtgttgcggacgctggccggaaaaccaaaatgccaygcacttcgacctatgatccttttcctaataatgcttgtcttggtcttgtttggttacggggtcctaagccccagaagtctaatgccaggaagcctggaac

SEQ ID NO: 14611 - DNA, 201 bp, Homo sapiens
tggcaggacgtgtccatgcgccgcatggagatgatcagtgacttctgcgagcggcgcttcctcagcgaggtggattacctggtgtgcgtggacgtggacakggagttccgcgaccacgtgggcgtggagatcctgactccgctgttcggcaccctgcaccccggcttctacggaagcagccgggaggccttcacctacgag

SEQ ID NO: 14612 - DNA, 201 bp, Homo sapiens
acttctgcgagcggcgcttcctcagcgaggtggattacctggtgtgcgtggacgtggacatggagttccgcgaccacgtgggcgtggagatcctgactccrctgttcggcaccctgcaccccggcttctacggaagcagccgggaggccttcacctacgagcgccggccccagtcccaggcctacatccccaaggacgagg

SEQ ID NO: 14613 - DNA, 201 bp, Homo sapiens
agatgatcagtgacttctgcgagcggcgcttcctcagcgaggtggattacctggtgtgcgtggacgtggacatggagttccgcgaccacgtgggcgtggakatcctgactccgctgttcggcaccctgcaccccggcttctacggaagcagccgggaggccttcacctacgagcgccggccccagtcccaggcctacatcc

SEQ ID NO: 14614 - DNA, 201 bp, Homo sapiens
cctcagcgaggtggattacctggtgtgcgtggacgtggacatggagttccgcgaccacgtgggcgtggagatcctgactccgctgttcggcaccctgcacyccggcttctacggaagcagccgggaggccttcacctacgagcgccggccccagtcccaggcctacatccccaaggacgagggcgatttctactacctggg

SEQ ID NO: 14615 - DNA, 201 bp, Homo sapiens
cggcttctacggaagcagccgggaggccttcacctacgagcgccggccccagtcccaggcctacatccccaaggacgagggcgatttctactacctggggrggttcttcggggggtcggtgcaagaggtgcagcggctcaccagggcctgccaccaggccatgatggtcgaccaggccaacggcatcgaggccgtgtggca

SEQ ID NO: 14616 - DNA, 201 bp, Homo sapiens
caaggacgagggcgatttctactacctgggggggttcttcggggggtcggtgcaagaggtgcagcggctcaccagggcctgccaccaggccatgatggtcraccaggccaacggcatcgaggccgtgtggcacgacgagagccacctgaacaagtacctgctgcgccacaaacccaccaaggtgctctcccccgagtactt

SEQ ID NO: 14617 - DNA, 201 bp, Homo sapiens
ctctcccccgagtacttgtgggaccagcagctgctgggctggcccgccgtcctgaggaagctgaggttcactgcggtgcccaagaaccaccaggcggtccbggaacccgtgagcggctgccaggggctctgggagggctgccggcagccccgtccccctcccgcccttggttttagcagaacgggtaaactctgtttcctt

SEQ ID NO: 14618 - DNA, 201 bp, Homo sapiens
cccgccgtcctgaggaagctgaggttcactgcggtgcccaagaaccaccaggcggtcccggaacccgtgagcggctgccaggggctctgggagggctgccrgcagccccgtccccctcccgcccttggttttagcagaacgggtaaactctgtttcctttgtccgtcctgttgtgagtaactgaagcctaggccccgtccc

SEQ ID NO: 14619 - DNA, 201 bp, Homo sapiens
gcaccccggcttctacggaagcagccgggaggccttcacctacgagcgccggccccagtcccaggcctacatccccaaggacgagggcgatttctactacmtgggggggttcttcggggggtcggtgcaagaggtgcagcggctcaccagggcctgccaccaggccatgatggtcgaccaggccaacggcatcgaggccgt

SEQ ID NO: 14620 - DNA, 201 bp, Homo sapiens
tcctgactccgctgttcggcaccctgcaccccggcttctacggaagcagccgggaggccttcacctacgagcgccggccccagtcccaggcctacatcccyaaggacgagggcgatttctactacctgggggggttcttcggggggtcggtgcaagaggtgcagcggctcaccagggcctgccaccaggccatgatggtcg

SEQ ID NO: 14621 - DNA, 201 bp, Homo sapiens
ggcttctacggaagcagccgggaggccttcacctacgagcgccggccccagtcccaggcctacatccccaaggacgagggcgatttctactacctgggggsgttcttcggggggtcggtgcaagaggtgcagcggctcaccagggcctgccaccaggccatgatggtcgaccaggccaacggcatcgaggccgtgtggcac

SEQ ID NO: 14622 - DNA, 201 bp, Homo sapiens
cttcacctacgagcgccggccccagtcccaggcctacatccccaaggacgagggcgatttctactacctgggggggttcttcggggggtcggtgcaagagrtgcagcggctcaccagggcctgccaccaggccatgatggtcgaccaggccaacggcatcgaggccgtgtggcacgacgagagccacctgaacaagtacct

SEQ ID NO: 14623 - DNA, 201 bp, Homo sapiens
ggccgaggtgttgcggacgctggccggaaaaccaaaatgccacgcacttcgacctatgatccttttcctaataatgcttgtcttggtcttgtttggttacrgggtcctaagccccagaagtctaatgccaggaagcctggaacgggggttctgcatggctgttagggaacctgaccatctgcagcgcgtctcgttgccaag

SEQ ID NO: 14624 - DNA, 201 bp, Homo sapiens
cgaggtgttgcggacgctggccggaaaaccaaaatgccacgcacttcgacctatgatccttttcctaataatgcttgtcttggtcttgtttggttacgggktcctaagccccagaagtctaatgccaggaagcctggaacgggggttctgcatggctgttagggaacctgaccatctgcagcgcgtctcgttgccaaggat

SEQ ID NO: 14625 - DNA, 201 bp, Homo sapiens
cagcgaggtggattacctggtgtgcgtggacgtggacatggagttccgcgaccacgtgggcgtggagatcctgactccgctgttcggcaccctgcaccccrgcttctacggaagcagccgggaggccttcacctacgagcgccggccccagtcccaggcctacatccccaaggacgagggcgatttctactacctgggggg

SEQ ID NO: 14626 - DNA, 201 bp, Homo sapiens
ccccagtcccaggcctacatccccaaggacgagggcgatttctactacctgggggggttcttcggggggtcggtgcaagaggtgcagcggctcaccagggyctgccaccaggccatgatggtcgaccaggccaacggcatcgaggccgtgtggcacgacgagagccacctgaacaagtacctgctgcgccacaaacccacc

SEQ ID NO: 14627 - DNA, 201 bp, Homo sapiens
atcaagaaatacgtggctttcctgaagctgttcctggagacggcggagaagcacttcatggtgggccaccgtgtccactactatgtcttcaccgaccagcyggccgcggtgccccgcgtgacgctggggaccggtcggcagctgtcagtgctggaggtgcgcgcctacaagcgctggcaggacgtgtccatgcgccgcatg

SEQ ID NO: 14628 - DNA, 158 bp, Homo sapiens
agacgcggagccatggccgaggtgttgcggacgctggccggaaaaccaaaatgccacrcacttcgacctatgatccttttcctaataatgcttgtcttggtcttgtttggttacggggtcctaagccccagaagtctaatgccaggaagcctggaacg

SEQ ID NO: 14629 - DNA, 201 bp, Homo sapiens
gaccggtcggcagctgtcagtgctggaggtgcgcgcctacaagcgctggcaggacgtgtccatgcgccgcatggagatgatcagtgacttctgcgagcggygcttcctcagcgaggtggattacctggtgtgcgtggacgtggacatggagttccgcgaccacgtgggcgtggagatcctgactccgctgttcggcaccct

SEQ ID NO: 14630 - DNA, 201 bp, Homo sapiens; identical to SEQ ID NO: 14595

SEQ ID NO: 14631 - DNA, 201 bp, Homo sapiens; identical to SEQ ID NO: 14596

SEQ ID NO: 14632 - DNA, 201 bp, Homo sapiens; identical to SEQ ID NO: 14597

SEQ ID NO: 14633 - DNA, 201 bp, Homo sapiens; identical to SEQ ID NO: 14598

SEQ ID NO: 14634 - DNA, 201 bp, Homo sapiens; identical to SEQ ID NO: 14599

SEQ ID NO: 14635 - DNA, 201 bp, Homo sapiens; identical to SEQ ID NO: 14600

SEQ ID NO: 14636 - DNA, 201 bp, Homo sapiens; identical to SEQ ID NO: 14601

SEQ ID NO: 14637 - DNA, 201 bp, Homo sapiens; identical to SEQ ID NO: 14602

SEQ ID NO: 14638 - DNA, 201 bp, Homo sapiens; identical to SEQ ID NO: 14603

SEQ ID NO: 14639 - DNA, 201 bp, Homo sapiens; identical to SEQ ID NO: 14604

SEQ ID NO: 14640 - DNA, 201 bp, Homo sapiens; identical to SEQ ID NO: 14605

SEQ ID NO: 14641 - DNA, 201 bp, Homo sapiens; identical to SEQ ID NO: 14606

SEQ ID NO: 14642 - DNA, 201 bp, Homo sapiens; identical to SEQ ID NO: 14607

SEQ ID NO: 14643 - DNA, 201 bp, Homo sapiens; identical to SEQ ID NO: 14608

SEQ ID NO: 14644 - DNA, 201 bp, Homo sapiens; identical to SEQ ID NO: 14609

SEQ ID NO: 14645 - DNA, 157 bp, Homo sapiens; identical to SEQ ID NO: 14610

SEQ ID NO: 14646 - DNA, 201 bp, Homo sapiens; identical to SEQ ID NO: 14611

SEQ ID NO: 14647 - DNA, 201 bp, Homo sapiens; identical to SEQ ID NO: 14612

SEQ ID NO: 14648 - DNA, 201 bp, Homo sapiens; identical to SEQ ID NO: 14613

SEQ ID NO: 14649 - DNA, 201 bp, Homo sapiens; identical to SEQ ID NO: 14614

SEQ ID NO: 14650 - DNA, 201 bp, Homo sapiens; identical to SEQ ID NO: 14615

SEQ ID NO: 14651 - DNA, 201 bp, Homo sapiens; identical to SEQ ID NO: 14616

SEQ ID NO: 14652 - DNA, 201 bp, Homo sapiens; identical to SEQ ID NO: 14617

SEQ ID NO: 14653 - DNA, 201 bp, Homo sapiens; identical to SEQ ID NO: 14618

SEQ ID NO: 14654 - DNA, 201 bp, Homo sapiens; identical to SEQ ID NO: 14619

SEQ ID NO: 14655 - DNA, 201 bp, Homo sapiens; identical to SEQ ID NO: 14620

SEQ ID NO: 14656 - DNA, 201 bp, Homo sapiens; identical to SEQ ID NO: 14621

SEQ ID NO: 14657 - DNA, 201 bp, Homo sapiens; identical to SEQ ID NO: 14622

SEQ ID NO: 14658 - DNA, 201 bp, Homo sapiens; identical to SEQ ID NO: 14623

SEQ ID NO: 14659 - DNA, 201 bp, Homo sapiens; identical to SEQ ID NO: 14624

SEQ ID NO: 14660 - DNA, 201 bp, Homo sapiens; identical to SEQ ID NO: 14625

SEQ ID NO: 14661 - DNA, 201 bp, Homo sapiens; identical to SEQ ID NO: 14626

SEQ ID NO: 14662 - DNA, 201 bp, Homo sapiens; identical to SEQ ID NO: 14627

SEQ ID NO: 14663 - DNA, 158 bp, Homo sapiens; identical to SEQ ID NO: 14628

SEQ ID NO: 14664 - DNA, 201 bp, Homo sapiens; identical to SEQ ID NO: 14629

SEQ ID NO: 14665 - DNA, 201 bp, Homo sapiens; identical to SEQ ID NO: 14598

SEQ ID NO: 14666 - DNA, 201 bp, Homo sapiens; identical to SEQ ID NO: 14602

SEQ ID NO: 14667 - DNA, 201 bp, Homo sapiens; identical to SEQ ID NO: 14609

SEQ ID NO: 14668 - DNA, 201 bp, Homo sapiens; identical to SEQ ID NO: 14595

SEQ ID NO: 14669 - DNA, 201 bp, Homo sapiens
ggagacggcggagaagcacttcatggtgggccaccgtgtccactactatgtcttcaccgaccagctggccgcggtgccccgcgtgacgctggggaccggtsggcagctgtcagtgctggaggtgcgcgcctacaagcgctggcaggacgtgtccatgcgccgcatggagatgatcagtgacttctgcgagcggcgcttcct

SEQ ID NO: 14670 - DNA, 201 bp, Homo sapiens
ggtgggccaccgtgtccactactatgtcttcaccgaccagctggccgcggtgccccgcgtgacgctggggaccggtcggcagctgtcagtgctggaggtgsgcgcctacaagcgctggcaggacgtgtccatgcgccgcatggagatgatcagtgacttctgcgagcggcgcttcctcagcgaggtggattacctggtgtg

SEQ ID NO: 14671 - DNA, 201 bp, Homo sapiens; identical to SEQ ID NO: 14623

SEQ ID NO: 14672 - DNA, 201 bp, Homo sapiens; identical to SEQ ID NO: 14607

SEQ ID NO: 14673 - DNA, 201 bp, Homo sapiens; identical to SEQ ID NO: 14624

SEQ ID NO: 14674 - DNA, 201 bp, Homo sapiens; identical to SEQ ID NO: 14627

SEQ ID NO: 14675 - DNA, 201 bp, Homo sapiens; identical to SEQ ID NO: 14611

SEQ ID NO: 14676 - DNA, 201 bp, Homo sapiens; identical to SEQ ID NO: 14613

SEQ ID NO: 14677 - DNA, 201 bp, Homo sapiens; identical to SEQ ID NO: 14614

SEQ ID NO: 14678 - DNA, 201 bp, Homo sapiens; identical to SEQ ID NO: 14615

SEQ ID NO: 14679 - DNA, 201 bp, Homo sapiens; identical to SEQ ID NO: 14616

SEQ ID NO: 14680 - DNA, 201 bp, Homo sapiens; identical to SEQ ID NO: 14608

SEQ ID NO: 14681 - DNA, 201 bp, Homo sapiens; identical to SEQ ID NO: 14619

SEQ ID NO: 14682 - DNA, 201 bp, Homo sapiens; identical to SEQ ID NO: 14621

SEQ ID NO: 14683 - DNA, 201 bp, Homo sapiens; identical to SEQ ID NO: 14622

SEQ ID NO: 14684 - DNA, 201 bp, Homo sapiens; identical to SEQ ID NO: 14599

SEQ ID NO: 14685 - DNA, 201 bp, Homo sapiens; identical to SEQ ID NO: 14600

SEQ ID NO: 14686 - DNA, 201 bp, Homo sapiens; identical to SEQ ID NO: 14603

SEQ ID NO: 14687 - DNA, 201 bp, Homo sapiens; identical to SEQ ID NO: 14605

SEQ ID NO: 14688 - DNA, 201 bp, Homo sapiens; identical to SEQ ID NO: 14606

SEQ ID NO: 14689 - DNA, 201 bp, Homo sapiens; identical to SEQ ID NO: 14620

SEQ ID NO: 14690 - DNA, 201 bp, Homo sapiens; identical to SEQ ID NO: 14625

SEQ ID NO: 14691 - DNA, 201 bp, Homo sapiens; identical to SEQ ID NO: 14626

SEQ ID NO: 14692 - DNA, 201 bp, Homo sapiens; identical to SEQ ID NO: 14629

SEQ ID NO: 14693 - DNA, 201 bp, Homo sapiens
gctttcctgaagctgttcctggagacggcggagaagcacttcatggtgggccaccgtgtccactactatgtcttcaccgaccagctggccgcggtgccccrcgtgacgctggggaccggtcggcagctgtcagtgctggaggtgcgcgcctacaagcgctggcaggacgtgtccatgcgccgcatggagatgatcagtgac

SEQ ID NO: 14694 - DNA, 201 bp, Homo sapiens; identical to SEQ ID NO: 14612

SEQ ID NO: 14695 - DNA, 201 bp, Homo sapiens
ttttagtgtcatctgcaaatgaaattgatgttcgtccctgtcctcttaacccaaatgaacacaaaggcactataacttggtataaagatgacagcaagacrcctgtatctacagaacaagcctccaggattcatcaacacaaagagaaactttggtttgttcctgctaaggtggaggattcaggacattactattgcgtgg

SEQ ID NO: 14696 - DNA, 201 bp, Homo sapiens
tcaggacattactattgcgtggtaagaaattcatcttactgcctcagaattaaaataagtgcaaaatttgtggagaatgagcctaacttatgttataatgsacaagccatatttaagcagaaactacccgttgcaggagacggaggacttgtgtgcccttatatggagttttttaaaaatgaaaataatgagttacctaaa

SEQ ID NO: 14697 - DNA, 201 bp, Homo sapiens
gccatgtcgcctgcccccagcactcctctgtctctgctcttgcctgcacccttcctcctcctttgcctaggaggccttctcgcattttctctagctgatcrgaattttaccaaaattcagaacatcctccaattccacagtctctgggagactttccctaagaggcgacttcctctccagccttctctctctggtcaggcc

SEQ ID NO: 14698 - DNA, 201 bp, Homo sapiens
ctgccctgtcctccagcttcccctcgctgtcctgctgtgtgaattcccaggttggcctggtggccatgtcgcctgcccccagcactcctctgtctctgctyttgcctgcacccttcctcctcctttgcctaggaggccttctcgcattttctctagctgatcagaattttaccaaaattcagaacatcctccaattccaca

SEQ ID NO: 14699 - DNA, 201 bp, Homo sapiens
ccacttcttaatgctttcctccctggcatgaccatcctgtcctttgttattatcctgcattttacgtctttggaggaacagctccctagtggcttcctccrtctgcaatgtcccttgcacagcccacacatgaaccatccttcccatgatgccgctcttctgtcatcccgctcctgctgaaacacctcccaggggctccac

SEQ ID NO: 14700 - DNA, 201 bp, Homo sapiens
gaagtcatcttagctttccacaggagggagagaacttaaaaaagcaacagtagcagggaattgatccacttcttaatgctttcctccctggcatgaccatsctgtcctttgttattatcctgcattttacgtctttggaggaacagctccctagtggcttcctccgtctgcaatgtcccttgcacagcccacacatgaacc

SEQ ID NO: 14701 - DNA, 201 bp, Homo sapiens
agaaggaaatagccaccgtctacagatggcttagttaagtcatccacagcccaagggcggggctatgccttgtctggggaccctgtagagtcactgaccckggagcggctctcctgagaggtgctgcaggcaaagtgagactgacacctcactgaggaagggagacatattcttggagaactttccatctgcttgtatttt

SEQ ID NO: 14702 - DNA, 201 bp, Homo sapiens
ttcctgctaaggtggaggattcaggacattactattgcgtggtaagaaattcatcttactgcctcagaattaaaataagtgcaaaatttgtggagaatgarcctaacttatgttataatgcacaagccatatttaagcagaaactacccgttgcaggagacggaggacttgtgtgcccttatatggagttttttaaaaatg

SEQ ID NO: 14703 - DNA, 201 bp, Homo sapiens
gctgttcatttatggaagggatgactacgttggggaagacattgttgaggtcattaatgaaaacgtaaagaaaagcagaagactgattatcattttagtcmgagaaacatcaggcttcagctggctgggtggttcatctgaagagcaaatagccatgtataatgctcttgttcaggatggaattaaagttgtcctgcttga

SEQ ID NO: 14704 - DNA, 201 bp, Homo sapiens
acctgttttgccaagaatacacatggtatagatgcagcatatatccagttaatatatccagtcactaatttccagaagcacatgattggtatatgtgtcaygttgacagtcataattgtgtgttctgttttcatctataaaatcttcaagattgacattgtgctttggtacagggattcctgctatgattttctcccaata

SEQ ID NO: 14705 - DNA, 201 bp, Homo sapiens
catctaaacaccagttactgtcaccagccactaaggagaaactgcaaagagaggctcacgtgcctctcgggtagcatggagaagttgccaagagttctttrggtgcctcctgtcttatggcgttgcaggccaggttatgcctcatgctgacttgcagagttcatggaatgtaactatatcatcctttatccctgaggtcac

SEQ ID NO: 14706 - DNA, 201 bp, Homo sapiens
tcttgacaatatacactttagtggagtcaaagataggctcatcgtgatgaatgtggctgaaaagcatagagggaactatacttgtcatgcatcctacacayacttgggcaagcaatatcctattacccgggtaatagaatttattactctagaggaaaacaaacccacaaggcctgtgattgtgagcccagctaatgagac

SEQ ID NO: 14707 - DNA, 201 bp, Homo sapiens
gctcttgttcaggatggaattaaagttgtcctgcttgagctggagaaaatccaagactatgagaaaatgccagaatcgattaaattcattaagcagaaacrtggggctatccgctggtcaggggactttacacagggaccacagtctgcaaagacaaggttctggaagaatgtcaggtaccacatgccagtccagcgacgg

SEQ ID NO: 14708 - DNA, 201 bp, Homo sapiens
atgccagtccagcgacggtcaccttcatctaaacaccagttactgtcaccagccactaaggagaaactgcaaagagaggctcacgtgcctctcgggtagcrtggagaagttgccaagagttctttaggtgcctcctgtcttatggcgttgcaggccaggttatgcctcatgctgacttgcagagttcatggaatgtaacta

SEQ ID NO: 14709 - DNA, 201 bp, Homo sapiens
gctttggtacagggattcctgctatgattttctcccaataaaagcttcagatggaaagacctatgacgcatatatactgtatccaaagactgttggggaarggtctacctctgactgtgatatttttgtgtttaaagtcttgcctgaggtcttggaaaaacagtgtggatataagctgttcatttatggaagggatgacta

SEQ ID NO: 14710 - DNA, 201 bp, Homo sapiens
aatagaatttattactctagaggaaaacaaacccacaaggcctgtgattgtgagcccagctaatgagacaatggaagtagacttgggatcccagatacaaytgatctgtaatgtcaccggccagttgagtgacattgcttactggaagtggaatgggtcagtaattgatgaagatgacccagtgctaggggaagactatta

SEQ ID NO: 14711 - DNA, 201 bp, Homo sapiens; identical to SEQ ID NO: 14695

SEQ ID NO: 14712 - DNA, 201 bp, Homo sapiens; identical to SEQ ID NO: 14696

SEQ ID NO: 14713 - DNA, 201 bp, Homo sapiens; identical to SEQ ID NO: 14697

SEQ ID NO: 14714 - DNA, 201 bp, Homo sapiens; identical to SEQ ID NO: 14698

SEQ ID NO: 14715 - DNA, 201 bp, Homo sapiens; identical to SEQ ID NO: 14699

SEQ ID NO: 14716 - DNA, 201 bp, Homo sapiens; identical to SEQ ID NO: 14700

SEQ ID NO: 14717 - DNA, 201 bp, Homo sapiens; identical to SEQ ID NO: 14701

SEQ ID NO: 14718 - DNA, 201 bp, Homo sapiens; identical to SEQ ID NO: 14702

SEQ ID NO: 14719 - DNA, 201 bp, Homo sapiens; identical to SEQ ID NO: 14703

SEQ ID NO: 14720 - DNA, 201 bp, Homo sapiens; identical to SEQ ID NO: 14704

SEQ ID NO: 14721 - DNA, 201 bp, Homo sapiens; identical to SEQ ID NO: 14705

SEQ ID NO: 14722 - DNA, 201 bp, Homo sapiens; identical to SEQ ID NO: 14706

SEQ ID NO: 14723 - DNA, 201 bp, Homo sapiens; identical to SEQ ID NO: 14707

SEQ ID NO: 14724 - DNA, 201 bp, Homo sapiens; identical to SEQ ID NO: 14708

SEQ ID NO: 14725 - DNA, 201 bp, Homo sapiens; identical to SEQ ID NO: 14709

SEQ ID NO: 14726 - DNA, 201 bp, Homo sapiens; identical to SEQ ID NO: 14710

SEQ ID NO: 14727 - DNA, 201 bp, Homo sapiens; identical to SEQ ID NO: 14695

SEQ ID NO: 14728 - DNA, 161 bp, Homo sapiens
cttgtggccggcggccggagccgactcggagcgcgcggcgccggccgggaggagccggagmgcggccgggccgggcggtgggggcgccggcctgccccgcgcgccccagggagcggcaggaatgtgacaatcgcgcgcccgcgcaccgaagcactcctcgc

SEQ ID NO: 14729 - DNA, 201 bp, Homo sapiens; identical to SEQ ID NO: 14696

SEQ ID NO: 14730 - DNA, 201 bp, Homo sapiens; identical to SEQ ID NO: 14697

SEQ ID NO: 14731 - DNA, 201 bp, Homo sapiens; identical to SEQ ID NO: 14698

SEQ ID NO: 14732 - DNA, 201 bp, Homo sapiens; identical to SEQ ID NO: 14699

SEQ ID NO: 14733 - DNA, 201 bp, Homo sapiens; identical to SEQ ID NO: 14700

SEQ ID NO: 14734 - DNA, 201 bp, Homo sapiens; identical to SEQ ID NO: 14701

SEQ ID NO: 14735 - DNA, 201 bp, Homo sapiens; identical to SEQ ID NO: 14702

SEQ ID NO: 14736 - DNA, 201 bp, Homo sapiens; identical to SEQ ID NO: 14703

SEQ ID NO: 14737 - DNA, 201 bp, Homo sapiens; identical to SEQ ID NO: 14704

SEQ ID NO: 14738 - DNA, 201 bp, Homo sapiens; identical to SEQ ID NO: 14705

SEQ ID NO: 14739 - DNA, 201 bp, Homo sapiens; identical to SEQ ID NO: 14706

SEQ ID NO: 14740 - DNA, 201 bp, Homo sapiens; identical to SEQ ID NO: 14707

SEQ ID NO: 14741 - DNA, 201 bp, Homo sapiens; identical to SEQ ID NO: 14708

SEQ ID NO: 14742 - DNA, 201 bp, Homo sapiens; identical to SEQ ID NO: 14709

SEQ ID NO: 14743 - DNA, 201 bp, Homo sapiens; identical to SEQ ID NO: 14710

SEQ ID NO: 14744 - DNA, 201 bp, Homo sapiens
gagccagtccagtgacacaggatgaccttcagtatcacaacctcagcaagcagcagaatgagtccccgcagcccctcgtggagacgggaaagaagtctccrgaatctctggtcaagctggatgcaaccccattgtcctccccacggcatgtgaggatcaaaaactggggcagcgggatgactttccaagacacacttcacc

SEQ ID NO: 14745 - DNA, 201 bp, Homo sapiens
gctccccatcaagccctttacttgacctcctaacaagtagcaccctggattgatcggagcctcctctctcaaactggggcctccctggtcccttggagacraaatcttaaatgccaggcctggcaagtgggtgaaagatggaacttgctgctgagtgcaccacttcaagtgaccaccaggaggtgctatcgcaccactgtg

SEQ ID NO: 14746 - DNA, 201 bp, Homo sapiens
tcagctcaccccgatgggagaaggggatgagctcagtgggcaggaggacgccttccgcagctgggccgtgcaaaccttcaaggcagcctgtgagacgtttsatgtccgaggcaaacagcacattcagatccccaagctctacacctccaatgtgacctgggacccgcaccactacaggctcgtgcaggactcacagccttt

SEQ ID NO: 14747 - DNA, 201 bp, Homo sapiens
ccatagagatggcctgtccttggaaatttctgttcaagaccaaattccaccagtatgcaatgaatggggaaaaagacatcaacaacaatgtggagaaagcyccctgtgccacctccagtccagtgacacaggatgaccttcagtatcacaacctcagcaagcagcagaatgagtccccgcagcccctcgtggagacgggaa

SEQ ID NO: 14748 - DNA, 201 bp, Homo sapiens
acccccgtgtttcaccaggagatgctgaactacgtcctgtcccctttctactactatcaggtagaggcctggaaaacccatgtctggcaggacgagaagcrgagacccaagagaagagagattccattgaaagtcttggtcaaagctgtgctctttgcctgtatgctgatgcgcaagacaatggcgtcccgagtcagagtc

SEQ ID NO: 14749 - DNA, 201 bp, Homo sapiens
tcctggtggaactctcctgtgaggatggccaaggcctgaactacctgccgggggagcaccttggggtttgcccaggcaaccagccggccctggtccaaggyatcctggagcgagtggtggatggccccacaccccaccagacagtgcgcctggaggccctggatgagagtggcagctactgggtcagtgacaagaggctgc

SEQ ID NO: 14750 - DNA, 201 bp, Homo sapiens
cctccagtccagtgacacaggatgaccttcagtatcacaacctcagcaagcagcagaatgagtccccgcagcccctcgtggagacgggaaagaagtctccrgaatctctggtcaagctggatgcaaccccattgtcctccccacggcatgtgaggatcaaaaactggggcagcgggatgactttccaagacacacttcacc

SEQ ID NO: 14751 - DNA, 201 bp, Homo sapiens
tgcccccctgctcactcagccaggccctcacctacttcctggacatcaccacacccccacccagctgctgctccaaaagctggcccaggtggccacagaaragcctgagagacgaggctggaggccctgtgccagccctcagagtacagcaagtggaagttcaccaacagccccacattcctggaggtgctagaggagttc

SEQ ID NO: 14752 - DNA, 201 bp, Homo sapiens
aggtggccacagaaaagcctgagagacgaggctggaggccctgtgccagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccggga

SEQ ID NO: 14753 - DNA, 201 bp, Homo sapiens
ttccccagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaaatacgagtggtttcgggaactggagctaaagtggtacgccctgcctgcagtgg

SEQ ID NO: 14754 - DNA, 201 bp, Homo sapiens
tggccaacatgctgcttgaggtgggcggcctggagttcccagggtgccccttcaatggctggtacatgggcacagagatcggagtccgggacttctgtgaygtccagcgctacaacatcctggaggaagtgggcaggagaatgggcctggaaacgcacaagctggcctcgctctggaaagaccaggctgtcgttgagatca

SEQ ID NO: 14755 - DNA, 201 bp, Homo sapiens
cttcgccaccaagcaggcctggcgcaatgccccacgctgcattgggaggatccagtggtccaacctgcaggtcttcgatgcccgcagctgttccactgccygggaaatgtttgaacacatctgcagacacgtgcgttactccaccaacaatggcaacatcaggtcggccatcaccgtgttcccccagcggagtgatggcaa

SEQ ID NO: 14756 - DNA, 201 bp, Homo sapiens
tcccgtccctgcgggtgtctgctggcttcctgctttcccagctccccattctgaagcccaggttctactccatcagctcctcccgggatcacacgcccacrgagatccacctgactgtggccgtggtcacctaccacacccgagatggccagggtcccctgcaccacggcgtctgcagcacatggctcaacagcctgaagc

SEQ ID NO: 14757 - DNA, 201 bp, Homo sapiens
accacacccgagatggccagggtcccctgcaccacggcgtctgcagcacatggctcaacagcctgaagccccaagacccagtgccctgctttgtgcggaaygccagcggcttccacctccccgaggatccctcccatccttgcatcctcatcgggcctggcacaggcatcgcgcccttccgcagtttctggcagcaacggc

SEQ ID NO: 14758 - DNA, 201 bp, Homo sapiens
tacaggctgagctgcctggaggaggaacggctgctgttggtggtgaccagtacgtttggcaatggagactgccctggcaatggagagaaactgaagaaatygctcttcatgctgaaagagctcaacaacaaattcaggtacgctgtgtttggcctcggctccagcatgtaccctcggttctgcgcctttgctcatgacatt

SEQ ID NO: 14759 - DNA, 201 bp, Homo sapiens
ctgcagcacatggctcaacagcctgaagccccaagacccagtgccctgctttgtgcggaatgccagcggcttccacctccccgaggatccctcccatcctygcatcctcatcgggcctggcacaggcatcgcgcccttccgcagtttctggcagcaacggctccatgactcccagcacaagggagtgcggggaggccgcat

SEQ ID NO: 14760 - DNA, 201 bp, Homo sapiens
tgcagcccagcagcctggagatgtcagcgctctgagggcctacaggaggggttaaagctgccggcacagaacttaaggatggagccagctctgcattatcygaggtcacagggcctggggagatggaggaaagtgatatcccccagcctcaagtcttatttcctcaacgttgctccccatcaagccctttacttgacctcc

SEQ ID NO: 14761 - DNA, 201 bp, Homo sapiens
taaagctgccggcacagaacttaaggatggagccagctctgcattatctgaggtcacagggcctggggagatggaggaaagtgatatcccccagcctcaaktcttatttcctcaacgttgctccccatcaagccctttacttgacctcctaacaagtagcaccctggattgatcggagcctcctctctcaaactggggcct

SEQ ID NO: 14762 - DNA, 201 bp, Homo sapiens; identical to SEQ ID NO: 14745

SEQ ID NO: 14763 - DNA, 201 bp, Homo sapiens; identical to SEQ ID NO: 14746

SEQ ID NO: 14764 - DNA, 201 bp, Homo sapiens; identical to SEQ ID NO: 14747

SEQ ID NO: 14765 - DNA, 201 bp, Homo sapiens; identical to SEQ ID NO: 14748

SEQ ID NO: 14766 - DNA, 201 bp, Homo sapiens; identical to SEQ ID NO: 14749

SEQ ID NO: 14767 - DNA, 201 bp, Homo sapiens; identical to SEQ ID NO: 14750

SEQ ID NO: 14768 - DNA, 201 bp, Homo sapiens; identical to SEQ ID NO: 14751

SEQ ID NO: 14769 - DNA, 201 bp, Homo sapiens; identical to SEQ ID NO: 14752

SEQ ID NO: 14770 - DNA, 201 bp, Homo sapiens
tcactcagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaaatacgagtggtttcgggaactggagctaaagtggtacgccctgcctgcagtgg

SEQ ID NO: 14771 - DNA, 201 bp, Homo sapiens; identical to SEQ ID NO: 14754

SEQ ID NO: 14772 - DNA, 201 bp, Homo sapiens; identical to SEQ ID NO: 14755

SEQ ID NO: 14773 - DNA, 201 bp, Homo sapiens; identical to SEQ ID NO: 14756

SEQ ID NO: 14774 - DNA, 201 bp, Homo sapiens; identical to SEQ ID NO: 14757

SEQ ID NO: 14775 - DNA, 201 bp, Homo sapiens; identical to SEQ ID NO: 14758

SEQ ID NO: 14776 - DNA, 201 bp, Homo sapiens; identical to SEQ ID NO: 14759

SEQ ID NO: 14777 - DNA, 201 bp, Homo sapiens; identical to SEQ ID NO: 14760

SEQ ID NO: 14778 - DNA, 201 bp, Homo sapiens; identical to SEQ ID NO: 14761

SEQ ID NO: 14779 - DNA, 201 bp, Homo sapiens; identical to SEQ ID NO: 14760

SEQ ID NO: 14780 - DNA, 201 bp, Homo sapiens; identical to SEQ ID NO: 14745

SEQ ID NO: 14781 - DNA, 201 bp, Homo sapiens; identical to SEQ ID NO: 14757

SEQ ID NO: 14782 - DNA, 201 bp, Homo sapiens; identical to SEQ ID NO: 14759

SEQ ID NO: 14783 - DNA, 201 bp, Homo sapiens; identical to SEQ ID NO: 14761

SEQ ID NO: 14784 - DNA, 201 bp, Homo sapiens; identical to SEQ ID NO: 14756

SEQ ID NO: 14785 - DNA, 201 bp, Homo sapiens; identical to SEQ ID NO: 14747

SEQ ID NO: 14786 - DNA, 201 bp, Homo sapiens; identical to SEQ ID NO: 14750

SEQ ID NO: 14787 - DNA, 201 bp, Homo sapiens; identical to SEQ ID NO: 14755

SEQ ID NO: 14788 - DNA, 201 bp, Homo sapiens; identical to SEQ ID NO: 14758

SEQ ID NO: 14789 - DNA, 201 bp, Homo sapiens; identical to SEQ ID NO: 14770

SEQ ID NO: 14790 - DNA, 201 bp, Homo sapiens; identical to SEQ ID NO: 14754

SEQ ID NO: 14791 - DNA, 201 bp, Homo sapiens; identical to SEQ ID NO: 14746

SEQ ID NO: 14792 - DNA, 201 bp, Homo sapiens; identical to SEQ ID NO: 14749

SEQ ID NO: 14793 - DNA, 201 bp, Homo sapiens
gcccccctgctcactcagccaggccctcacctacttcctggacatcaccacacccccaacccagctgctgctccaaaagctggcccaggtggccacagaaragcctgagagacagaggctggaggccctgtgccagccctcagagtacagcaagtggaagttcaccaacagccccacattcctggaggtgctagaggagtt

SEQ ID NO: 14794 - DNA, 201 bp, Homo sapiens
ggtggccacagaagagcctgagagacagaggctggaggccctgtgccagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccggga

SEQ ID NO: 14795 - DNA, 201 bp, Homo sapiens; identical to SEQ ID NO: 14748

SEQ ID NO: 14796 - DNA, 201 bp, Homo sapiens
agccagctgtgggggagcccgctgaggtcacgaccacggtgctggtgaggagagatcaccatggagccaatttctcgtgccgcactgaactggacctgcgsccccaagggctggagctgtttgagaacacctcggccccctaccagctccagacctttgtcctgccagcgactcccccacaacttgtcagcccccgggtcc

SEQ ID NO: 14797 - DNA, 201 bp, Homo sapiens
agaacacctcggccccctaccagctccagacctttgtcctgccagcgactcccccacaacttgtcagcccccgggtcctagaggtggacacgcaggggacmgtggtctgttccctggacgggctgttcccagtctcggaggcccaggtccacctggcactgggggaccagaggttgaaccccacagtcacctatggcaacg

SEQ ID NO: 14798 - DNA, 201 bp, Homo sapiens
gccagctgtgggggagcccgctgaggtcacgaccacggtgctggtgaggagagatcaccatggagccaatttctcgtgccgcactgaactggacctgcggscccaagggctggagctgtttgagaacacctcggccccctaccagctccagacctttgtcctgccagcgactcccccacaacttgtcagcccccgggtcct

SEQ ID NO: 14799 - DNA, 154 bp, Homo sapiens
gtgatcctcccacctcagcctcctgagtagctgggaccataggctcacaacaccacacctggcaaatttgatttttttttttttttcagagacggggtctygcaacattgcccagacttcctttgtgttagttaataaagctttctcaactgcc

SEQ ID NO: 14800 - DNA, 201 bp, Homo sapiens
ccagctccagacctttgtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggc

SEQ ID NO: 14801 - DNA, 154 bp, Homo sapiens
gcgccccagtcgacgctgagctcctctgctactcagagttgcaacctcagcctmgctatggctcccagcagcccccggcccgcgctgcccgcactcctggtcctgctcggggctctgttcccaggacctggcaatgcccagacatctgtgtccc

SEQ ID NO: 14802 - DNA, 201 bp, Homo sapiens
aagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaac

SEQ ID NO: 14803 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctccccccggtatgagattgtcatcatcactgtggtagcagccgcagtcataatgggcactgcaggcctcagcacgtacct

SEQ ID NO: 14804 - DNA, 201 bp, Homo sapiens
tatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaaatggggctgggacttctcattggccaac

SEQ ID NO: 14805 - DNA, 168 bp, Homo sapiens
ccttttgggctcaagtgatcctcccacctcagcctcctgagtagctgggaccataggctcacaacaccacacctggcaaatttgatttttttttttttttyagagacggggtctcgcaacattgcccagacttcctttgtgttagttaataaagctttctcaactgcc

SEQ ID NO: 14806 - DNA, 201 bp, Homo sapiens
gacaacgggcgcagcttctcctgctctgcaaccctggaggtggccggccagcttatacacaagaaccagacccgggagcttcgtgtcctgtatggcccccractggacgagagggattgtccgggaaactggacgtggccagaaaattcccagcagactccaatgtgccaggcttgggggaacccattgcccgagctcaag

SEQ ID NO: 14807 - DNA, 201 bp, Homo sapiens
ggacgagggcacccagcggctgacgtgtgcagtaatactggggaaccagagccaggagacactgcagacagtgaccatctacagctttccggcgcccaacrtgattctgacgaagccagaggtctcagaagggaccgaggtgacagtgaagtgtgaggcccaccctagagccaaggtgacgctgaatggggttccagccca

SEQ ID NO: 14808 - DNA, 201 bp, Homo sapiens
taaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctaccggccctgg

SEQ ID NO: 14809 - DNA, 201 bp, Homo sapiens
tgcagctccagtttcctgcagtgatcagggtcctgcaagcagtggggaagggggccaaggtattggaggactccctcccagctttggaagcctcatccgcktgtgtgtgtgtgtgtatgtgtagacaagctctcgctctgtcacccaggctggagtgcagtggtgcaatcatggttcactgcagtcttgaccttttgggct

SEQ ID NO: 14810 - DNA, 201 bp, Homo sapiens
agctccagacctttgtcctgccagcgactcccccacaacttgtcagcccccgggtcctagaggtggacacgcaggggaccgtggtctgttccctggacggkctgttcccagtctcggaggcccaggtccacctggcactgggggaccagaggttgaaccccacagtcacctatggcaacgactccttctcggccaaggcct

SEQ ID NO: 14811 - DNA, 201 bp, Homo sapiens
cctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactg

SEQ ID NO: 14812 - DNA, 201 bp, Homo sapiens
cgagggcccagctcctgctgaaggccaccccagaggacaacgggcgcagcttctcctgctctgcaaccctggaggtggccggccagcttatacacaagaaycagacccgggagcttcgtgtcctgtatggcccccgactggacgagagggattgtccgggaaactggacgtggccagaaaattcccagcagactccaatgt

SEQ ID NO: 14813 - DNA, 201 bp, Homo sapiens
caggttgtacactgcaggagagtgcctggcaaaaagatcaaatggggctgggacttctcattggccaacctgcctttccccagaaggagtgatttttctaycggcacaaaagcactatatggactggtaatggttacaggttcagagattacccagtgaggccttattcctcccttccccccaaaactgacacctttgtta

SEQ ID NO: 14814 - DNA, 201 bp, Homo sapiens
cgcgtgtgtgtgtgtgtgtatgtgtagacaagctctcgctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgatttttttttttttttcagagacg

SEQ ID NO: 14815 - DNA, 201 bp, Homo sapiens
tctctggcctcacggagctcccagtcctaatcacattcaaggtcaccaggtacagttgtacaggttgtacactgcaggagagtgcctggcaaaaagatcaratggggctgggacttctcattggccaacctgcctttccccagaaggagtgatttttctatcggcacaaaagcactatatggactggtaatggttacaggt

SEQ ID NO: 14816 - DNA, 169 bp, Homo sapiens
accttttgggctcaagtgatcctcccacctcagcctcctgagtagctgggaccataggctcacaacaccacacctggcaaatttgattttttttttttttycagagacggggtctcgcaacattgcccagacttcctttgtgttagttaataaagctttctcaactgcc

SEQ ID NO: 14817 - DNA, 162 bp, Homo sapiens
gggctcaagtgatcctcccacctcagcctcctgagtagctgggaccataggctcacaacaccacacctggcaaatttgatttttttttttttttcagagayggggtctcgcaacattgcccagacttcctttgtgttagttaataaagctttctcaactgcc

SEQ ID NO: 14818 - DNA, 201 bp, Homo sapiens
cctatcccgggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctg

SEQ ID NO: 14819 - DNA, 149 bp, Homo sapiens
gcgccccagtcgacgctgagctcctctgctactcagagttgcaacctcmgcctcgctatggctcccagcagcccccggcccgcgctgcccgcactcctggtcctgctcggggctctgttcccaggacctggcaatgcccagacatctgt

SEQ ID NO: 14820 - DNA, 201 bp, Homo sapiens
gcaagcagtggggaagggggccaaggtattggaggactccctcccagctttggaagcctcatccgcgtgtgtgtgtgtgtgtatgtgtagacaagctctckctctgtcacccaggctggagtgcagtggtgcaatcatggttcactgcagtcttgaccttttgggctcaagtgatcctcccacctcagcctcctgagtagc

SEQ ID NO: 14821 - DNA, 201 bp, Homo sapiens
ggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaa

SEQ ID NO: 14822 - DNA, 201 bp, Homo sapiens
aggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagctttccggcgcccaacgtga

SEQ ID NO: 14823 - DNA, 201 bp, Homo sapiens
tagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtc

SEQ ID NO: 14824 - DNA, 154 bp, Homo sapiens; identical to SEQ ID NO: 14799

SEQ ID NO: 14825 - DNA, 201 bp, Homo sapiens
cactttcccactgcccatcggggaatcagtgactgtcactcgagatcttgagggcacctacctctgtcgggccaggagcactcaaggggaggtcacccgcragccccccggtatgagattgtcatcatcactgtggtagcagccgcagtcataatgggcactgcaggcctcagcacgtacctctataaccgccagcggaag

SEQ ID NO: 14826 - DNA, 201 bp, Homo sapiens; identical to SEQ ID NO: 14804

SEQ ID NO: 14827 - DNA, 168 bp, Homo sapiens; identical to SEQ ID NO: 14805

SEQ ID NO: 14828 - DNA, 123 bp, Homo sapiens
cgtgtttttccagatggcccccractggacgagagggattgtccgggaaactggacgtggccagaaaattcccagcagactccaatgtgccaggcttgggggaacccattgcccgagctcaag

SEQ ID NO: 14829 - DNA, 102 bp, Homo sapiens
crtgtttttccagatggcccccgactggacgagagggattgtccgggaaactggacgtggccagaaaattcccagcagactccaatgtgccaggcttggggg

SEQ ID NO: 14830 - DNA, 201 bp, Homo sapiens; identical to SEQ ID NO: 14808

SEQ ID NO: 14831 - DNA, 201 bp, Homo sapiens; identical to SEQ ID NO: 14809

SEQ ID NO: 14832 - DNA, 201 bp, Homo sapiens; identical to SEQ ID NO: 14814

SEQ ID NO: 14833 - DNA, 201 bp, Homo sapiens; identical to SEQ ID NO: 14813

SEQ ID NO: 14834 - DNA, 162 bp, Homo sapiens; identical to SEQ ID NO: 14817

SEQ ID NO: 14835 - DNA, 169 bp, Homo sapiens; identical to SEQ ID NO: 14816

SEQ ID NO: 14836 - DNA, 201 bp, Homo sapiens; identical to SEQ ID NO: 14815

SEQ ID NO: 14837 - DNA, 201 bp, Homo sapiens; identical to SEQ ID NO: 14818

SEQ ID NO: 14838 - DNA, 201 bp, Homo sapiens; identical to SEQ ID NO: 14820

SEQ ID NO: 14839 - DNA, 201 bp, Homo sapiens; identical to SEQ ID NO: 14823

SEQ ID NO: 14840 - DNA, 201 bp, Homo sapiens
gcagatgaggttcctgcctactgtgtgccaccccaagaagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcggaaggtaccaagttt

SEQ ID NO: 14841 - DNA, 201 bp, Homo sapiens
gtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgc

SEQ ID NO: 14842 - DNA, 201 bp, Homo sapiens
caatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccag

SEQ ID NO: 14843 - DNA, 201 bp, Homo sapiens
aacaactgctcagttccttgtgaatgcccagagggactctgccaccctgtctctgggtcctgccagccaggctctggcagtcgggacactgccctcatcgygggcagccttgtgcctctgctgctgctcttcctgggtcttgcctgctgtgcctgctgctgctgggccccccgatcagacctcaaggacaggccagcgaga

SEQ ID NO: 14844 - DNA, 201 bp, Homo sapiens
tgggctccacgctgccctgccgttccctcagctcccacaagctaccctgggtgacagtctcacatcacgacccggaggtccccttcaaccacagcttcatygagccgccctctgccggctgggccactgatgactccttctcatccgatcctgagtctggagaggcagatgaggttcctgcctactgtgtgccaccccaag

SEQ ID NO: 14845 - DNA, 201 bp, Homo sapiens
gcgcacctccagcctagctcgggccaagcggccatcggtctccttcgcggaaggtaccaagtttgcaccacagagtcgccgaagctcaggggagctctccmgcccgctccgaaagcccaagaggctctcccggggggcgcagtcgggtcctgagggccgggaagccgaagagtccacaggcccagacgaagcagaagcccc

SEQ ID NO: 14846 - DNA, 201 bp, Homo sapiens
gccaagcggccatcggtctccttcgcggaaggtaccaagtttgcaccacagagtcgccgaagctcaggggagctctccagcccgctccgaaagcccaagargctctcccggggggcgcagtcgggtcctgagggccgggaagccgaagagtccacaggcccagacgaagcagaagcccccgagtcctttccggcggctgcc

SEQ ID NO: 14847 - DNA, 201 bp, Homo sapiens
gggccgggaagccgaagagtccacaggcccagacgaagcagaagcccccgagtcctttccggcggctgccagtcccggggattcagccactggccaccggyggcccccacttggtagccggacagtggctgagcacgtggaagccattgagggcagcgtccaggagagctcgggccctgtgaccacgatctacatgctggc

SEQ ID NO: 14848 - DNA, 201 bp, Homo sapiens
ccccttcaaccacagcttcatcgagccgccctctgccggctgggccactgatgactccttctcatccgatcctgagtctggagaggcagatgaggttcctrcctactgtgtgccaccccaagaagggatggtccctgtggcccaggcagggtcgtcagaggccagcctggctgcaggtgctttcccgccccctgaggacgc

SEQ ID NO: 14849 - DNA, 201 bp, Homo sapiens
caggggagctctccagcccgctccgaaagcccaagaggctctcccggggggcgcagtcgggtcctgagggccgggaagccgaagagtccacaggcccagasgaagcagaagcccccgagtcctttccggcggctgccagtcccggggattcagccactggccaccggcggcccccacttggtagccggacagtggctgagc

SEQ ID NO: 14850 - DNA, 201 bp, Homo sapiens
cgcggaaggtaccaagtttgcaccacagagtcgccgaagctcaggggagctctccagcccgctccgaaagcccaagaggctctcccggggggcgcagtcgrgtcctgagggccgggaagccgaagagtccacaggcccagacgaagcagaagcccccgagtcctttccggcggctgccagtcccggggattcagccactgg

SEQ ID NO: 14851 - DNA, 201 bp, Homo sapiens
tctgccaccctgtctctgggtcctgccagccaggctctggcagtcgggacactgccctcatcgtgggcagccttgtgcctctgctgctgctcttcctgggycttgcctgctgtgcctgctgctgctgggccccccgatcagacctcaaggacaggccagcgagagatggagctaccgtgtccaggatgaagctgcaggtct

SEQ ID NO: 14852 - DNA, 201 bp, Homo sapiens
ttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggg

SEQ ID NO: 14853 - DNA, 201 bp, Homo sapiens
agagtccacaggcccagacgaagcagaagcccccgagtcctttccggcggctgccagtcccggggattcagccactggccaccggcggcccccacttggtrgccggacagtggctgagcacgtggaagccattgagggcagcgtccaggagagctcgggccctgtgaccacgatctacatgctggcagggaagccccgcgg

SEQ ID NO: 14854 - DNA, 201 bp, Homo sapiens
tgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacg

SEQ ID NO: 14855 - DNA, 201 bp, Homo sapiens
ctgcaggtgctttcccgccccctgaggacgcctccacgccattcgccatcccgcgcacctccagcctagctcgggccaagcggccatcggtctccttcgcrgaaggtaccaagtttgcaccacagagtcgccgaagctcaggggagctctccagcccgctccgaaagcccaagaggctctcccggggggcgcagtcgggtc

SEQ ID NO: 14856 - DNA, 201 bp, Homo sapiens
gggctgggggctggcaccgagagttcaaggagagcccaggagccagtctctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagac

SEQ ID NO: 14857 - DNA, 201 bp, Homo sapiens
atgtcccgcatgtccctgtcctccttcagcgtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagac

SEQ ID NO: 14858 - DNA, 201 bp, Homo sapiens
agtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtgctcagaaccacacgttgcagagg

SEQ ID NO: 14859 - DNA, 201 bp, Homo sapiens
agcccttgggctggcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccc

SEQ ID NO: 14860 - DNA, 201 bp, Homo sapiens
tgggctgggccagctggagcctgggcagagagtgaggagcacccaagtggggccagaggaacgttgtgtgtggcagcaaggagcccgcagaggaacatggygctgctctgggggctcctggtgctcagctggtcctgcctgcaaggcccctgctccgtgttctcccctgtgagcgccatggagcccttgggctggcagcta

SEQ ID NO: 14861 - DNA, 201 bp, Homo sapiens
gaacatggcgctgctctgggggctcctggtgctcagctggtcctgcctgcaaggcccctgctccgtgttctcccctgtgagcgccatggagcccttgggcyggcagctaactagcgggccgaaccaggagcaggtgtccccacttaccctcctcaagttgggcaaccaggagcctggtggccagactgccctgaagagtcc

SEQ ID NO: 14862 - DNA, 201 bp, Homo sapiens; identical to SEQ ID NO: 14857

SEQ ID NO: 14863 - DNA, 201 bp, Homo sapiens; identical to SEQ ID NO: 14858

SEQ ID NO: 14864 - DNA, 201 bp, Homo sapiens
tgggatttattcaggaggcctgtcactccccagcctcttctgggacttgaaaaactggagcctgttcttggcaagaagattctaatgcccaggaacatggygctgctctgggggctcctggtgctcagctggtcctgcctgcaaggcccctgctccgtgttctcccctgtgagcgccatggagcccttgggctggcagcta

SEQ ID NO: 14865 - DNA, 201 bp, Homo sapiens; identical to SEQ ID NO: 14859

SEQ ID NO: 14866 - DNA, 201 bp, Homo sapiens
gctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggaacatggcgctgctctgggggctcctggtgctcagctggtcctgcc

SEQ ID NO: 14867 - DNA, 201 bp, Homo sapiens; identical to SEQ ID NO: 14861

SEQ ID NO: 14868 - DNA, 201 bp, Homo sapiens; identical to SEQ ID NO: 14857

SEQ ID NO: 14869 - DNA, 201 bp, Homo sapiens; identical to SEQ ID NO: 14858

SEQ ID NO: 14870 - DNA, 201 bp, Homo sapiens
aaaaagacggtcttattttggtcctcaccatgcatgtgagaagagtgagggacttgtgccaccgttttacaagctttctgtccctgccacaggaacatggygctgctctgggggctcctggtgctcagctggtcctgcctgcaaggcccctgctccgtgttctcccctgtgagcgccatggagcccttgggctgcagctaa

SEQ ID NO: 14871 - DNA, 201 bp, Homo sapiens
gagcccttgggctgcagctaactagcgggccgaaccaggagcaggtgtccccacttaccctcctcaagttgggcaaccaggagcctggtggccagactgcyctgaagagtcccccaggagtctgcagcagagaccccaccccagagcagacccacaggctggcccgggccatgatggccttcactgccgacctgttctccc

SEQ ID NO: 14872 - DNA, 201 bp, Homo sapiens
gaacatggcgctgctctgggggctcctggtgctcagctggtcctgcctgcaaggcccctgctccgtgttctcccctgtgagcgccatggagcccttgggcygcagctaactagcgggccgaaccaggagcaggtgtccccacttaccctcctcaagttgggcaaccaggagcctggtggccagactgccctgaagagtccc

SEQ ID NO: 14873 - DNA, 201 bp, Homo sapiens
ctccgtctcaaaaaataaacaacaaaaaatcccaaaaagacggtcttattttggtcctcaccatgcatgtgagaagagtgagggacttgtgccaccgtttkacaagctttctgtccctgccacaggaacatggcgctgctctgggggctcctggtgctcagctggtcctgcctgcaaggcccctgctccgtgttctcccct

SEQ ID NO: 14874 - DNA, 201 bp, Homo sapiens; identical to SEQ ID NO: 14857

SEQ ID NO: 14875 - DNA, 201 bp, Homo sapiens; identical to SEQ ID NO: 14858

SEQ ID NO: 14876 - DNA, 201 bp, Homo sapiens; identical to SEQ ID NO: 14859

SEQ ID NO: 14877 - DNA, 109 bp, Homo sapiens
gaacatggygctgctctgggggctcctggtgctcagctggtcctgcctgcaaggcccctgctccgtgttctcccctgtgagcgccatggagcccttgggctggcagcta

SEQ ID NO: 14878 - DNA, 201 bp, Homo sapiens; identical to SEQ ID NO: 14861

SEQ ID NO: 14879 - DNA, 201 bp, Homo sapiens
gtttgggagaagaactggcaattagggagtttgtggagcttctaattacacaccagcccctctgccaggagctggtgcccgccagccgggggcaggctgcygggagtacccagctccagctggagacagtcagtgcctgaggatttgggggaagcaggtggggaaaccttggcacagggctgacaccttcctctgtgccag

SEQ ID NO: 14880 - DNA, 201 bp, Homo sapiens
ggacttgtgccaccgttttacaaggcacaggggctgtgacaaggccttcaacacagaacctggagctgaccccttgacctccctgacccctgatctgtccytgcaggagcctggtggccagactgccctgaagagtcccccaggagtctgcagcagagaccccaccccagagcagacccacaggctggcccgggccatgat

SEQ ID NO: 14881 - DNA, 201 bp, Homo sapiens
agtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtttctggaggaacaagtttgacccg

SEQ ID NO: 14882 - DNA, 201 bp, Homo sapiens
acaggggctgtgacaaggccttcaacacagaacctggagctgaccccttgacctccctgacccctgatctgtccctgcaggagcctggtggccagactgcyctgaagagtcccccaggagtctgcagcagagaccccaccccagagcagacccacaggctggcccgggccatgatggccttcactgccgacctgttctccc

SEQ ID NO: 14883 - DNA, 139 bp, Homo sapiens
atgcatgtgagaagagtgagggacttgtgccaccgtttkacaaggcacaggggctgtgacaaggccttcaacacagaacctggagctgaccccttgacctccctgacccctgatctgtccctgcaggagcctggtggcc

SEQ ID NO: 14884 - DNA, 201 bp, Homo sapiens
aaccacctcctctaccagagaagaaaaacaaacacatgctggcctacatgcagttgctggaggactactcggagccgcagccctctatgttctaccagacrccacagaacgagcacatctaccagcagaagaacaagctcctcatggaggtatacggcttcagcgactccttcagtggggtggactccgtgcaggagctgg

SEQ ID NO: 14885 - DNA, 201 bp, Homo sapiens
ccatcctctctgccctggactcggcgcccatccgcaggctggagtggcagaagcagacttcagagggcctggccgagtactgcacactgatcgacagctcstcctccttccgagcctaccgggccgccctctcggaggtggaaccgccgtgcatcccgtacctggggctgatcctgcaggacctgaccttcgttcacctgg

SEQ ID NO: 14886 - DNA, 201 bp, Homo sapiens
ggcttgagctggatagaggtggggtctcttcaccttccctgaattcagaacagaccctgtgcctggccccagtgtgcccaggcaattccccaggccctcaytgggagcccttggtgttctgagcagcagggcccaggcagcacatgagcagtgcccaggggctccctgcgtgaggacggcaaggtgcgatgtatgtctaac

SEQ ID NO: 14887 - DNA, 197 bp, Homo sapiens
ctcagtgctgcggcctggccgtggctcgtctgttcctttggggggcccgggcgggttgtgggaatcagtcttcacacctcacctgcaggtgtcggggtggrggggggcaaggaggggcaggcacacaccatgtctgacctgaacccgattctggggagcatcttcccgctccggccccacgacctccacagggttac

SEQ ID NO: 14888 - DNA, 201 bp, Homo sapiens
aacttcttcaatgacttcagtgaccacctggctgaggaggccctatgggaactgtctctgaaaattaaacccaggaacataacaaggagaaaaacagaccrggaagagaagacctaggagcagacgccgggatccaggagaatgctcgaggggcgcagagggcagctcccagaccggagaggaccttggacctgttaggcg

SEQ ID NO: 14889 - DNA, 201 bp, Homo sapiens
ctgagactgacaggaaagatttggtgttgtactgcgaggcattcctgaccacctacaggaccttcatctccccagaggagctcatcaagaagctgcaccgrccacatggctatttctttaacccgtgctccacatatgagaaattctctccctttgccgacacattcaagaagcgcgtcagcaagaacacgttcttcgtgc

SEQ ID NO: 14890 - DNA, 201 bp, Homo sapiens
acatcgacgggaaagtgaacttctccaagcggtggcagcagttcaacatcctcgacagcatgcgctgcttccagcaggcgcactatgacatgcggaggaaygacgacattataaacttcttcaatgacttcagtgaccacctggctgaggaggccctatgggaactgtctctgaaaattaaacccaggaacataacaagga

SEQ ID NO: 14891 - DNA, 201 bp, Homo sapiens
tgcaggagctggccccgccgcccgccctaccccccaagcagcggcagctggagccaccggctgggaaagacggacatcccagagatccctcagcggtcagyggcgtccctgggaaggacagcagagacggcagtgagagggccccaaagtcaccagatgctctggagtcggctcagtcggaggaggaagtggacgagctgt

SEQ ID NO: 14892 - DNA, 201 bp, Homo sapiens
agtctttgggggagtctgggtctccatttcttggccctcctttccagctgcctcttggcggccatccccagccagacggacctctggccccagggcagcaracagatacgccacctgctctccccgagaagaagcgcaggagcgcagcctcccagacggcggacggctctggctgcagggtgtcctacgagcggcatccct

SEQ ID NO: 14893 - DNA, 201 bp, Homo sapiens
gagatccctcagcggtcagcggcgtccctgggaaggacagcagagacggcagtgagagggccccaaagtcaccagatgctctggagtcggctcagtcggargaggaagtggacgagctgtccctcattgaccacaacgaaattatgtccaggctgacgctcaagcaggagggtgatgacgggccggacgtccgcggaggat

SEQ ID NO: 14894 - DNA, 201 bp, Homo sapiens
attttgatgttgactgttacgcacagaggcgactgtcaggaggcagccactcatatggtggagagtcgccccgcctctccccctgcagcagcataggcaarctcagcaagtcagacgagcagctgtcctctctggacagggacagtgggcagtgctcccggaacacaagctgtgaaacactagaccactatgatcccgact

SEQ ID NO: 14895 - DNA, 201 bp, Homo sapiens
aagtggacgagctgtccctcattgaccacaacgaaattatgtccaggctgacgctcaagcaggagggtgatgacgggccggacgtccgcggaggatctggrgacatcttactggtccatgctactgagactgacaggaaagatttggtgttgtactgcgaggcattcctgaccacctacaggaccttcatctccccagagg

SEQ ID NO: 14896 - DNA, 201 bp, Homo sapiens
catccctcgcagtatgacaacatctctggggaggacctgcagagcacagccccgatcccatccgtcccctacgcgccctttgctgctattctgccctttcmgcatggaggttcctcagcccctgtcgaatttgtgggtgattttactgctcctgagtcaaccggtgacccagaaaaaccacctcctctaccagagaagaaa

SEQ ID NO: 14897 - DNA, 201 bp, Homo sapiens; identical to SEQ ID NO: 14884

SEQ ID NO: 14898 - DNA, 201 bp, Homo sapiens; identical to SEQ ID NO: 14885

SEQ ID NO: 14899 - DNA, 201 bp, Homo sapiens; identical to SEQ ID NO: 14886

SEQ ID NO: 14900 - DNA, 201 bp, Homo sapiens
ccgggcgggttgtgggaatcagtcttcacagacagacgtgagccaggcggaggactcgttccttgcagaggtcagtcctcacctgcaggtgtcggggtggrggggggcaaggaggggcaggcacacaccatgtctgacctgaacccgattctggggagcatcttcccgctccggccccacgacctccacagggttacattg

SEQ ID NO: 14901 - DNA, 201 bp, Homo sapiens; identical to SEQ ID NO: 14888

SEQ ID NO: 14902 - DNA, 201 bp, Homo sapiens
cctccctcctccattgctcgctgtgtgccttaaactccatctcatgtccctccccatcccctggctttccctccctccttgccccatcctgggccagccakcagggctcctcctctggctcttcagacctttcagccagtgctgtcagtgcccctgggagggaagggcatccctgaggcacccgaatggtccctcagggtg

SEQ ID NO: 14903 - DNA, 201 bp, Homo sapiens; identical to SEQ ID NO: 14890

SEQ ID NO: 14904 - DNA, 201 bp, Homo sapiens
ttattgctgggagtcttctgaacctcaccaaactgaggccagagctgagctcctgggggagttaattcagaggggagaggccagcacctccctcctccatygctcgctgtgtgccttaaactccatctcatgtccctccccatcccctggctttccctccctccttgccccatcctgggccagccagcagggctcctcctc

SEQ ID NO: 14905 - DNA, 201 bp, Homo sapiens; identical to SEQ ID NO: 14891

SEQ ID NO: 14906 - DNA, 201 bp, Homo sapiens; identical to SEQ ID NO: 14892

SEQ ID NO: 14907 - DNA, 201 bp, Homo sapiens; identical to SEQ ID NO: 14893

SEQ ID NO: 14908 - DNA, 201 bp, Homo sapiens; identical to SEQ ID NO: 14894

SEQ ID NO: 14909 - DNA, 201 bp, Homo sapiens; identical to SEQ ID NO: 14895

SEQ ID NO: 14910 - DNA, 201 bp, Homo sapiens; identical to SEQ ID NO: 14896

SEQ ID NO: 14911 - DNA, 201 bp, Homo sapiens
ttaactatcattgtaataatggaagacaaaaatccagccccgggagaacagcatgtacaccagcctcagtgttacagagtgtgggtacatcaaggtgaatrgtgagcagaaactataacctgttagtccttctacacctcatctgctacaagttctggcttagacatggatattctttgtgaagaaaatacttctttgagc

SEQ ID NO: 14912 - DNA, 201 bp, Homo sapiens
tctacaccagtttaattactgtgagagatgcagcgagtcacagaataacaaatgtatctcatgtgtgaaccctgaagacaaatgacatttatcttcccgarcgctcaaaaaaaaccctgcaacctctatgctaaaagttcattctgcttttttgtcctcggtttggtgagaaaataataaaaccaaacagtggactctcct

SEQ ID NO: 14913 - DNA, 201 bp, Homo sapiens
aggtcagccttttcacggtatattcagtgtcagtacaaggaaaacaaaaaaccattgcagttaattttagtgaacacaataccggctttggcctacaagtytagccaacttcaaatgggacaaaaaaagaattcaaagcaagatgccaagacaacagataatgactgctcaatggttgctctaggaaagcagcattctgaa

SEQ ID NO: 14914 - DNA, 201 bp, Homo sapiens
tcatctgctacaagttctggcttagacatggatattctttgtgaagaaaatacttctttgagctcaactacgaactccctaatgcaattaaatgatgacamcaggctctacagtaatgactttaactctggagaagctaacacttctgatgcatttaactggacagtcgactctgaaaatcgaaccaacctttcctgtgaa

SEQ ID NO: 14915 - DNA, 201 bp, Homo sapiens
atgtgtgaaccctgaagacaaatgacatttatcttcccgaacgctcaaaaaaaaccctgcaacctctatgctaaaagttcattctgcttttttgtcctcgstttggtgagaaaataataaaaccaaacagtggactctcctaaaattgtgaatgaagaaaacttacagccaccacagttcagttctttaactatcattgta

SEQ ID NO: 14916 - DNA, 201 bp, Homo sapiens
tcaactccagaactaaggcatttctgaaaatcattgctgtttggaccatatcagtaggtatatccatgccaataccagtctttgggctacaggacgattcraaggtctttaaggaggggagttgcttactcgccgatgataactttgtcctgatcggctcttttgtgtcatttttcattcccttaaccatcatggtgatca

SEQ ID NO: 14917 - DNA, 201 bp, Homo sapiens
aaattaacttctattttcaagtggaaaccttgctgctatgctgttcattgatgacatgggattgagttggttacctattgctgtaaataaaaatagctatmaatagtgaaaattttattgaatataatggcctcttaaaaattatctttaaaacttactatggtatatattttgaaaggagaaaaaaaaagccactaaggt

SEQ ID NO: 14918 - DNA, 201 bp, Homo sapiens
accggtggcctctgccgagcaagctttgtgcagtctggatttacctggacgtgctcttctccacggcctccatcatgcacctctgcgccatctcgctggaycgctacgtcgccatccagaatcccatccaccacagccgcttcaactccagaactaaggcatttctgaaaatcattgctgtttggaccatatcagtaggta

SEQ ID NO: 14919 - DNA, 201 bp, Homo sapiens
acacactgttcaacaagacctataggtcagccttttcacggtatattcagtgtcagtacaaggaaaacaaaaaaccattgcagttaattttagtgaacacwataccggctttggcctacaagtctagccaacttcaaatgggacaaaaaaagaattcaaagcaagatgccaagacaacagataatgactgctcaatggttg

SEQ ID NO: 14920 - DNA, 201 bp, Homo sapiens
catgcacctctgcgccatctcgctggaccgctacgtcgccatccagaatcccatccaccacagccgcttcaactccagaactaaggcatttctgaaaatcrttgctgtttggaccatatcagtaggtatatccatgccaataccagtctttgggctacaggacgattcgaaggtctttaaggaggggagttgcttactcgc

SEQ ID NO: 14921 - DNA, 201 bp, Homo sapiens
tattatgctggtggaagatcaagaagaggggactctacaccagtttaattactgtgagagatgcagcgagtcacagaataacaaatgtatctcatgtgtgraccctgaagacaaatgacatttatcttcccgaacgctcaaaaaaaaccctgcaacctctatgctaaaagttcattctgcttttttgtcctcggtttggtg

SEQ ID NO: 14922 - DNA, 201 bp, Homo sapiens
ctacaagtctagccaacttcaaatgggacaaaaaaagaattcaaagcaagatgccaagacaacagataatgactgctcaatggttgctctaggaaagcagyattctgaagaggcttctaaagacaatagcgacggagtgaatgaaaaggtgagctgtgtgtgataggctagttgccgtggcaactgtggaaggcacactga

SEQ ID NO: 14923 - DNA, 201 bp, Homo sapiens
ctgtggaaggcacactgagcaagttttcacctatctggaaaaaaaaaaatatgagattggaaaaaattagacaagtctagtggaaccaacgatcatatctstatgcctcattttattctgtcaatgaaaagcggggttcaatgctacaaaatgtgtgcttggaaaatgttctgacagcatttcagctgtgagctttctgat

SEQ ID NO: 14924 - DNA, 201 bp, Homo sapiens
tggatattctttgtgaagaaaatacttctttgagctcaactacgaactccctaatgcaattaaatgatgacaccaggctctacagtaatgactttaactcyggagaagctaacacttctgatgcatttaactggacagtcgactctgaaaatcgaaccaacctttcctgtgaagggtgcctctcaccgtcgtgtctctcct

SEQ ID NO: 14925 - DNA, 201 bp, Homo sapiens
ataccggctttggcctacaagtctagccaacttcaaatgggacaaaaaaagaattcaaagcaagatgccaagacaacagataatgactgctcaatggttgytctaggaaagcagcattctgaagaggcttctaaagacaatagcgacggagtgaatgaaaaggtgagctgtgtgtgataggctagttgccgtggcaactgt

SEQ ID NO: 14926 - DNA, 201 bp, Homo sapiens
gggactctacaccagtttaattactgtgagagatgcagcgagtcacagaataacaaatgtatctcatgtgtgaaccctgaagacaaatgacatttatcttyccgaacgctcaaaaaaaaccctgcaacctctatgctaaaagttcattctgcttttttgtcctcggtttggtgagaaaataataaaaccaaacagtggact

SEQ ID NO: 14927 - DNA, 201 bp, Homo sapiens; identical to SEQ ID NO: 14911

SEQ ID NO: 14928 - DNA, 201 bp, Homo sapiens; identical to SEQ ID NO: 14912

SEQ ID NO: 14929 - DNA, 201 bp, Homo sapiens; identical to SEQ ID NO: 14913

SEQ ID NO: 14930 - DNA, 201 bp, Homo sapiens; identical to SEQ ID NO: 14914

SEQ ID NO: 14931 - DNA, 201 bp, Homo sapiens; identical to SEQ ID NO: 14915

SEQ ID NO: 14932 - DNA, 201 bp, Homo sapiens; identical to SEQ ID NO: 14916

SEQ ID NO: 14933 - DNA, 201 bp, Homo sapiens; identical to SEQ ID NO: 14917

SEQ ID NO: 14934 - DNA, 201 bp, Homo sapiens; identical to SEQ ID NO: 14918

SEQ ID NO: 14935 - DNA, 201 bp, Homo sapiens; identical to SEQ ID NO: 14919

SEQ ID NO: 14936 - DNA, 201 bp, Homo sapiens; identical to SEQ ID NO: 14920

SEQ ID NO: 14937 - DNA, 201 bp, Homo sapiens; identical to SEQ ID NO: 14921

SEQ ID NO: 14938 - DNA, 201 bp, Homo sapiens; identical to SEQ ID NO: 14922

SEQ ID NO: 14939 - DNA, 201 bp, Homo sapiens; identical to SEQ ID NO: 14923

SEQ ID NO: 14940 - DNA, 201 bp, Homo sapiens; identical to SEQ ID NO: 14924

SEQ ID NO: 14941 - DNA, 201 bp, Homo sapiens; identical to SEQ ID NO: 14925

SEQ ID NO: 14942 - DNA, 201 bp, Homo sapiens; identical to SEQ ID NO: 14926

SEQ ID NO: 14943 - DNA, 201 bp, Homo sapiens; identical to SEQ ID NO: 14911

SEQ ID NO: 14944 - DNA, 118 bp, Homo sapiens
gacatttatcttcccgarcgctcaaaaaaaaccctgcaacctctatgctaaaagttcattctgcttttttgtcctcggtttggtgagaaaataataaaaccaaacagtggactctcct

SEQ ID NO: 14945 - DNA, 201 bp, Homo sapiens; identical to SEQ ID NO: 14913

SEQ ID NO: 14946 - DNA, 201 bp, Homo sapiens; identical to SEQ ID NO: 14914

SEQ ID NO: 14947 - DNA, 178 bp, Homo sapiens
gacatttatcttcccgaacgctcaaaaaaaaccctgcaacctctatgctaaaagttcattctgcttttttgtcctcgstttggtgagaaaataataaaaccaaacagtggactctcctaaaattgtgaatgaagaaaacttacagccaccacagttcagttctttaactatcattgta

SEQ ID NO: 14948 - DNA, 201 bp, Homo sapiens; identical to SEQ ID NO: 14916

SEQ ID NO: 14949 - DNA, 201 bp, Homo sapiens; identical to SEQ ID NO: 14917

SEQ ID NO: 14950 - DNA, 201 bp, Homo sapiens; identical to SEQ ID NO: 14918

SEQ ID NO: 14951 - DNA, 201 bp, Homo sapiens; identical to SEQ ID NO: 14919

SEQ ID NO: 14952 - DNA, 201 bp, Homo sapiens; identical to SEQ ID NO: 14920

SEQ ID NO: 14953 - DNA, 201 bp, Homo sapiens; identical to SEQ ID NO: 14922

SEQ ID NO: 14954 - DNA, 201 bp, Homo sapiens; identical to SEQ ID NO: 14923

SEQ ID NO: 14955 - DNA, 201 bp, Homo sapiens; identical to SEQ ID NO: 14924

SEQ ID NO: 14956 - DNA, 201 bp, Homo sapiens; identical to SEQ ID NO: 14925

SEQ ID NO: 14957 - DNA, 113 bp, Homo sapiens
gacatttatcttyccgaacgctcaaaaaaaaccctgcaacctctatgctaaaagttcattctgcttttttgtcctcggtttggtgagaaaataataaaaccaaacagtggact

SEQ ID NO: 14958 - DNA, 201 bp, Homo sapiens
tgtaccaaagacggtgaaggtgaagggaacggcagggctctcgcagaacagcactctggaggtccagacactcagtgtggctcccaaggccctggagaccktgcagaagaggaagctggcagcagaccacccattcctgaaggagatgcaagatcaaggggagaacctgtatgtggtgatggaggtggtggagacggtgca

SEQ ID NO: 14959 - DNA, 201 bp, Homo sapiens
aaagacggtgaaggtgaagggaacggcagggctctcgcagaacagcactctggaggtccagacactcagtgtggctcccaaggccctggagaccttgcagragaggaagctggcagcagaccacccattcctgaaggagatgcaagatcaaggggagaacctgtatgtggtgatggaggtggtggagacggtgcaggaggt

SEQ ID NO: 14960 - DNA, 174 bp, Homo sapiens
ctccccacctccacagagacaatgaccatgtttgaaaatgtcacccgggccctggccagacagctaaaccctcraggggacctgacaccacttgacagcctcatcgacttcaagcgcttccatcccttctgcctggtgctgaggaagaggaagagcacgctcttctggggggcc

SEQ ID NO: 14961 - DNA, 201 bp, Homo sapiens
cccaacaagtggagaagctgagccgagtagggcaaagctccctgctcagctccctcagcaaacttctagggaagaaaaaggagctacaagaccttgagctygcacttgaaggggctctagacaagggacatgaagtgaccctggaggcactcccaaaagatgtcctgctatcaaaggaggccgtgggcgccatcctctatt

SEQ ID NO: 14962 - DNA, 201 bp, Homo sapiens
tccctgctcagctccctcagcaaacttctagggaagaaaaaggagctacaagaccttgagctcgcacttgaaggggctctagacaagggacatgaagtgamcctggaggcactcccaaaagatgtcctgctatcaaaggaggccgtgggcgccatcctctatttcgttggagccctaacagagctaagtgaagcccaacag

SEQ ID NO: 14963 - DNA, 201 bp, Homo sapiens
acctgacaccacttgacagcctcatcgacttcaagcgcttccatcccttctgcctggtgctgaggaagaggaagagcacgctcttctggggggcccggtaygtccgcaccgactacacgctgctggatgtgcttgagcccggcagctcaccttcagacccaacagacactgggaattttggctttaagaatatgctggaca

SEQ ID NO: 14964 - DNA, 201 bp, Homo sapiens
gcctcatcgacttcaagcgcttccatcccttctgcctggtgctgaggaagaggaagagcacgctcttctggggggcccggtacgtccgcaccgactacacrctgctggatgtgcttgagcccggcagctcaccttcagacccaacagacactgggaattttggctttaagaatatgctggacacccgagtggagggagatg

SEQ ID NO: 14965 - DNA, 201 bp, Homo sapiens
cgagccggcaaggcagaggcctgcttctccctccccttcttcgccccattggggctacagggatccataaatcacaaggaggctgtaaccatccccaaggrctgcgtcctggcctttcgagtgagacagctgatggtcaaaggcaaagatgagtgggatattccacatatctgcaatgataacatgcaaaccttccctcct

SEQ ID NO: 14966 - DNA, 201 bp, Homo sapiens
cagacccaacagacactgggaattttggctttaagaatatgctggacacccgagtggagggagatgtggatgtaccaaagacggtgaaggtgaagggaacrgcagggctctcgcagaacagcactctggaggtccagacactcagtgtggctcccaaggccctggagaccttgcagaagaggaagctggcagcagaccacc

SEQ ID NO: 14967 - DNA, 201 bp, Homo sapiens
tgagctgtggaggtggggtccttggaagctggatgacagcagctggcaaggggataagagagcagtgagcccctccctcaaggaggtctggctttatccayagacagggccctctgaggtggggctgaggtacaaagggggattgagcagcccaggagaagagagatgggggttcccttcttctcttctctcagatgcatg

SEQ ID NO: 14968 - DNA, 201 bp, Homo sapiens
ggctgggggtctcactgcagagatgaagctgcttctggccctagcagggctcctggccattctggccacgccccagccctctgaaggtgctgctccagctktcctgggggaggtggacacctcgttggtgctgagctccatggaggaggccaagcagctggtggacaaggcctacaaggagcggcgggaaaggtggggcac

SEQ ID NO: 14969 - DNA, 201 bp, Homo sapiens
gggttcccttcttctcttctctcagatgcatggtggacttaggaccttgctgggctgggggtctcactgcagagatgaagctgcttctggccctagcaggsctcctggccattctggccacgccccagccctctgaaggtgctgctccagctgtcctgggggaggtggacacctcgttggtgctgagctccatggaggagg

SEQ ID NO: 14970 - DNA, 201 bp, Homo sapiens
tttggtgggagaacgagggtgtgttcagcatgcagcagcgacaggccctggcccagatctcattgccccggatcatctgcgacaacacaggcatcaccacygtgtctaagaacaacatcttcatgtccaactcatatccccgggactttgtcaactgcagtacacttcctgcattgaacctggcttcctggagggaagcct

SEQ ID NO: 14971 - DNA, 201 bp, Homo sapiens
ggttcccttcttctcttctctcagatgcatggtggacttaggaccttgctgggctgggggtctcactgcagagatgaagctgcttctggccctagcagggstcctggccattctggccacgccccagccctctgaaggtgctgctccagctgtcctgggggaggtggacacctcgttggtgctgagctccatggaggaggc

SEQ ID NO: 14972 - DNA, 201 bp, Homo sapiens
ggaggccaagcagctggtggacaaggcctacaaggagcggcgggaaaggtggggcacgaggcactgcccagctctgggcaaggatgtcccaggcctttcasagaagcagcaggcagcagggagcttgaaggtgggagagggggactatggggacccatgtggactccctttctgtctgtctgtccctgtcatcaagcagcg

SEQ ID NO: 14973 - DNA, 201 bp, Homo sapiens
gggtgtgttcagcatgcagcagcgacaggccctggcccagatctcattgccccggatcatctgcgacaacacaggcatcaccaccgtgtctaagaacaacrtcttcatgtccaactcatatccccgggactttgtcaactgcagtacacttcctgcattgaacctggcttcctggagggaagcctcctagaggccaggtaa

SEQ ID NO: 14974 - DNA, 201 bp, Homo sapiens
tggccacagagctcaagagcctgaaccctaggtgggatggggagaggctctaccaggaagcccggaagatcgtgggggccatggtccagatcatcacttaycgggactacctgcccctggtgctggggccaacggccatgaggaagtacctgcccacgtaccgttcctacaatgactcagtggacccacgcatcgccaacg

SEQ ID NO: 14975 - DNA, 201 bp, Homo sapiens
aatgacccccgcatcaagaaccaagccgactgcatcccgttcttccgctcctgcccggcttgccccgggagcaacatcaccatccgcaaccagatcaacgygctcacttccttcgtggacgccagcatggtgtacggcagcgaggagcccctggccaggaacctgcgcaacatgtccaaccagctggggctgctggccgtc

SEQ ID NO: 14976 - DNA, 201 bp, Homo sapiens
aagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtg

SEQ ID NO: 14977 - DNA, 201 bp, Homo sapiens
gggatggggagaggctctaccaggaagcccggaagatcgtgggggccatggtccagatcatcacttaccgggactacctgcccctggtgctggggccaacrgccatgaggaagtacctgcccacgtaccgttcctacaatgactcagtggacccacgcatcgccaacgtcttcaccaatgccttccgctacggccacaccc

SEQ ID NO: 14978 - DNA, 201 bp, Homo sapiens
gagggtcgtgctggaaggtggcattgaccccatcctccggggcctcatggccacccctgccaagctgaatcgtcagaaccaaattgcagtggatgagatcygggagcgattgtttgagcaggtcatgaggattgggctggacctgcctgctctgaacatgcagcgcagcagggaccacggcctcccaggatacaatgcctg

SEQ ID NO: 14979 - DNA, 201 bp, Homo sapiens
aagcgcaacggcttcccggtggctctggctcgcgcggtctccaacgagatcgtgcgcttccccactgatcagctgactccggaccaggagcgctcactcaygttcatgcaatggggccagctgttggaccacgacctcgacttcacccctgagccggccgcccgggcctccttcgtcactggcgtcaactgcgagaccagc

SEQ ID NO: 14980 - DNA, 201 bp, Homo sapiens; identical to SEQ ID NO: 14967

SEQ ID NO: 14981 - DNA, 201 bp, Homo sapiens
ggctgggggtctcactgcagagatgaagctgcttctggccctagcagggctcctggccattctggccacgccccagccctctgaaggtgctgctccagctktcctgggggaggtggacacctcgttggtgctgagctccatggaggaggccaagcagctggtggacaaggcctacaaggagcggcgggaaagcatcaagca

SEQ ID NO: 14982 - DNA, 201 bp, Homo sapiens; identical to SEQ ID NO: 14969

SEQ ID NO: 14983 - DNA, 201 bp, Homo sapiens; identical to SEQ ID NO: 14970

SEQ ID NO: 14984 - DNA, 201 bp, Homo sapiens; identical to SEQ ID NO: 14971

SEQ ID NO: 14985 - DNA, 201 bp, Homo sapiens; identical to SEQ ID NO: 14973

SEQ ID NO: 14986 - DNA, 201 bp, Homo sapiens; identical to SEQ ID NO: 14974

SEQ ID NO: 14987 - DNA, 201 bp, Homo sapiens; identical to SEQ ID NO: 14975

SEQ ID NO: 14988 - DNA, 201 bp, Homo sapiens; identical to SEQ ID NO: 14976

SEQ ID NO: 14989 - DNA, 201 bp, Homo sapiens; identical to SEQ ID NO: 14977

SEQ ID NO: 14990 - DNA, 201 bp, Homo sapiens; identical to SEQ ID NO: 14978

SEQ ID NO: 14991 - DNA, 201 bp, Homo sapiens; identical to SEQ ID NO: 14979

SEQ ID NO: 14992 - DNA, 201 bp, Homo sapiens; identical to SEQ ID NO: 14967

SEQ ID NO: 14993 - DNA, 201 bp, Homo sapiens; identical to SEQ ID NO: 14981

SEQ ID NO: 14994 - DNA, 201 bp, Homo sapiens; identical to SEQ ID NO: 14969

SEQ ID NO: 14995 - DNA, 201 bp, Homo sapiens; identical to SEQ ID NO: 14970

SEQ ID NO: 14996 - DNA, 201 bp, Homo sapiens; identical to SEQ ID NO: 14971

SEQ ID NO: 14997 - DNA, 201 bp, Homo sapiens; identical to SEQ ID NO: 14973

SEQ ID NO: 14998 - DNA, 201 bp, Homo sapiens; identical to SEQ ID NO: 14974

SEQ ID NO: 14999 - DNA, 201 bp, Homo sapiens; identical to SEQ ID NO: 14975

SEQ ID NO: 15000 - DNA, 201 bp, Homo sapiens; identical to SEQ ID NO: 14976

SEQ ID NO: 15001 - DNA, 201 bp, Homo sapiens; identical to SEQ ID NO: 14977

SEQ ID NO: 15002 - DNA, 201 bp, Homo sapiens; identical to SEQ ID NO: 14978

SEQ ID NO: 15003 - DNA, 201 bp, Homo sapiens; identical to SEQ ID NO: 14979

SEQ ID NO: 15004 - DNA, 201 bp, Homo sapiens; identical to SEQ ID NO: 14967

SEQ ID NO: 15005 - DNA, 201 bp, Homo sapiens; identical to SEQ ID NO: 14981

SEQ ID NO: 15006 - DNA, 201 bp, Homo sapiens; identical to SEQ ID NO: 14969

SEQ ID NO: 15007 - DNA, 201 bp, Homo sapiens; identical to SEQ ID NO: 14970

SEQ ID NO: 15008 - DNA, 201 bp, Homo sapiens; identical to SEQ ID NO: 14971

SEQ ID NO: 15009 - DNA, 201 bp, Homo sapiens; identical to SEQ ID NO: 14973

SEQ ID NO: 15010 - DNA, 201 bp, Homo sapiens; identical to SEQ ID NO: 14974

SEQ ID NO: 15011 - DNA, 201 bp, Homo sapiens; identical to SEQ ID NO: 14975

SEQ ID NO: 15012 - DNA, 201 bp, Homo sapiens; identical to SEQ ID NO: 14976

SEQ ID NO: 15013 - DNA, 201 bp, Homo sapiens; identical to SEQ ID NO: 14977

SEQ ID NO: 15014 - DNA, 201 bp, Homo sapiens; identical to SEQ ID NO: 14978

SEQ ID NO: 15015 - DNA, 201 bp, Homo sapiens; identical to SEQ ID NO: 14979

SEQ ID NO: 15016 - DNA, 201 bp, Homo sapiens
acccccagaaataaaatggtataaaaatggaataccccttgagtccaatcacacaattaaagcggggcatgtactgacgattatggaagtgagtgaaagaracacaggaaattacactgtcatccttaccaatcccatttcaaaggagaagcagagccatgtggtctctctggttgtgtatgtcccaccccagattggtga

SEQ ID NO: 15017 - DNA, 201 bp, Homo sapiens
ccactcaaacgctgacatgtacggtctatgccattcctcccccgcatcacatccactggtattggcagttggaggaagagtgcgccaacgagcccagccawgctgtctcagtgacaaacccatacccttgtgaagaatggagaagtgtggaggacttccagggaggaaataaaattgaagttaataaaaatcaatttgctc

SEQ ID NO: 15018 - DNA, 201 bp, Homo sapiens
ctgcaaatttggaaacctgtccacttacctgaggagcaagagaaatgaatttgtcccctacaagaccaaaggggcacgattccgtcaagggaaagactacrttggagcaatccctgtggatctgaaacggcgcttggacagcatcaccagtagccagagctcagccagctctggatttgtggaggagaagtccctcagtga

SEQ ID NO: 15019 - DNA, 201 bp, Homo sapiens
aggacttcctgaccttggagcatctcatctgttacagcttccaagtggctaagggcatggagttcttggcatcgcgaaagtgtatccacagggacctggcrgcacgaaatatcctcttatcggagaagaacgtggttaaaatctgtgactttggcttggcccgggatatttataaagatccagattatgtcagaaaaggag

SEQ ID NO: 15020 - DNA, 201 bp, Homo sapiens
ggcatgcagtgttcttggctgtgcaaaagtggaggcatttttcataatagaaggtgcccaggaaaagacgaacttggaaatcattattctagtaggcacgrcggtgattgccatgttcttctggctacttcttgtcatcatcctacggaccgttaagcgggccaatggaggggaactgaagacaggctacttgtccatcgt

SEQ ID NO: 15021 - DNA, 201 bp, Homo sapiens
ggctcagcatacaaaaagacatacttacaattaaggctaatacaactcttcaaattacttgcaggggacagagggacttggactggctttggcccaataawcagagtggcagtgagcaaagggtggaggtgactgagtgcagcgatggcctcttctgtaagacactcacaattccaaaagtgatcggaaatgacactggag

SEQ ID NO: 15022 - DNA, 201 bp, Homo sapiens
gagtgcaaaccggtagcacagcccagattctccagcctgactcggggaccacactgagctctcctcctgtttaaaaggaagcatccacacccccaactccyggacatcacatgagaggtgctgctcagattttcaagtgttgttctttccaccagcaggaagtagccgcatttgattttcatttcgacaacaaacaaagac

SEQ ID NO: 15023 - DNA, 201 bp, Homo sapiens
gcggctaccagtccggatatcactccgatgacacagacaccaccgtgtactccagtgaggaagcagaacttttaaagctgatagagattggagtgcaaacyggtagcacagcccagattctccagcctgactcggggaccacactgagctctcctcctgtttaaaaggaagcatccacacccccaactcccggacatcaca

SEQ ID NO: 15024 - DNA, 201 bp, Homo sapiens
ttcttcgaagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatgaaaaaccttttgt

SEQ ID NO: 15025 - DNA, 201 bp, Homo sapiens
agcctgactcggggaccacactgagctctcctcctgtttaaaaggaagcatccacacccccaactcccggacatcacatgagaggtgctgctcagattttsaagtgttgttctttccaccagcaggaagtagccgcatttgattttcatttcgacaacaaacaaagacgttcaagaaatggccccatcctcaaagaagtag

SEQ ID NO: 15026 - DNA, 201 bp, Homo sapiens
cacagacaccaccgtgtactccagtgaggaagcagaacttttaaagctgatagagattggagtgcaaaccggtagcacagcccagattctccagcctgacwcggggaccacactgagctctcctcctgtttaaaaggaagcatccacacccccaactcccggacatcacatgagaggtgctgctcagattttcaagtgttg

SEQ ID NO: 15027 - DNA, 201 bp, Homo sapiens
aagaagaacagcacatttgtcagggtccatgaaaaaccttttgttgcttttggaagtggcatggaatctctggtggaagccacggtgggggagcgtgtcaraatccctgcgaagtaccttggttacccacccccagaaataaaatggtataaaaatggaataccccttgagtccaatcacacaattaaagcggggcatgta

SEQ ID NO: 15028 - DNA, 201 bp, Homo sapiens
tgccattcctcccccgcatcacatccactggtattggcagttggaggaagagtgcgccaacgagcccagccaagctgtctcagtgacaaacccataccctygtgaagaatggagaagtgtggaggacttccagggaggaaataaaattgaagttaataaaaatcaatttgctctaattgaaggaaaaaacaaaactgtaag

SEQ ID NO: 15029 - DNA, 201 bp, Homo sapiens; identical to SEQ ID NO: 15016

SEQ ID NO: 15030 - DNA, 201 bp, Homo sapiens; identical to SEQ ID NO: 15017

SEQ ID NO: 15031 - DNA, 201 bp, Homo sapiens; identical to SEQ ID NO: 15019

SEQ ID NO: 15032 - DNA, 201 bp, Homo sapiens; identical to SEQ ID NO: 15020

SEQ ID NO: 15033 - DNA, 201 bp, Homo sapiens; identical to SEQ ID NO: 15021

SEQ ID NO: 15034 - DNA, 201 bp, Homo sapiens; identical to SEQ ID NO: 15022

SEQ ID NO: 15035 - DNA, 201 bp, Homo sapiens; identical to SEQ ID NO: 15023

SEQ ID NO: 15036 - DNA, 201 bp, Homo sapiens; identical to SEQ ID NO: 15025

SEQ ID NO: 15037 - DNA, 201 bp, Homo sapiens; identical to SEQ ID NO: 15024

SEQ ID NO: 15038 - DNA, 201 bp, Homo sapiens; identical to SEQ ID NO: 15026

SEQ ID NO: 15039 - DNA, 201 bp, Homo sapiens; identical to SEQ ID NO: 15027

SEQ ID NO: 15040 - DNA, 201 bp, Homo sapiens; identical to SEQ ID NO: 15028

SEQ ID NO: 15041 - DNA, 201 bp, Homo sapiens; identical to SEQ ID NO: 15016

SEQ ID NO: 15042 - DNA, 201 bp, Homo sapiens; identical to SEQ ID NO: 15017

SEQ ID NO: 15043 - DNA, 201 bp, Homo sapiens; identical to SEQ ID NO: 15018

SEQ ID NO: 15044 - DNA, 201 bp, Homo sapiens; identical to SEQ ID NO: 15019

SEQ ID NO: 15045 - DNA, 201 bp, Homo sapiens; identical to SEQ ID NO: 15020

SEQ ID NO: 15046 - DNA, 201 bp, Homo sapiens; identical to SEQ ID NO: 15021

SEQ ID NO: 15047 - DNA, 201 bp, Homo sapiens
gagtgcaaaccggtagcacagcccagattctccagcctgactcggggaccacactgagctctcctcctgtttaaaaggaagcatccacacccccaactccyggacatcacatgagaggtgctgctcagattttcaagtgttgttctttccaccagcaggaagtagccgcatttgattttcatttcgacaacagaaaaagga

SEQ ID NO: 15048 - DNA, 201 bp, Homo sapiens; identical to SEQ ID NO: 15023

SEQ ID NO: 15049 - DNA, 201 bp, Homo sapiens; identical to SEQ ID NO: 15024

SEQ ID NO: 15050 - DNA, 201 bp, Homo sapiens
agcctgactcggggaccacactgagctctcctcctgtttaaaaggaagcatccacacccccaactcccggacatcacatgagaggtgctgctcagattttsaagtgttgttctttccaccagcaggaagtagccgcatttgattttcatttcgacaacagaaaaaggacctcggactgcagggagccagtcttctaggcat

SEQ ID NO: 15051 - DNA, 201 bp, Homo sapiens; identical to SEQ ID NO: 15026

SEQ ID NO: 15052 - DNA, 201 bp, Homo sapiens; identical to SEQ ID NO: 15027

SEQ ID NO: 15053 - DNA, 201 bp, Homo sapiens; identical to SEQ ID NO: 15028

SEQ ID NO: 15054 - DNA, 201 bp, Homo sapiens
cagcccctagaagggacatttccctgtgactttgcttggggagttgttgacaactacattcaagtagataccactctgtctcagtttaccgacctgaatgyttacctgtgggatgtccaccacagtaaaaggcttattaaagtggatggggttgtgaccaagaagaggaaatcctactgtgttgactttgctgccatccag

SEQ ID NO: 15055 - DNA, 201 bp, Homo sapiens
ggaaatgcacgttacacattttcgcttctccctggactgggccctgattctccctctgggtaaccagtcccaggtgaaccacaccatcctgcagtactatygctgcatggccagcgagcttgtccgtgtcaacatcaccccagtggtggccctgtggcagcctatggccccgaaccaaggactgccgcgcctcctggccag

SEQ ID NO: 15056 - DNA, 201 bp, Homo sapiens
accgagggcggctggcagcagcacggcaagggtgcgtccatctgggacacgttcacccaccaccccctggcacccccgggagactcccggaacgccagtckgccgttgggcgccccgtcgccgctgcagcccgccaccggggacgtagccagcgacagctacaacaacgtcttccgcgacacggaggcgctgcgcgagctc

SEQ ID NO: 15057 - DNA, 201 bp, Homo sapiens
actcccccagtcaggtggcggtagtgccctgggggttgcgcaaagtgctgaactggctgaagttcaagtacggagacctccccatgtacataatatccaayggaatcgatgacgggctgcatgctgaggacgaccagctgagggtgtattatatgcagaattacataaacgaagctctcaaagcccacatactggatggta

SEQ ID NO: 15058 - DNA, 201 bp, Homo sapiens
ttactgaatctgagaaaaagttcatcaaaggaactgctgacttttttgctctttgctttggacccaccttgagttttcaacttttggaccctcacatgaarttccgccaattggaatctcccaacctgaggcaactgctttcctggattgaccttgaatttaaccatcctcaaatatttattgtggaaaatggctggtttg

SEQ ID NO: 15059 - DNA, 201 bp, Homo sapiens
aaaagtttaggcatgctcagaatgggaaaatatccatagccttgcaggctgattggatagaacctgcctgccctttctcccaaaaggacaaagaggtggcygagagagttttggaatttgacattggctggctggctgagcccattttcggctctggagattatccatgggtgatgagggactggctgaaccaaagaaaca

SEQ ID NO: 15060 - DNA, 201 bp, Homo sapiens
tatcccgagagcatgaagaataacctttcatctattctgcctgattttactgaatctgagaaaaagttcatcaaaggaactgctgacttttttgctctttsctttggacccaccttgagttttcaacttttggaccctcacatgaagttccgccaattggaatctcccaacctgaggcaactgctttcctggattgacctt

SEQ ID NO: 15061 - DNA, 201 bp, Homo sapiens
ggcttattaaagtggatggggttgtgaccaagaagaggaaatcctactgtgttgactttgctgccatccagccccagatcgctttactccaggaaatgcaygttacacattttcgcttctccctggactgggccctgattctccctctgggtaaccagtcccaggtgaaccacaccatcctgcagtactatcgctgcatgg

SEQ ID NO: 15062 - DNA, 201 bp, Homo sapiens
atctctggactttgtactaggttggtttgccaaacccgtatttattgatggtgactatcccgagagcatgaagaataacctttcatctattctgcctgatkttactgaatctgagaaaaagttcatcaaaggaactgctgacttttttgctctttgctttggacccaccttgagttttcaacttttggaccctcacatgaa

SEQ ID NO: 15063 - DNA, 201 bp, Homo sapiens
agggcaccttccccgacggcttcctctgggccgtgggcagcgccgcctaccagaccgagggcggctggcagcagcacggcaagggtgcgtccatctgggayacgttcacccaccaccccctggcacccccgggagactcccggaacgccagtctgccgttgggcgccccgtcgccgctgcagcccgccaccggggacgtag

SEQ ID NO: 15064 - DNA, 152 bp, Homo sapiens
cgcgcagcatgcccgccagcgccccgccgcgccgcccgcggccgccgccgcmgtcgctgtcgctgctgctggtgctgctgggcctgggcggccgccgcctgcgtgcggagccgggcgacggcgcgcagacctgggcccgtttctcgcggcct

SEQ ID NO: 15065 - DNA, 201 bp, Homo sapiens
ctttctaagccaggacaagatgttgttgccaaagtcttcagccttgttctaccaaaagctgatagagaaaaatggcttccctcctttacctgaaaatcagyccctagaagggacatttccctgtgactttgcttggggagttgttgacaactacattcaagtagataccactctgtctcagtttaccgacctgaatgttta

SEQ ID NO: 15066 - DNA, 201 bp, Homo sapiens
tgtactgagtgcagtttttttcacacccgaaagtctttactggctttcatagcttttctattttttgcttctattatttctctctcccttatattttactrctcgaagaaaggcagaagaagttacaaatagttctgaacatttttctattcattcattttgaaataattatgcagacacatcagctgttaaccatttgca

SEQ ID NO: 15067 - DNA, 201 bp, Homo sapiens
aaaagctgatagagaaaaatggcttccctcctttacctgaaaatcagcccctagaagggacatttccctgtgactttgcttggggagttgttgacaactayattcaagtagataccactctgtctcagtttaccgacctgaatgtttacctgtgggatgtccaccacagtaaaaggcttattaaagtggatggggttgtga

SEQ ID NO: 15068 - DNA, 201 bp, Homo sapiens
gccgccgccgccgtcgctgtcgctgctgctggtgctgctgggcctgggcggccgccgcctgcgtgcggagccgggcgacggcgcgcagacctgggcccgtktctcgcggcctcctgcccccgaggccgcgggcctcttccagggcaccttccccgacggcttcctctgggccgtgggcagcgccgcctaccagaccgaggg

SEQ ID NO: 15069 - DNA, 201 bp, Homo sapiens
tggctttaagccattataccaccatccttgtagactcagaaaaagaagatccaataaaatacaatgattacctagaagtgcaagaaatgaccgacatcacrtggctcaactcccccagtcaggtggcggtagtgccctgggggttgcgcaaagtgctgaactggctgaagttcaagtacggagacctccccatgtacataa

SEQ ID NO: 15070 - DNA, 201 bp, Homo sapiens
aaagtttaggcatgctcagaatgggaaaatatccatagccttgcaggctgattggatagaacctgcctgccctttctcccaaaaggacaaagaggtggccragagagttttggaatttgacattggctggctggctgagcccattttcggctctggagattatccatgggtgatgagggactggctgaaccaaagaaacaa

SEQ ID NO: 15071 - DNA, 201 bp, Homo sapiens; identical to SEQ ID NO: 15058

SEQ ID NO: 15072 - DNA, 201 bp, Homo sapiens; identical to SEQ ID NO: 15060

SEQ ID NO: 15073 - DNA, 201 bp, Homo sapiens; identical to SEQ ID NO: 15062

SEQ ID NO: 15074 - DNA, 201 bp, Homo sapiens; identical to SEQ ID NO: 15063

SEQ ID NO: 15075 - DNA, 201 bp, Homo sapiens; identical to SEQ ID NO: 15056

SEQ ID NO: 15076 - DNA, 152 bp, Homo sapiens; identical to SEQ ID NO: 15064

SEQ ID NO: 15077 - DNA, 201 bp, Homo sapiens
ctttctaagccaggacaagatgttgttgccaaagtcttcagccttgttctaccaaaagctgatagagaaaaatggcttccctcctttacctgaaaatcagyccctagaagggacatttccctgtgactttgcttggggagttgttgacaactacattcaagtaagtcagctgacaaaaccaatcagcagtctcaccaagcc

SEQ ID NO: 15078 - DNA, 201 bp, Homo sapiens; identical to SEQ ID NO: 15068

SEQ ID NO: 15079 - DNA, 155 bp, Homo sapiens
aaaagctgatagagaaaaatggcttccctcctttacctgaaaatcagcccctagaagggacatttccctgtgactttgcttggggagttgttgacaactayattcaagtaagtcagctgacaaaaccaatcagcagtctcaccaagccctatcac

SEQ ID NO: 15080 - DNA, 201 bp, Homo sapiens
caagacggctgctgaccgcaggaatgtcaagcagaaccaggccttccagtacgagtttggagccatgtatgcatggatgctgtgtgtcttcactgtcatcrtggcctacagcatcacttgtcccatcatcgcgccatttggcctcatctacatcctgctcaagcacatggtggaccggcacaacctctacttcgtctacct

SEQ ID NO: 15081 - DNA, 201 bp, Homo sapiens
ctgctgaccctgaggacatctgctggaagaacctctctatccagggcctccgctggtggctacagtggctgggcatcaacttcaccctcttcctggggctrtttttcctgaccacaccctccatcatcctgtccaccatggacaagtttaatgtcaccaaacccatccatgcgctgaataacccgatcatcagccagttct

SEQ ID NO: 15082 - DNA, 201 bp, Homo sapiens
gcttcaagcacctcagccctctgaactacaaaacagaagagcctgcaagtgacaaaggaagtgaggcagaggcccacatgcccccaccgttcacaccctaygtgcctcggattctgaacggcttggcctcggagaggacagcactgtctccgcagcagcagcagcagcagacctatggtgccatccacaacatcagcggga

SEQ ID NO: 15083 - DNA, 201 bp, Homo sapiens
ccatccactacctgtccttccagaggcacatcatcttcctgttggtggtggtcagctttttgtccctgtgtgtcatcctgcctgtcaacctctcaggggayttgctggacaaagacccgtatagttttgggaggacaacaatagcaaacctacagactgacaatgacctcctttggctgcacaccatctttgctgtcattt

SEQ ID NO: 15084 - DNA, 201 bp, Homo sapiens
caaagacccgtatagttttgggaggacaacaatagcaaacctacagactgacaatgacctcctttggctgcacaccatctttgctgtcatttacctcttcytcactgtgggtttcatgcggcaccacactcagtccattaagtacaaagaggagaacctggtgaggcggaccctgttcatcacaggactccccagagatgc

SEQ ID NO: 15085 - DNA, 201 bp, Homo sapiens
tggtgctgatcctgccctccctgggtctcaccagtctagattttttcttccggtggctctttgacaaaacttcctcggaggcctccatcaggttggagtgygtcttcctgcctgaccagggtgccttctttgtgaactatgtcatcgcctcggccttcatcggcaatggcatggagctgctgcggctgccaggtctcatcc

SEQ ID NO: 15086 - DNA, 201 bp, Homo sapiens
ggacagcactgtctccgcagcagcagcagcagcagacctatggtgccatccacaacatcagcgggactatccctggacagtgcttggcgcagagcgccacrggcagtgtggctgctgccccccaggaggcctgaggctgggtctcactgctctgaaaagacacaaccagaatggcctggggctcaggcccttggctgagtg

SEQ ID NO: 15087 - DNA, 201 bp, Homo sapiens
gaggtggctggggctgcttttgcctttgccagagacagctccaactgaggacctctccaacgggcccatccacagtccttccttcccctagtgtctgggargacaggcgcgatgatggactccccgttcctggagctgtggcagtccaaggcagtgtccatcagggagcagctgggactcggggaccggcccaacgactcc

SEQ ID NO: 15088 - DNA, 201 bp, Homo sapiens
tctgtaggccctgcctgtgcctgtccgctggcctggggggcctgggcttatctgggccttctcactcagggactctcttgacgctgacttgcccccgcagyggtggccagtgctgcctctgctccaagctgcccctgcgctgggaggggtgggggcggtgccattggtctggtgcagcatagccctggccagtggcctcat

SEQ ID NO: 15089 - DNA, 201 bp, Homo sapiens
ggtggctctttgacaaaacttcctcggaggcctccatcaggttggagtgcgtcttcctgcctgaccagggtgccttctttgtgaactatgtcatcgcctcrgccttcatcggcaatggcatggagctgctgcggctgccaggtctcatcctctataccttccgcatgatcatggccaagacggctgctgaccgcaggaatg

SEQ ID NO: 15090 - DNA, 201 bp, Homo sapiens
gggggtgggcagtgctcagggcctcctcggagccaaaggacagcatggtcggcacagaggaaggggtacctgggctgggtgcagggccatcccactgcccktgagctgtggctctggcaggaaggaggggcagcccatccctcttctccctcctggggattctggggaatgggatgcaacttaagacttctgcctgagaag

SEQ ID NO: 15091 - DNA, 201 bp, Homo sapiens
tcctccaggyttaccaggtcctcaaggcccaaagggtaacaaaggctctactggacccgctggccagaaaggtgacagtggtcttccagggcctcctgggyctccaggtccacctggtgaagtcattcagcctttaccaatcttgtcctccaaaaaaacgagaagacatactgaaggcatgcaagcagatgcagatgataa

SEQ ID NO: 15092 - DNA, 201 bp, Homo sapiens
gtgaccgagggctccctggaactcaaggatctccaggagcaaaaggggatgggggaattcctggtcctgctggtcccttaggtccacctggtcctccaggyttaccaggtcctcaaggcccaaagggtaacaaaggctctactggacccgctggccagaaaggtgacagtggtcttccagggcctcctgggcctccaggtc

SEQ ID NO: 15093 - DNA, 201 bp, Homo sapiens
ggctctgggatttcaccgtaacaaccctcgcattgaccttcctcttccaagctagagaggtcagaggagctgctccagttgatgtactaaaagcactagaktttcacaattctccagagggaatatcaaaaacaacgggattttgcacaaacagaaagaattctaaaggctcagatactgcttacagagtttcaaagcaag

SEQ ID NO: 15094 - DNA, 201 bp, Homo sapiens
atactgaaggcatgcaagcagatgcagatgataatattcttgattactcggatggaatggaagaaatatttggttccctcaattccctgaaacaagacatygagcatatgaaatttccaatgggtactcagaccaatccagcccgaacttgtaaagacctgcaactcagccatcctgacttcccagatggtgaatattgga

SEQ ID NO: 15095 - DNA, 201 bp, Homo sapiens
ctggagaaaaaggtccccaagggcctgcagggagagatggagttcaaggtcctgttggtctcccagggccagctggtcctgccggctcccctggggaagayggagacaagggtgaaattggtgagccgggacaaaaaggcagcaagggtgacaagggagaaaatggccctcccggtcccccaggtcttcaaggaccagttg

SEQ ID NO: 15096 - DNA, 201 bp, Homo sapiens
gtgactcttcagcacccaaggctgctcaagctcaggaacctcagatagatgagaaaaagaaatccaatttcaaaaagaagatgaggacagtggctactaamtcaaaggaaaaatccaaaaagtttacaccccccaaatctgaaaaattttcatccaagaagaagaaaagttatcaagcatcagcaaaagccaaactagggg

SEQ ID NO: 15097 - DNA, 201 bp, Homo sapiens
caggagaacctggggcaaagggagatcgagggtttgatggacttccgggtctgccaggtgacaaaggtcacaggggtgaacgaggtcctcaaggtcctccrggtcctcctggtgatgatggaatgaggggagaagatggagaaattggaccaagaggtcttccaggtgaagctggcccacgaggtttgctgggtccaaggg

SEQ ID NO: 15098 - DNA, 201 bp, Homo sapiens
  misc_feature (1)...(201): n = A,T,C or G, or insertion/deletion polymorphism (see Tables 1-2)
gctggacctccaggtgccaaggggccaccaggtgatgatggccctaagggtaacccgggtcctgttggttttcctggagatcctggtcctcctggggaacntggccctgcaggtcaagatggtgttggtggtgacaagggtgaagatggagatcctggtcaaccgggtcctcctggcccatctggtgaggctggcccacca

SEQ ID NO: 15099 - DNA, 201 bp, Homo sapiens
cgaaaccacttgatagaagtgagagagcaattgttgataccaatggaatcacggtttttggaacaaggattttggatgaagaagtttttgagggggacatycagcagtttttgatcacaggtgatcccaaggcagcatatgactactgtgagcattatagtccagactgtgactcttcagcacccaaggctgctcaagctc

SEQ ID NO: 15100 - DNA, 201 bp, Homo sapiens
atccaaaaagtttacaccccccaaatctgaaaaattttcatccaagaagaagaaaagttatcaagcatcagcaaaagccaaactaggggtaaaggcaaacrtcgttgatgattttcaagaatacaactatggaacaatggaaagttaccagacagaagctcctaggcatgtttctgggacaaatgagccaaatccagttga

SEQ ID NO: 15101 - DNA, 201 bp, Homo sapiens
tttaattggcctgattggtcctccaggagaacaaggggaaaaaggtgaccgagggctccctggaactcaaggatctccaggagcaaaaggggatgggggarttcctggtcctgctggtcccttaggtccacctggtcctccaggcttaccaggtcctcaaggcccaaagggtaacaaaggctctactggacccgctggcca

SEQ ID NO: 15102 - DNA, 201 bp, Homo sapiens
attggattgatcctaaccaaggttgctcaggagattccttcaaagtttactgtaatttcacatctggtggtgagacttgcatttatccagacaaaaaatckgagggagtaagaatttcatcatggccaaaggagaaaccaggaagttggtttagtgaatttaagaggggaaaactgctttcatacttagatgttgaaggaa

SEQ ID NO: 15103 - DNA, 201 bp, Homo sapiens
aagacaaagaacatatcaaatcaacagaaaatataccttggtgccaccaacccattttgtgccacatgcaagttttgaataaggatggtatagaaaacaaygctgcatatacaggtaccatttaggaaataccgatgcctttgtgggggcagaatcacatggcaaaagctttgaaaatcataaagatataagttggtgtgg

SEQ ID NO: 15104 - DNA, 201 bp, Homo sapiens
tacaccaaaaattgatcaagtacctattgttgatgtcatgatcaatgactttggtgatcagaatcagaagttcggatttgaagttggtcctgtttgttttyttggctaagattaagacaaagaacatatcaaatcaacagaaaatataccttggtgccaccaacccattttgtgccacatgcaagttttgaataaggatgg

SEQ ID NO: 15105 - DNA, 201 bp, Homo sapiens
caaaacttgcacgtgtccctgaattccatctgactctaattttatgagaattgcagaactctgatggcaataaatatatgtattatgaaaaaataaagttrtaatttctgatgactctaagtccctttctttggttaataataaaatgcctttgtatatattgatgttgaagagttcaattatttgatgtcgccaacaaaa

SEQ ID NO: 15106 - DNA, 201 bp, Homo sapiens
tgtggctaagatggaaacagggctgattcttgattcccaattctcaactctccttttcctatttgaatttctttggtgctgtagaaaacaaaaaaagaaaratatatattcataaaaaatatggtgctcattctcatccatccaggatgtactaaaacagtgtgtttaataaattgtaattattttgtgtacagttctata

SEQ ID NO: 15107 - DNA, 201 bp, Homo sapiens
gagacacgaagaacgcaaaccatcaaatttagaagaaaaagccctttgactttttccccctctccctccccaatggctgtgtagcaaacatccctggcgawaccttggaaaggacgaagttggtctgcagtcgcaatttcgtgggttgagttcacagttgtgagtgcggggctcggagatggagccgtggtcctctaggtg

SEQ ID NO: 15108 - DNA, 201 bp, Homo sapiens
tctgtgtccatttccaaaacttgcacgtgtccctgaattccatctgactctaattttatgagaattgcagaactctgatggcaataaatatatgtattatraaaaaataaagttgtaatttctgatgactctaagtccctttctttggttaataataaaatgcctttgtatatattgatgttgaagagttcaattatttga

SEQ ID NO: 15109 - DNA, 201 bp, Homo sapiens
ttttatgagaattgcagaactctgatggcaataaatatatgtattatgaaaaaataaagttgtaatttctgatgactctaagtccctttctttggttaatrataaaatgcctttgtatatattgatgttgaagagttcaattatttgatgtcgccaacaaaattctcagagggcaaaaatctggaagacttttggaagcac

SEQ ID NO: 15110 - DNA, 201 bp, Homo sapiens; identical to SEQ ID NO: 15091

SEQ ID NO: 15111 - DNA, 201 bp, Homo sapiens; identical to SEQ ID NO: 15092

SEQ ID NO: 15112 - DNA, 201 bp, Homo sapiens; identical to SEQ ID NO: 15093

SEQ ID NO: 15113 - DNA, 201 bp, Homo sapiens; identical to SEQ ID NO: 15094

SEQ ID NO: 15114 - DNA, 201 bp, Homo sapiens; identical to SEQ ID NO: 15095

SEQ ID NO: 15115 - DNA, 201 bp, Homo sapiens; identical to SEQ ID NO: 15097

SEQ ID NO: 15116 - DNA, 201 bp, Homo sapiens; identical to SEQ ID NO: 15098
  misc_feature (1)...(201): n = A,T,C or G, or insertion/deletion polymorphism (see Tables 1-2)

SEQ ID NO: 15117 - DNA, 201 bp, Homo sapiens; identical to SEQ ID NO: 15099

SEQ ID NO: 15118 - DNA, 201 bp, Homo sapiens
caaggcagcatatgactactgtgagcattatagtccagactgtgactcttcagcacccaaggctgctcaagctcaggaacctcagatagatgaggcaaacrtcgttgatgattttcaagaatacaactatggaacaatggaaagttaccagacagaagctcctaggcatgtttctgggacaaatgagccaaatccagttga

SEQ ID NO: 15119 - DNA, 201 bp, Homo sapiens; identical to SEQ ID NO: 15101

SEQ ID NO: 15120 - DNA, 201 bp, Homo sapiens; identical to SEQ ID NO: 15102

SEQ ID NO: 15121 - DNA, 201 bp, Homo sapiens; identical to SEQ ID NO: 15103

SEQ ID NO: 15122 - DNA, 201 bp, Homo sapiens; identical to SEQ ID NO: 15104

SEQ ID NO: 15123 - DNA, 201 bp, Homo sapiens; identical to SEQ ID NO: 15105

SEQ ID NO: 15124 - DNA, 201 bp, Homo sapiens; identical to SEQ ID NO: 15106

SEQ ID NO: 15125 - DNA, 201 bp, Homo sapiens; identical to SEQ ID NO: 15108

SEQ ID NO: 15126 - DNA, 201 bp, Homo sapiens; identical to SEQ ID NO: 15107

SEQ ID NO: 15127 - DNA, 201 bp, Homo sapiens; identical to SEQ ID NO: 15109

SEQ ID NO: 15128 - DNA, 201 bp, Homo sapiens; identical to SEQ ID NO: 15091

SEQ ID NO: 15129 - DNA, 201 bp, Homo sapiens; identical to SEQ ID NO: 15092

SEQ ID NO: 15130 - DNA, 201 bp, Homo sapiens; identical to SEQ ID NO: 15093

SEQ ID NO: 15131 - DNA, 201 bp, Homo sapiens; identical to SEQ ID NO: 15094

SEQ ID NO: 15132 - DNA, 201 bp, Homo sapiens; identical to SEQ ID NO: 15095

SEQ ID NO: 15133 - DNA, 201 bp, Homo sapiens; identical to SEQ ID NO: 15096

SEQ ID NO: 15134 - DNA, 201 bp, Homo sapiens; identical to SEQ ID NO: 15097

SEQ ID NO: 15135 - DNA, 201 bp, Homo sapiens; identical to SEQ ID NO: 15098
  misc_feature (1)...(201): n = A,T,C or G, or insertion/deletion polymorphism (see Tables 1-2)

SEQ ID NO: 15136 - DNA, 201 bp, Homo sapiens; identical to SEQ ID NO: 15099

SEQ ID NO: 15137 - DNA, 201 bp, Homo sapiens; identical to SEQ ID NO: 15100

SEQ ID NO: 15138 - DNA, 201 bp, Homo sapiens; identical to SEQ ID NO: 15101

SEQ ID NO: 15139 - DNA, 201 bp, Homo sapiens; identical to SEQ ID NO: 15102

SEQ ID NO: 15140 - DNA, 201 bp, Homo sapiens; identical to SEQ ID NO: 15103

SEQ ID NO: 15141 - DNA, 201 bp, Homo sapiens; identical to SEQ ID NO: 15104

SEQ ID NO: 15142 - DNA, 201 bp, Homo sapiens; identical to SEQ ID NO: 15105

SEQ ID NO: 15143 - DNA, 201 bp, Homo sapiens; identical to SEQ ID NO: 15106

SEQ ID NO: 15144 - DNA, 201 bp, Homo sapiens; identical to SEQ ID NO: 15107

SEQ ID NO: 15145 - DNA, 201 bp, Homo sapiens; identical to SEQ ID NO: 15108

SEQ ID NO: 15146 - DNA, 201 bp, Homo sapiens; identical to SEQ ID NO: 15109

SEQ ID NO: 15147 - DNA, 201 bp, Homo sapiens; identical to SEQ ID NO: 15091

SEQ ID NO: 15148 - DNA, 201 bp, Homo sapiens; identical to SEQ ID NO: 15092

SEQ ID NO: 15149 - DNA, 201 bp, Homo sapiens; identical to SEQ ID NO: 15093

SEQ ID NO: 15150 - DNA, 201 bp, Homo sapiens; identical to SEQ ID NO: 15094

SEQ ID NO: 15151 - DNA, 201 bp, Homo sapiens; identical to SEQ ID NO: 15095

SEQ ID NO: 15152 - DNA, 201 bp, Homo sapiens; identical to SEQ ID NO: 15097

SEQ ID NO: 15153 - DNA, 201 bp, Homo sapiens; identical to SEQ ID NO: 15098
  misc_feature (1)...(201): n = A,T,C or G, or insertion/deletion polymorphism (see Tables 1-2)

SEQ ID NO: 15154 - DNA, 201 bp, Homo sapiens; identical to SEQ ID NO: 15099

SEQ ID NO: 15155 - DNA, 201 bp, Homo sapiens
atatgactatgagtatggggaagcagagtataaagaggctgaaagtgtaacagagggacccactgtaactgaggagacaatagcacagacggaggcaaacrtcgttgatgattttcaagaatacaactatggaacaatggaaagttaccagacagaagctcctaggcatgtttctgggacaaatgagccaaatccagttga

SEQ ID NO: 15156 - DNA, 201 bp, Homo sapiens; identical to SEQ ID NO: 15101

SEQ ID NO: 15157 - DNA, 201 bp, Homo sapiens; identical to SEQ ID NO: 15102

SEQ ID NO: 15158 - DNA, 201 bp, Homo sapiens; identical to SEQ ID NO: 15103

SEQ ID NO: 15159 - DNA, 201 bp, Homo sapiens; identical to SEQ ID NO: 15104

SEQ ID NO: 15160 - DNA, 201 bp, Homo sapiens; identical to SEQ ID NO: 15105

SEQ ID NO: 15161 - DNA, 201 bp, Homo sapiens; identical to SEQ ID NO: 15106

SEQ ID NO: 15162 - DNA, 201 bp, Homo sapiens; identical to SEQ ID NO: 15108

SEQ ID NO: 15163 - DNA, 201 bp, Homo sapiens; identical to SEQ ID NO: 15107

SEQ ID NO: 15164 - DNA, 201 bp, Homo sapiens; identical to SEQ ID NO: 15109

SEQ ID NO: 15165 - DNA, 201 bp, Homo sapiens; identical to SEQ ID NO: 15091

SEQ ID NO: 15166 - DNA, 201 bp, Homo sapiens; identical to SEQ ID NO: 15092

SEQ ID NO: 15167 - DNA, 201 bp, Homo sapiens; identical to SEQ ID NO: 15093

SEQ ID NO: 15168 - DNA, 201 bp, Homo sapiens; identical to SEQ ID NO: 15094

SEQ ID NO: 15169 - DNA, 201 bp, Homo sapiens; identical to SEQ ID NO: 15095

SEQ ID NO: 15170 - DNA, 201 bp, Homo sapiens; identical to SEQ ID NO: 15097

SEQ ID NO: 15171 - DNA, 201 bp, Homo sapiens; identical to SEQ ID NO: 15098
  misc_feature (1)...(201): n = A,T,C or G, or insertion/deletion polymorphism (see Tables 1-2)

SEQ ID NO: 15172 - DNA, 201 bp, Homo sapiens; identical to SEQ ID NO: 15099

SEQ ID NO: 15173 - DNA, 201 bp, Homo sapiens; identical to SEQ ID NO: 15155

SEQ ID NO: 15174 - DNA, 201 bp, Homo sapiens; identical to SEQ ID NO: 15101

SEQ ID NO: 15175 - DNA, 201 bp, Homo sapiens; identical to SEQ ID NO: 15102

SEQ ID NO: 15176 - DNA, 201 bp, Homo sapiens; identical to SEQ ID NO: 15103

SEQ ID NO: 15177 - DNA, 201 bp, Homo sapiens; identical to SEQ ID NO: 15104

SEQ ID NO: 15178 - DNA, 201 bp, Homo sapiens; identical to SEQ ID NO: 15105

SEQ ID NO: 15179 - DNA, 201 bp, Homo sapiens; identical to SEQ ID NO: 15106

SEQ ID NO: 15180 - DNA, 201 bp, Homo sapiens; identical to SEQ ID NO: 15108

SEQ ID NO: 15181 - DNA, 201 bp, Homo sapiens; identical to SEQ ID NO: 15107

SEQ ID NO: 15182 - DNA, 201 bp, Homo sapiens; identical to SEQ ID NO: 15109

SEQ ID NO: 15183 - DNA, 201 bp, Homo sapiens; identical to SEQ ID NO: 15091

SEQ ID NO: 15184 - DNA, 201 bp, Homo sapiens; identical to SEQ ID NO: 15092

SEQ ID NO: 15185 - DNA, 201 bp, Homo sapiens; identical to SEQ ID NO: 15093

SEQ ID NO: 15186 - DNA, 201 bp, Homo sapiens; identical to SEQ ID NO: 15094

SEQ ID NO: 15187 - DNA, 201 bp, Homo sapiens; identical to SEQ ID NO: 15095

SEQ ID NO: 15188 - DNA, 201 bp, Homo sapiens; identical to SEQ ID NO: 15097

SEQ ID NO: 15189 - DNA, 201 bp, Homo sapiens; identical to SEQ ID NO: 15098
  misc_feature (1)...(201): n = A,T,C or G, or insertion/deletion polymorphism (see Tables 1-2)

SEQ ID NO: 15190 - DNA, 201 bp, Homo sapiens; identical to SEQ ID NO: 15099

SEQ ID NO: 15191 - DNA, 201 bp, Homo sapiens; identical to SEQ ID NO: 15118

SEQ ID NO: 15192 - DNA, 201 bp, Homo sapiens; identical to SEQ ID NO: 15101

SEQ ID NO: 15193 - DNA, 201 bp, Homo sapiens; identical to SEQ ID NO: 15102

SEQ ID NO: 15194 - DNA, 201 bp, Homo sapiens; identical to SEQ ID NO: 15103

SEQ ID NO: 15195 - DNA, 201 bp, Homo sapiens; identical to SEQ ID NO: 15104

SEQ ID NO: 15196 - DNA, 201 bp, Homo sapiens; identical to SEQ ID NO: 15105

SEQ ID NO: 15197 - DNA, 201 bp, Homo sapiens; identical to SEQ ID NO: 15106

SEQ ID NO: 15198 - DNA, 201 bp, Homo sapiens; identical to SEQ ID NO: 15108

SEQ ID NO: 15199 - DNA, 201 bp, Homo sapiens; identical to SEQ ID NO: 15107

SEQ ID NO: 15200 - DNA, 201 bp, Homo sapiens; identical to SEQ ID NO: 15109

SEQ ID NO: 15201 - DNA, 201 bp, Homo sapiens
ccaggaggatgaaggtctccgtggctgccctctcctgcctcatgcttgttgctgtccttggatcccaggcccagttcacaaatgatgcagagacagagttmatgatgtcaaagcttccactggaaaatccagtagttctgaacagctttcactttgctgctgactgctgcacctcctacatctcacaaagcatcccgtgtt

SEQ ID NO: 15202 - DNA, 201 bp, Homo sapiens
cttcctggatcctcctcttcttataaatacaagggcagagctggtatcccggggagccaggaagcagtgagcccaggagtcctcggccagccctgcctgcycaccaggaggatgaaggtctccgtggctgccctctcctgcctcatgcttgttgctgtccttggatcccaggcccagttcacaaatgatgcagagacagag

SEQ ID NO: 15203 - DNA, 201 bp, Homo sapiens
agaggattagattaatctcctggagggaagactcttccttgaaacatttttttttatctgcctgtagctattgggataattcgggaaatccacagggacakttcaagtcatctttgtcctctactttctgttgcactctcagccttgttctctttttagaaactgcatggtaactattatatagctaaagaagagcattct

SEQ ID NO: 15204 - DNA, 201 bp, Homo sapiens
ctcggccagccctgcctgcccaccaggaggatgaaggtctccgtggctgccctctcctgcctcatgcttgttgctgtccttggatcccaggcccagttcayaaatgatgcagagacagagttaatgatgtcaaagcttccactggaaaatccagtagttctgaacagctttcactttgctgctgactgctgcacctcctac

SEQ ID NO: 15205 - DNA, 201 bp, Homo sapiens
tcaagtcatctttgtcctctactttctgttgcactctcagccttgttctctttttagaaactgcatggtaactattatatagctaaagaagagcattctgmcctctgccctgggacttcctggatcctcctcttcttataaatacaagggcagagctggtatcccggggagccaggaagcagtgagcccaggagtcctcgg

SEQ ID NO: 15206 - DNA, 101 bp, Homo sapiens
ttgttgtgtctggtaatgaaagtaatgcatctaataaagagtattcaattttttaactttgcttgagttttaagaggaaataaactaatataaaactgaar

SEQ ID NO: 15207 - DNA, 201 bp, Homo sapiens; identical to SEQ ID NO: 15201

SEQ ID NO: 15208 - DNA, 201 bp, Homo sapiens; identical to SEQ ID NO: 15202

SEQ ID NO: 15209 - DNA, 201 bp, Homo sapiens; identical to SEQ ID NO: 15203

SEQ ID NO: 15210 - DNA, 201 bp, Homo sapiens
acaaaagaggccagccacccacctccaacacctcctgagcctctgaagctcccaccaggccagctctcctcccacaacagcttcccacagcatgaagatcyccgtggctgccattcccttcttcctcctcatcaccatcgccctagggaccaagactgaatcctcctcacggggaccttaccacccctcagagtgctgctt

SEQ ID NO: 15211 - DNA, 201 bp, Homo sapiens; identical to SEQ ID NO: 15204

SEQ ID NO: 15212 - DNA, 201 bp, Homo sapiens; identical to SEQ ID NO: 15205

SEQ ID NO: 15213 - DNA, 201 bp, Homo sapiens
gggaccttaccacccctcagagtgctgcttcacctacactacctacaagatcccgcgtcagcggattatggattactatgagaccaacagccagtgctccragcccggaattgtcttcatcaccaaaaggggccattccgtctgtaccaaccccagtgacaagtgggtccaggactatatcaaggacatgaaggagaactg

SEQ ID NO: 15214 - DNA, 201 bp, Homo sapiens; identical to SEQ ID NO: 15201

SEQ ID NO: 15215 - DNA, 201 bp, Homo sapiens; identical to SEQ ID NO: 15202

SEQ ID NO: 15216 - DNA, 201 bp, Homo sapiens; identical to SEQ ID NO: 15203

SEQ ID NO: 15217 - DNA, 201 bp, Homo sapiens
acaaaagaggccagccacccacctccaacacctcctgagcctctgaagctcccaccaggccagctctcctcccacaacagcttcccacagcatgaagatcyccgtggctgccattcccttcttcctcctcatcaccatcgccctagggaccaagactgaatcctcctcacaaactggggggaaaccgaaggttgttaaaat

SEQ ID NO: 15218 - DNA, 201 bp, Homo sapiens; identical to SEQ ID NO: 15204

SEQ ID NO: 15219 - DNA, 201 bp, Homo sapiens; identical to SEQ ID NO: 15205

SEQ ID NO: 15220 - DNA, 201 bp, Homo sapiens; identical to SEQ ID NO: 15213

SEQ ID NO: 15221 - DNA, 201 bp, Homo sapiens; identical to SEQ ID NO: 15210

SEQ ID NO: 15222 - DNA, 201 bp, Homo sapiens
cttcctggatcctcctcttcttataaatacaagggcagagctggtatcccggggagccaggaagcagtgagcccaggagtcctcggccagccctgcctgcycaccaggaggatgaaggtctccgtggctgccctctcctgcctcatgcttgttgctgtccttggatcccaggcccagttcataaatgatgcagagacagag

SEQ ID NO: 15223 - DNA, 201 bp, Homo sapiens; identical to SEQ ID NO: 15203

SEQ ID NO: 15224 - DNA, 201 bp, Homo sapiens; identical to SEQ ID NO: 15204

SEQ ID NO: 15225 - DNA, 201 bp, Homo sapiens; identical to SEQ ID NO: 15205

SEQ ID NO: 15226 - DNA, 201 bp, Homo sapiens; identical to SEQ ID NO: 15213

SEQ ID NO: 15227 - DNA, 201 bp, Homo sapiens
ccaggaggatgaaggtctccgtggctgccctctcctgcctcatgcttgttgctgtccttggatcccaggcccagttcataaatgatgcagagacagagttmatgatgtcaaagcttccactggaaaatccagtagttctgaacagctttcactttgctgctgactgctgcacctcctacatctcacaaagcatcccgtgtt

SEQ ID NO: 15228 - DNA, 201 bp, Homo sapiens
ggcaagcactaccaggctgtgggtctgcacctctggaaggtagagaagcggcgggtcaatctgcctagggtcctgtccatgccccccgtggctggcaccgygtgccatgcatacgaccgggaggtccacctgcgttgtgagctctcaccgggctactacctggctgtccccagcaccttcctgaaggacgcgccaggggag

SEQ ID NO: 15229 - DNA, 201 bp, Homo sapiens
ccgggcaggtggcggatgccctggtggacctgaccggcggcctggcagaaagatggaacctgaagggcgtagcaggaagcggaggccagcaggacaggccrggccgctgggagcacaggacttgtcggcagctgctccacctgaaggaccagtgtctgatcagctgctgcgtgctcagccccagagcaggtgcccgggagc

SEQ ID NO: 15230 - DNA, 201 bp, Homo sapiens
agcacaggacttgtcggcagctgctccacctgaaggaccagtgtctgatcagctgctgcgtgctcagccccagagcaggtgcccgggagctgggggagttycatgccttcattgtctcggacctgcgggagctccagggtcaggcgggccagtgcatcctgctgctgcggatccagaacccctggggccggcggtgctggc

SEQ ID NO: 15231 - DNA, 201 bp, Homo sapiens
ggccgggcaggtggcggatgccctggtggacctgaccggcggcctggcagaaagatggaacctgaagggcgtagcaggaagcggaggccagcaggacaggmcaggccgctgggagcacaggacttgtcggcagctgctccacctgaaggaccagtgtctgatcagctgctgcgtgctcagccccagagcaggtgcccggga

SEQ ID NO: 15232 - DNA, 201 bp, Homo sapiens
cttgctggcttctgttgcgccactgagacggcagagaccccaggatcccagagcttcccaggatccctcccagatcctctgctgactccatatggaggccycacacccagagggtagggcagcagatcttctttataactatttattgttcgaatcacttttaggatgtaactttataaataaacatgagcgctgatgatt

SEQ ID NO: 15233 - DNA, 201 bp, Homo sapiens
ggagccaggacgcacccccactgctgctgcaggagccgctgctgagctgcgtgccacatcgctacgcccaggaggtgagccggctctgcctcctgcctgcrggcacctacaaggttgtgccctccacctacctgccggacacagagggggccttcacagtgaccatcgcaaccaggattgacaggccatccattcacagcc

SEQ ID NO: 15234 - DNA, 201 bp, Homo sapiens
tggagcccgagggcctgacaggttcccagcagctgggccggccagccttgcactgtgggggctggtcctgagtcttggcctgcctcccagccctgccaggrggctgcggcctaggggtccacgggaagcctccgtcaggagagacgcagccctgggggccagctggtgctgcaaggaagggtgggaagcttgctggcttct

SEQ ID NO: 15235 - DNA, 201 bp, Homo sapiens
ggacacagagggggccttcacagtgaccatcgcaaccaggattgacaggccatccattcacagccaggagatgctgggccagttcctccaagaggtctccrtcatggcagtgatgaaaacctaacagggtggccccctgtgccagctcaggtgactggagcccgagggcctgacaggttcccagcagctgggccggccagc

SEQ ID NO: 15236 - DNA, 201 bp, Homo sapiens; identical to SEQ ID NO: 15228

SEQ ID NO: 15237 - DNA, 201 bp, Homo sapiens; identical to SEQ ID NO: 15229

SEQ ID NO: 15238 - DNA, 201 bp, Homo sapiens; identical to SEQ ID NO: 15230

SEQ ID NO: 15239 - DNA, 201 bp, Homo sapiens; identical to SEQ ID NO: 15231

SEQ ID NO: 15240 - DNA, 201 bp, Homo sapiens; identical to SEQ ID NO: 15232

SEQ ID NO: 15241 - DNA, 201 bp, Homo sapiens; identical to SEQ ID NO: 15233

SEQ ID NO: 15242 - DNA, 201 bp, Homo sapiens; identical to SEQ ID NO: 15234

SEQ ID NO: 15243 - DNA, 201 bp, Homo sapiens; identical to SEQ ID NO: 15235

SEQ ID NO: 15244 - DNA, 201 bp, Homo sapiens; identical to SEQ ID NO: 15229

SEQ ID NO: 15245 - DNA, 201 bp, Homo sapiens; identical to SEQ ID NO: 15231

SEQ ID NO: 15246 - DNA, 201 bp, Homo sapiens
cagcaccttcctgaaggacgcgccaggggagttcctgctccgagtcttctctaccgggcgagtctcccttagcgccatcagggcagtggccaagaacaccrcccccggggcagccctgcctgcgggggagtgggggaccgtgcagctacggggttcttggagagtcggccagacggcggggggcagcaggaactttgcctc

SEQ ID NO: 15247 - DNA, 201 bp, Homo sapiens; identical to SEQ ID NO: 15232

SEQ ID NO: 15248 - DNA, 201 bp, Homo sapiens; identical to SEQ ID NO: 15228

SEQ ID NO: 15249 - DNA, 201 bp, Homo sapiens; identical to SEQ ID NO: 15230

SEQ ID NO: 15250 - DNA, 201 bp, Homo sapiens; identical to SEQ ID NO: 15233

SEQ ID NO: 15251 - DNA, 201 bp, Homo sapiens; identical to SEQ ID NO: 15235

SEQ ID NO: 15252 - DNA, 201 bp, Homo sapiens; identical to SEQ ID NO: 15234

SEQ ID NO: 15253 - DNA, 201 bp, Homo sapiens
acagatactggcgccagggccaagtgaagcccgggattggtagagaagcggcgggtcaatctgcctagggtcctgtccatgccccccgtggctggcaccgygtgccatgcatacgaccgggaggtccacctgcgttgtgagctctcaccgggctactacctggctgtccccagcaccttcctgaaggacgcgccaggggag

SEQ ID NO: 15254 - DNA, 201 bp, Homo sapiens; identical to SEQ ID NO: 15229

SEQ ID NO: 15255 - DNA, 201 bp, Homo sapiens; identical to SEQ ID NO: 15230

SEQ ID NO: 15256 - DNA, 201 bp, Homo sapiens; identical to SEQ ID NO: 15231

SEQ ID NO: 15257 - DNA, 201 bp, Homo sapiens; identical to SEQ ID NO: 15232

SEQ ID NO: 15258 - DNA, 201 bp, Homo sapiens; identical to SEQ ID NO: 15233

SEQ ID NO: 15259 - DNA, 201 bp, Homo sapiens; identical to SEQ ID NO: 15234

SEQ ID NO: 15260 - DNA, 201 bp, Homo sapiens; identical to SEQ ID NO: 15235

SEQ ID NO: 15261 - DNA, 188 bp, Homo sapiens
gtgcctgcgccgcgctgcagaagagcaggcacctcctggaccaggtctcttgccctgtgcagcttcctgcagactggacttgcaaagtccagcctgtatgrctggagttcccatgcctgccaatctcctgtcgactgcgagtcagctccgatacttcaccagattcagccacctgggggagctggaag

SEQ ID NO: 15262 - DNA, 189 bp, Homo sapiens
tgtgcctgcgccgcgctgcagaagagcaggcacctcctggaccaggtctcttgccctgtgcagcttcctgcagactggacttgcaaagtccagcctgtatsgctggagttcccatgcctgccaatctcctgtcgactgcgagtcagctccgatacttcaccagattcagccacctgggggagctggaag

SEQ ID NO: 15263 - DNA, 201 bp, Homo sapiens; identical to SEQ ID NO: 15229

SEQ ID NO: 15264 - DNA, 201 bp, Homo sapiens; identical to SEQ ID NO: 15231

SEQ ID NO: 15265 - DNA, 201 bp, Homo sapiens; identical to SEQ ID NO: 15246

SEQ ID NO: 15266 - DNA, 201 bp, Homo sapiens; identical to SEQ ID NO: 15232

SEQ ID NO: 15267 - DNA, 201 bp, Homo sapiens; identical to SEQ ID NO: 15228

SEQ ID NO: 15268 - DNA, 201 bp, Homo sapiens; identical to SEQ ID NO: 15230

SEQ ID NO: 15269 - DNA, 201 bp, Homo sapiens; identical to SEQ ID NO: 15233

SEQ ID NO: 15270 - DNA, 201 bp, Homo sapiens; identical to SEQ ID NO: 15235

SEQ ID NO: 15271 - DNA, 201 bp, Homo sapiens; identical to SEQ ID NO: 15234

SEQ ID NO: 15272 - DNA, 201 bp, Homo sapiens; identical to SEQ ID NO: 15229

SEQ ID NO: 15273 - DNA, 201 bp, Homo sapiens; identical to SEQ ID NO: 15230

SEQ ID NO: 15274 - DNA, 201 bp, Homo sapiens; identical to SEQ ID NO: 15231

SEQ ID NO: 15275 - DNA, 201 bp, Homo sapiens; identical to SEQ ID NO: 15232

SEQ ID NO: 15276 - DNA, 201 bp, Homo sapiens; identical to SEQ ID NO: 15233

SEQ ID NO: 15277 - DNA, 201 bp, Homo sapiens; identical to SEQ ID NO: 15235

SEQ ID NO: 15278 - DNA, 201 bp, Homo sapiens; identical to SEQ ID NO: 15234

SEQ ID NO: 15279 - DNA, 201 bp, Homo sapiens; identical to SEQ ID NO: 15232

SEQ ID NO: 15280 - DNA, 201 bp, Homo sapiens; identical to SEQ ID NO: 15233

SEQ ID NO: 15281 - DNA, 201 bp, Homo sapiens; identical to SEQ ID NO: 15235

SEQ ID NO: 15282 - DNA, 201 bp, Homo sapiens; identical to SEQ ID NO: 15234

SEQ ID NO: 15283 - DNA, 201 bp, Homo sapiens
gtgcctgcgccgcgctgcagaagagcaggcacctcctggaccaggtctcttgccctgtgcagcttcctgcagactggacttgcaaagtccagcctgtatgrctggagttcccatgcctgccaatctcctgtcgactgcgagtcagctccgatacttcaccagattcagccacctgggggagctggaagtgaatctcatctt

SEQ ID NO: 15284 - DNA, 201 bp, Homo sapiens
tgtgcctgcgccgcgctgcagaagagcaggcacctcctggaccaggtctcttgccctgtgcagcttcctgcagactggacttgcaaagtccagcctgtatsgctggagttcccatgcctgccaatctcctgtcgactgcgagtcagctccgatacttcaccagattcagccacctgggggagctggaagtgaatctcatct

SEQ ID NO: 15285 - DNA, 201 bp, Homo sapiens; identical to SEQ ID NO: 15228

SEQ ID NO: 15286 - DNA, 201 bp, Homo sapiens; identical to SEQ ID NO: 15229

SEQ ID NO: 15287 - DNA, 201 bp, Homo sapiens; identical to SEQ ID NO: 15230

SEQ ID NO: 15288 - DNA, 201 bp, Homo sapiens; identical to SEQ ID NO: 15231

SEQ ID NO: 15289 - DNA, 201 bp, Homo sapiens; identical to SEQ ID NO: 15232

SEQ ID NO: 15290 - DNA, 201 bp, Homo sapiens; identical to SEQ ID NO: 15233

SEQ ID NO: 15291 - DNA, 201 bp, Homo sapiens; identical to SEQ ID NO: 15234

SEQ ID NO: 15292 - DNA, 201 bp, Homo sapiens; identical to SEQ ID NO: 15235

SEQ ID NO: 15293 - DNA, 201 bp, Homo sapiens; identical to SEQ ID NO: 15229

SEQ ID NO: 15294 - DNA, 201 bp, Homo sapiens; identical to SEQ ID NO: 15231

SEQ ID NO: 15295 - DNA, 201 bp, Homo sapiens; identical to SEQ ID NO: 15232

SEQ ID NO: 15296 - DNA, 201 bp, Homo sapiens; identical to SEQ ID NO: 15246

SEQ ID NO: 15297 - DNA, 201 bp, Homo sapiens
gccgctcctccacactgagcctcctgcacgtgctcacaggtagagaagcggcgggtcaatctgcctagggtcctgtccatgccccccgtggctggcaccgygtgccatgcatacgaccgggaggtccacctgcgttgtgagctctcaccgggctactacctggctgtccccagcaccttcctgaaggacgcgccaggggag

SEQ ID NO: 15298 - DNA, 201 bp, Homo sapiens; identical to SEQ ID NO: 15230

SEQ ID NO: 15299 - DNA, 201 bp, Homo sapiens; identical to SEQ ID NO: 15233

SEQ ID NO: 15300 - DNA, 201 bp, Homo sapiens; identical to SEQ ID NO: 15234

SEQ ID NO: 15301 - DNA, 201 bp, Homo sapiens; identical to SEQ ID NO: 15235

SEQ ID NO: 15302 - DNA, 201 bp, Homo sapiens
gcaactgtgagatcctctattttcgtcgctggctgcaggacaatgctgaaaatgtctacgtatggaagcaaggtgtggacgtcaaggccatgacctctaaygtggccagtgtgcagtgtgacaattcagacaagtttcccgtctacaaatacccaggaaaggggtgccccacccttggtgatgaaggtgacacagacctat

SEQ ID NO: 15303 - DNA, 171 bp, Homo sapiens
gagagaaggacggagtcgagtggcaccctagaagacgctctgtgccttcggaggtctttctgcctgcctgycctcatgcctctcctcctcttgctgctcctgctgccaagccccttacacccccaccccatctgtgaggtctccaaagtggccagccacctagaagtgaac

SEQ ID NO: 15304 - DNA, 201 bp, Homo sapiens
agcgctgcctccagacctgccgaaagacacaaccatcctccacctgagtgagaacctcctgtacaccttctccctggcaaccctgatgccttacactcgcytcactcagctgaacctagataggtgcgagctcaccaagctccaggtcgatgggacgctgccagtgctggggaccctggatctatcccacaatcagctgca

SEQ ID NO: 15305 - DNA, 201 bp, Homo sapiens
gggcagacactgcctgctctcaccgtcctggacgtctccttcaaccggctgacctcgctgcctcttggtgccctgcgtggtcttggcgaactccaagagcyctacctgaaaggcaatgagctgaagaccctgcccccagggctcctgacgcccacacccaagctggagaagctcagtctggctaacaacaacttgactgag

SEQ ID NO: 15306 - DNA, 201 bp, Homo sapiens
agacacaaccatcctccacctgagtgagaacctcctgtacaccttctccctggcaaccctgatgccttacactcgcctcactcagctgaacctagataggygcgagctcaccaagctccaggtcgatgggacgctgccagtgctggggaccctggatctatcccacaatcagctgcaaagcctgcccttgctagggcagac

SEQ ID NO: 15307 - DNA, 201 bp, Homo sapiens
accccaatcccgaccatcgccacaagcccgaccatcctggtgtctgccacaagcctgatcactccaaaaagcacatttttaactaccacaaaacccgtatmactcttagaatccaccaaaaaaaccatccctgaacttgatcagccaccaaagctccgtggggtgctccaagggcatttggagagctccagaaatgaccct

SEQ ID NO: 15308 - DNA, 201 bp, Homo sapiens
tctactcatggtccactgcttctctagacagccaaatgccctcctccttgcatccaacacaagaatccactaaggagcagaccacattcccacctagatgraccccaaatttcacacttcacatggaatccatcacattctccaaaactccaaaatccactactgaaccaaccccaagcccgaccacctcagagcccgtcc

SEQ ID NO: 15309 - DNA, 201 bp, Homo sapiens
ctgacctcgctgcctcttggtgccctgcgtggtcttggcgaactccaagagctctacctgaaaggcaatgagctgaagaccctgcccccagggctcctgaygcccacacccaagctggagaagctcagtctggctaacaacaacttgactgagctccccgctgggctcctgaatgggctggagaatctcgacacccttctc

SEQ ID NO: 15310 - DNA, 201 bp, Homo sapiens
acagcgctgcctccagacctgccgaaagacacaaccatcctccacctgagtgagaacctcctgtacaccttctccctggcaaccctgatgccttacactcrcctcactcagctgaacctagataggtgcgagctcaccaagctccaggtcgatgggacgctgccagtgctggggaccctggatctatcccacaatcagctg

SEQ ID NO: 15311 - DNA, 122 bp, Homo sapiens
gtgtctggatgttacaaatatgggtggttttattttctttttccctgtttagcattttctagttttccactattattgtatattatctgtataataaaaartaattttagggttgggagtga

SEQ ID NO: 15312 - DNA, 201 bp, Homo sapiens
cacccttctcctccaagagaactcgctgtatacaataccaaagggcttttttgggtcccacctcctgccttttgcttttctccacgggaacccctggttawgcaactgtgagatcctctattttcgtcgctggctgcaggacaatgctgaaaatgtctacgtatggaagcaaggtgtggacgtcaaggccatgacctctaa

SEQ ID NO: 15313 - DNA, 201 bp, Homo sapiens
cttggcgaactccaagagctctacctgaaaggcaatgagctgaagaccctgcccccagggctcctgacgcccacacccaagctggagaagctcagtctggytaacaacaacttgactgagctccccgctgggctcctgaatgggctggagaatctcgacacccttctcctccaagagaactcgctgtatacaataccaaag

SEQ ID NO: 15314 - DNA, 201 bp, Homo sapiens
cccctggttatgcaactgtgagatcctctattttcgtcgctggctgcaggacaatgctgaaaatgtctacgtatggaagcaaggtgtggacgtcaaggccrtgacctctaacgtggccagtgtgcagtgtgacaattcagacaagtttcccgtctacaaatacccaggaaaggggtgccccacccttggtgatgaaggtga

SEQ ID NO: 15315 - DNA, 201 bp, Homo sapiens
tgctccaagggcatttggagagctccagaaatgacccttttctccaccccgacttttgctgcctcctccccctgggcttctatgtcttgggtctcttctgrctgctctttgcctctgtggtcctcatcctgctgctgagctgggttgggcatgtgaaaccacaggccctggactctggccaaggtgctgctctgaccacag

SEQ ID NO: 15316 - DNA, 201 bp, Homo sapiens
gcttttctccacgggaacccctggttatgcaactgtgagatcctctattttcgtcgctggctgcaggacaatgctgaaaatgtctacgtatggaagcaagktgtggacgtcaaggccatgacctctaacgtggccagtgtgcagtgtgacaattcagacaagtttcccgtctacaaatacccaggaaaggggtgccccacc

SEQ ID NO: 15317 - DNA, 201 bp, Homo sapiens
tattctactcatggtccactgcttctctagacagccaaatgccctcctccttgcatccaacacaagaatccactaaggagcagaccacattcccacctagrtggaccccaaatttcacacttcacatggaatccatcacattctccaaaactccaaaatccactactgaaccaaccccaagcccgaccacctcagagcccg

SEQ ID NO: 15318 - DNA, 201 bp, Homo sapiens
tgacctcgctgcctcttggtgccctgcgtggtcttggcgaactccaagagctctacctgaaaggcaatgagctgaagaccctgcccccagggctcctgacrcccacacccaagctggagaagctcagtctggctaacaacaacttgactgagctccccgctgggctcctgaatgggctggagaatctcgacacccttctcc

SEQ ID NO: 15319 - DNA, 201 bp, Homo sapiens
gaacccctggttatgcaactgtgagatcctctattttcgtcgctggctgcaggacaatgctgaaaatgtctacgtatggaagcaaggtgtggacgtcaagkccatgacctctaacgtggccagtgtgcagtgtgacaattcagacaagtttcccgtctacaaatacccaggaaaggggtgccccacccttggtgatgaagg

SEQ ID NO: 15320 - DNA, 201 bp, Homo sapiens
cagatgctggagaactaggccagggagatggacccagagctgagagggagaccatcacctgtgccatgggacagaacctgggaacatgtagggtggggagkatgagcaccaacataccctgctggtcaaagtaccctaggacaaaggggcaaatggtgggcatgggtgctcctgctctgcactccagaaacaccctgacag

SEQ ID NO: 15321 - DNA, 105 bp, Homo sapiens
gcgcwcaccgagagccacttccggaacaagcgtcgcgtttctgaggagaaactcttggtgagaattcccagagtgataatggctacctacagcctggcgaacgag

SEQ ID NO: 15322 - DNA, 201 bp, Homo sapiens
gacaggctcagagaggagatggaaactgacatacccaacccacttcctcaaacacttcatgctgctgccccagccttcccgcagacttggcctaatgaaartacatacttcttcattcggagagacaaaacaagaactagagttttaatgataataaaagcaataataataaaagcaataacaataaaaacaagatcagac

SEQ ID NO: 15323 - DNA, 201 bp, Homo sapiens
aggcatagctgtgggcaggctcgggcttcagtttttccatgcccaccatttgcccctttgtcctagggtactttgaccagcagggtatgttggtgctcatmctccccaccctacatgttcccaggttctgtcccatggcacaggtgatggtctccctctcagctctgggtccatctccctggcctagttctccagcatctg

SEQ ID NO: 15324 - DNA, 201 bp, Homo sapiens
gttcaggaattgatgagctgtcttgatctcaaagaatgtggacatgcttactcggggattgtggcccaccagaagcatttacttcctaccagccccccaayttctcaggcctcagagggggcatcttcagatatccacacccctgcccagatgctcctgtccaccttgcagtccactcagcgccccaccctcccagtagga

SEQ ID NO: 15325 - DNA, 201 bp, Homo sapiens
gtctgatcttgtttttattgttattgcttttattattattgcttttattatcattaaaactctagttcttgttttgtctctccgaatgaagaagtatgtaytttcattaggccaagtctgcgggaaggctggggcagcagcatgaagtgtttgaggaagtgggttgggtatgtcagtttccatctcctctctgagcctgtc

SEQ ID NO: 15326 - DNA, 201 bp, Homo sapiens
cggagtctcgctctgtcatccaggctggagtgcagtggcatgatctcggctcactgcaacccccatctcccaggttcaagcgattctcctgcctcctcctragtagctgggactacaggtgctcaccaccacacccggctaattttttgtatttttagtagagacggggtttcaccatgttgaccaggctggtctcgaact

SEQ ID NO: 15327 - DNA, 201 bp, Homo sapiens
catcggttcagttcatgaatcgtctccggaaacacctgagagcttaccatcggtgtctatactacacgaggttccagctcctttcctggagcgtgtgtggrggcaacaaggacccatgggttcaggaattgatgagctgtcttgatctcaaagaatgtggacatgcttactcggggattgtggcccaccagaagcatttac

SEQ ID NO: 15328 - DNA, 201 bp, Homo sapiens
ggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcg

SEQ ID NO: 15329 - DNA, 201 bp, Homo sapiens
ctgcgggccacagtctggcagttgggcctgaggctggggagaaccagaagcagccggaaaaaaatgctggtcccacagccaggacatcagccacagtgccrgtcctgtgcctcctggccatcatcttcatcctcaccgcagccctttcctatgtgctgtgcaagaggaggagggggcagtcaccgcagtcctctccagatc

SEQ ID NO: 15330 - DNA, 201 bp, Homo sapiens
ttcattatatacctgtggcacctgactctaatacctgagccaagaatggaagtttgtgaggagacggactctatgttgcccaggctgttatggaactcctragtcaagtgatcctcccaccttggcctctgaaggtgcgaggattataggcgtcacctaccacatccagcctacacgtatttgttaatatctaacatagga

SEQ ID NO: 15331 - DNA, 201 bp, Homo sapiens
cgaaagccattgagacaccagctggacgtcacgcgccggagcatgtctgggagtcagagcgaggtggctccatccccgcagagtccgcggagccccgagaygggacgggacttgcggcccgggtcccgcgtgctcctgctcctgcttctgctcctgctggtgtacctgactcagccaggcaatggcaacgagggcagcgtc

SEQ ID NO: 15332 - DNA, 201 bp, Homo sapiens
cagggcgcgggagctccacctcctcggctttccctgcgtccagaggctggcatggcgcgggccgagtactgagcgcacggtcggggcacagcagggccggkgggtgcagctggctcgcgcctcctctccggccgccgtctcctccggtccccggcgaaagccattgagacaccagctggacgtcacgcgccggagcatgtc

SEQ ID NO: 15333 - DNA, 201 bp, Homo sapiens
gacggagccgggcccagtgcgggggcgcagggcgcgggagctccacctcctcggctttccctgcgtccagaggctggcatggcgcgggccgagtactgagmgcacggtcggggcacagcagggccggggggtgcagctggctcgcgcctcctctccggccgccgtctcctccggtccccggcgaaagccattgagacacca

SEQ ID NO: 15334 - DNA, 201 bp, Homo sapiens
cgacggagccgggcccagtgcgggggcgcagggcgcgggagctccacctcctcggctttccctgcgtccagaggctggcatggcgcgggccgagtactgarcgcacggtcggggcacagcagggccggggggtgcagctggctcgcgcctcctctccggccgccgtctcctccggtccccggcgaaagccattgagacacc

SEQ ID NO: 15335 - DNA, 201 bp, Homo sapiens
actcagcgccccaccctcccagtaggatcactgtcctcggacaaagagctcactcgtcccaatgaaaccaccattcacactgcgggccacagtctggcagytgggcctgaggctggggagaaccagaagcagccggaaaaaaatgctggtcccacagccaggacatcagccacagtgccggtcctgtgcctcctggccatc

SEQ ID NO: 15336 - DNA, 201 bp, Homo sapiens
agccaagaatggaagtttgtgaggagacggactctatgttgcccaggctgttatggaactcctgagtcaagtgatcctcccaccttggcctctgaaggtgygaggattataggcgtcacctaccacatccagcctacacgtatttgttaatatctaacataggactaaccagccactgccctctcttaggcccctcattta

SEQ ID NO: 15337 - DNA, 201 bp, Homo sapiens
gcaagaggaggagggggcagtcaccgcagtcctctccagatctgccggttcattatatacctgtggcacctgactctaatacctgagccaagaatggaagyttgtgaggagacggactctatgttgcccaggctgttatggaactcctgagtcaagtgatcctcccaccttggcctctgaaggtgcgaggattataggcgt

SEQ ID NO: 15338 - DNA, 201 bp, Homo sapiens
tgctaaaccaattccgaacagatttggaaaagctggaaaaggagattacagcccggaatgagcaacttgactggccctatgaatatctgaagcccagctgyatagagaacagtgtcaccatctgagccctagagtgactctacctgcaagatttcacatcagctttaggactgacatttctatcttgaatttcatgctttc

SEQ ID NO: 15339 - DNA, 201 bp, Homo sapiens
ggcaggatgatgagttgttcagctaccagttcctcaatggtgccaaccccatgctgttgagacgctcgacctctctgccctccaggctagtgctgccctcrgggatggaagagcttcaggctcaactggagaaagaacttcagaatggttccctgtttgaagctgacttcatccttctggatggaattccagccaacgtga

SEQ ID NO: 15340 - DNA, 201 bp, Homo sapiens
tggccaccggggcctggctcttctccgggtcgtacaaccgcgtgcagctttggctggtcgggacgcgcggggaggcggagctggagctgcagctgcggccsgcgcggggcgaggaggaggagtttgatcatgacgttgcagaggacttggggctcctgcagttcgtgaggctgcgcaagcaccactggctggtggacgacg

SEQ ID NO: 15341 - DNA, 201 bp, Homo sapiens
gcccccacccaccaccaaggaagatgtgacgatggccacagtgatggggtcactacctgatgtccggcaggcctgtcttcaaatggccatctcatggcatytgagtcgccgccagccagacatggtgcctctggggcaccacaaagaaaaatatttctcaggccccaagcccaaagctgtgctaaaccaattccgaacaga

SEQ ID NO: 15342 - DNA, 201 bp, Homo sapiens
atccgaggagagaagcaatacctggctgcccccctcgttatgctgaagatggagcccaatgggaagctgcagcccatggtcatccagattcagcctcccarccccagctctccaaccccaacactgttcctgccctcagaccccccacttgcctggctcctggcaaagtcctgggtccgaaattcagatttccaactgcac

SEQ ID NO: 15343 - DNA, 201 bp, Homo sapiens
gcctgctgggactcccaggtgctctctatgcccatgatgctttacggctctgggagatcattgccaggtatgtggaggggatcgtccacctcttctaccaragggatgacatagtgaagggggaccctgagctgcaggcctggtgtcgggagatcacggaggtggggctgtgccaggcccaggaccgaggtttccctgtct

SEQ ID NO: 15344 - DNA, 201 bp, Homo sapiens
agccagacatggtgcctctggggcaccacaaagaaaaatatttctcaggccccaagcccaaagctgtgctaaaccaattccgaacagatttggaaaagctrgaaaaggagattacagcccggaatgagcaacttgactggccctatgaatatctgaagcccagctgcatagagaacagtgtcaccatctgagccctagagt

SEQ ID NO: 15345 - DNA, 201 bp, Homo sapiens
cgtaaggatgatctacctccaaatatgagattccatgaggagaagaggctggactttgaatggacactgaaggcaggggctctggagatggccctcaaacrtgtttacaccctcctgagctcctggaactgcctagaagactttgatcagatcttctggggccagaagagtgccctggctgagaaggttcgccagtgctgg

SEQ ID NO: 15346 - DNA, 201 bp, Homo sapiens
tcctgccctcagaccccccacttgcctggctcctggcaaagtcctgggtccgaaattcagatttccaactgcacgagatccagtatcacttgctgaacackcacctggtggctgaggtcatcgctgtcgccaccatgcggtgcctcccaggactgcaccccatcttcaagttcctgatcccccatatccgctacaccatgg

SEQ ID NO: 15347 - DNA, 201 bp, Homo sapiens
ttcagctaccagttcctcaatggtgccaaccccatgctgttgagacgctcgacctctctgccctccaggctagtgctgccctcggggatggaagagcttcrggctcaactggagaaagaacttcagaatggttccctgtttgaagctgacttcatccttctggatggaattccagccaacgtgatccgaggagagaagcaa

SEQ ID NO: 15348 - DNA, 201 bp, Homo sapiens; identical to SEQ ID NO: 15338

SEQ ID NO: 15349 - DNA, 201 bp, Homo sapiens; identical to SEQ ID NO: 15339

SEQ ID NO: 15350 - DNA, 201 bp, Homo sapiens; identical to SEQ ID NO: 15340

SEQ ID NO: 15351 - DNA, 201 bp, Homo sapiens; identical to SEQ ID NO: 15341

SEQ ID NO: 15352 - DNA, 201 bp, Homo sapiens; identical to SEQ ID NO: 15342

SEQ ID NO: 15353 - DNA, 201 bp, Homo sapiens; identical to SEQ ID NO: 15343

SEQ ID NO: 15354 - DNA, 201 bp, Homo sapiens; identical to SEQ ID NO: 15344

SEQ ID NO: 15355 - DNA, 160 bp, Homo sapiens
gagatagagtctgatctggaggctggaaggcggggctaaaactcccactcacttacctcyaccaacaactaggccaccaagtcatttctgaggactggctcaagaaagcagatttaacttacactggcctagcccaggccaccagatgcatccacggaga

SEQ ID NO: 15356 - DNA, 201 bp, Homo sapiens; identical to SEQ ID NO: 15345

SEQ ID NO: 15357 - DNA, 201 bp, Homo sapiens; identical to SEQ ID NO: 15346

SEQ ID NO: 15358 - DNA, 201 bp, Homo sapiens; identical to SEQ ID NO: 15347

SEQ ID NO: 15359 - DNA, 201 bp, Homo sapiens
aggatctcacagatggccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaagacagacaccaaaccagtgcagatgatgaacatggaggccacgt

SEQ ID NO: 15360 - DNA, 185 bp, Homo sapiens
gataagctatccgtgttgcaggttcatggattacttctctataaaaaatatgtatttaccaaaaattttgtgacattccttctcccatctcttccttgacmtgcattgtaaataggttcttcttgttctgagattcaatattgaatttttcctatgctattgacaataaaatattattgaactac

SEQ ID NO: 15361 - DNA, 201 bp, Homo sapiens
tgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttat

SEQ ID NO: 15362 - DNA, 201 bp, Homo sapiens
ttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacctgcattgtaaat

SEQ ID NO: 15363 - DNA, 201 bp, Homo sapiens
gcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctatt

SEQ ID NO: 15364 - DNA, 201 bp, Homo sapiens
ttatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagt

SEQ ID NO: 15365 - DNA, 201 bp, Homo sapiens
ccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttatccacaaagtgtgcttagaaataactgaagatggtgggg

SEQ ID NO: 15366 - DNA, 201 bp, Homo sapiens
aaaattctgaattttggggattttcaaaagataatattttacatacactgtatgttatagaacttcatggatcagatctggggcagcaccctataaatcamcaccttaatatgctgcaacaaaatgtagaatattcagacaaaatggatacataaagactaagtagcccataaggggtcaaaatttgctgccaaatgcgta

SEQ ID NO: 15367 - DNA, 201 bp, Homo sapiens
ctcctcgcttgcctgttccttttccacgcattttccaggataacttccttgcttccaggcccgcaatggatgccctgcaactagcaaattcggcttttgcygttgatctgttcaaacaactatgtgaaaaggagccactgggcaatgtcctcttctctccaatctgtctctccacctctctgtcacttgctcaagtgggtg

SEQ ID NO: 15368 - DNA, 201 bp, Homo sapiens
gtttattaaaattctgaattttggggattttcaaaagataatattttacatacactgtatgttatagaacttcatggatcagatctggggcagcaccctahaaatcaacaccttaatatgctgcaacaaaatgtagaatattcagacaaaatggatacataaagactaagtagcccataaggggtcaaaatttgctgccaa

SEQ ID NO: 15369 - DNA, 197 bp, Homo sapiens
cagacacggtcgcctccacatccaggtctttgtgctcctcgcttgcctgttccttttccacgcattttccaggataacttccttgcttccaggccckcaatggatgccctgcaactagcaaattcggcttttgccgttgatctgttcaaacaactatgtgaaaaggagccactgggcaatgtcctcttctctccaat

SEQ ID NO: 15370 - DNA, 201 bp, Homo sapiens
aggttcttcattttgaaaatgtcaaagatgtaccctttggatttcaaacagtaacatcggatgtaaacaaacttagttccttttactcactgaaactaatmaagcggctctacgtagacaaatctctgaatctttctacagagttcatcagctctacgaagagaccgtatgcaaaggaattggaaactgttgacttcaaag

SEQ ID NO: 15371 - DNA, 201 bp, Homo sapiens
aatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatcaagcggctctacgtagacaaatctctgaa

SEQ ID NO: 15372 - DNA, 170 bp, Homo sapiens
ttgcaggttcatggattacttctctataaaaaatatgtatttaccaaaaattttgtgacattccttctcccatctcttccttgacctgcattgtaaatagsttcttcttgttctgagattcaatattgaatttttcctatgctattgacaataaaatattattgaactac

SEQ ID NO: 15373 - DNA, 201 bp, Homo sapiens
  misc_feature (1)...(201): n = A,T,C or G, or insertion/deletion polymorphism (see Tables 1-2)
ggcttgtctggaaaatctagggctgaaacatatcttcagtgaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgacca

SEQ ID NO: 15374 - DNA, 201 bp, Homo sapiens
acaaacttagttccttttactcactgaaactaatcaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggccactttg

SEQ ID NO: 15375 - DNA, 201 bp, Homo sapiens
ccactttgagaacattttagctgacaacagtgtgaacgaccagaccaaaatccttgtggttaatgctgcctactttgttggcaagtggatgaagaaatttyctgaatcagaaacaaaagaatgtcctttcagagtcaacaagacagacaccaaaccagtgcagatgatgaacatggaggccacgttctgtatgggaaacat

SEQ ID NO: 15376 - DNA, 201 bp, Homo sapiens
gaacgaccagaccaaaatccttgtggttaatgctgcctactttgttggcaagtggatgaagaaattttctgaatcagaaacaaaagaatgtcctttcagastcaacaagacagacaccaaaccagtgcagatgatgaacatggaggccacgttctgtatgggaaacattgacagtatcaattgtaagatcatagagcttcc

SEQ ID NO: 15377 - DNA, 201 bp, Homo sapiens
tctcacagatggcaagccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaagacagacaccaaaccagtgcagatgatgaacatggaggccacgt

SEQ ID NO: 15378 - DNA, 185 bp, Homo sapiens; identical to SEQ ID NO: 15360

SEQ ID NO: 15379 - DNA, 201 bp, Homo sapiens; identical to SEQ ID NO: 15361

SEQ ID NO: 15380 - DNA, 201 bp, Homo sapiens; identical to SEQ ID NO: 15362

SEQ ID NO: 15381 - DNA, 201 bp, Homo sapiens; identical to SEQ ID NO: 15363

SEQ ID NO: 15382 - DNA, 201 bp, Homo sapiens; identical to SEQ ID NO: 15364

SEQ ID NO: 15383 - DNA, 201 bp, Homo sapiens; identical to SEQ ID NO: 15365

SEQ ID NO: 15384 - DNA, 201 bp, Homo sapiens; identical to SEQ ID NO: 15366

SEQ ID NO: 15385 - DNA, 201 bp, Homo sapiens; identical to SEQ ID NO: 15367

SEQ ID NO: 15386 - DNA, 201 bp, Homo sapiens; identical to SEQ ID NO: 15368

SEQ ID NO: 15387 - DNA, 197 bp, Homo sapiens; identical to SEQ ID NO: 15369

SEQ ID NO: 15388 - DNA, 201 bp, Homo sapiens; identical to SEQ ID NO: 15370

SEQ ID NO: 15389 - DNA, 201 bp, Homo sapiens; identical to SEQ ID NO: 15371

SEQ ID NO: 15390 - DNA, 170 bp, Homo sapiens; identical to SEQ ID NO: 15372

SEQ ID NO: 15391 - DNA, 201 bp, Homo sapiens; identical to SEQ ID NO: 15373
  misc_feature (1)...(201): n = A,T,C or G, or insertion/deletion polymorphism (see Tables 1-2)

SEQ ID NO: 15392 - DNA, 201 bp, Homo sapiens
acaaacttagttccttttactcactgaaactaatcaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggcaagccac

SEQ ID NO: 15393 - DNA, 201 bp, Homo sapiens; identical to SEQ ID NO: 15375

SEQ ID NO: 15394 - DNA, 201 bp, Homo sapiens; identical to SEQ ID NO: 15376

SEQ ID NO: 15395 - DNA, 201 bp, Homo sapiens; identical to SEQ ID NO: 15359

SEQ ID NO: 15396 - DNA, 185 bp, Homo sapiens; identical to SEQ ID NO: 15360

SEQ ID NO: 15397 - DNA, 201 bp, Homo sapiens; identical to SEQ ID NO: 15361

SEQ ID NO: 15398 - DNA, 201 bp, Homo sapiens; identical to SEQ ID NO: 15362

SEQ ID NO: 15399 - DNA, 201 bp, Homo sapiens; identical to SEQ ID NO: 15363

SEQ ID NO: 15400 - DNA, 201 bp, Homo sapiens; identical to SEQ ID NO: 15364

SEQ ID NO: 15401 - DNA, 201 bp, Homo sapiens; identical to SEQ ID NO: 15365

SEQ ID NO: 15402 - DNA, 201 bp, Homo sapiens; identical to SEQ ID NO: 15366

SEQ ID NO: 15403 - DNA, 201 bp, Homo sapiens
gtgctcctcgcttgcctgttccttttccacgcattttccaggataactgtgactccaggcccgcaatggatgccctgcaactagcaaattcggcttttgcygttgatctgttcaaacaactatgtgaaaaggagccactgggcaatgtcctcttctctccaatctgtctctccacctctctgtcacttgctcaagtgggtg

SEQ ID NO: 15404 - DNA, 201 bp, Homo sapiens; identical to SEQ ID NO: 15368

SEQ ID NO: 15405 - DNA, 201 bp, Homo sapiens
ttctgcccagacacggtcgcctccacatccaggtctttgtgctcctcgcttgcctgttccttttccacgcattttccaggataactgtgactccaggccckcaatggatgccctgcaactagcaaattcggcttttgccgttgatctgttcaaacaactatgtgaaaaggagccactgggcaatgtcctcttctctccaat

SEQ ID NO: 15406 - DNA, 201 bp, Homo sapiens; identical to SEQ ID NO: 15370

SEQ ID NO: 15407 - DNA, 201 bp, Homo sapiens; identical to SEQ ID NO: 15371

SEQ ID NO: 15408 - DNA, 170 bp, Homo sapiens; identical to SEQ ID NO: 15372

SEQ ID NO: 15409 - DNA, 201 bp, Homo sapiens; identical to SEQ ID NO: 15373
  misc_feature (1)...(201): n = A,T,C or G, or insertion/deletion polymorphism (see Tables 1-2)

SEQ ID NO: 15410 - DNA, 201 bp, Homo sapiens; identical to SEQ ID NO: 15374

SEQ ID NO: 15411 - DNA, 201 bp, Homo sapiens; identical to SEQ ID NO: 15375

SEQ ID NO: 15412 - DNA, 201 bp, Homo sapiens; identical to SEQ ID NO: 15376

SEQ ID NO: 15413 - DNA, 201 bp, Homo sapiens
tctcacagatggcaagccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaaggtatgtggggcagcatgtagcagtaaaaggagcccaattatag

SEQ ID NO: 15414 - DNA, 201 bp, Homo sapiens; identical to SEQ ID NO: 15392

SEQ ID NO: 15415 - DNA, 201 bp, Homo sapiens
tggttaatgctgcctactttgttggcaagtggatgaagaaattttctgaatcagaaacaaaagaatgtcctttcagagtcaacaaggtatgtggggcagcrtgtagcagtaaaaggagcccaattatagatgtgaaaaatgatagggacagagtggggcataaatccattccaatgaggaacctgagggcacggccggcaa

SEQ ID NO: 15416 - DNA, 201 bp, Homo sapiens
ccactttgagaacattttagctgacaacagtgtgaacgaccagaccaaaatccttgtggttaatgctgcctactttgttggcaagtggatgaagaaatttyctgaatcagaaacaaaagaatgtcctttcagagtcaacaaggtatgtggggcagcatgtagcagtaaaaggagcccaattatagatgtgaaaaatgatag

SEQ ID NO: 15417 - DNA, 170 bp, Homo sapiens
tttctgaatcagaaacaaaagaatgtcctttcagagtcaacaaggtatgtggggcagcatgtagcagtaaaaggagcccaattatagatgtgaaaaatgayagggacagagtggggcataaatccattccaatgaggaacctgagggcacggccggcaaagtgcctttcc

SEQ ID NO: 15418 - DNA, 201 bp, Homo sapiens
gaacgaccagaccaaaatccttgtggttaatgctgcctactttgttggcaagtggatgaagaaattttctgaatcagaaacaaaagaatgtcctttcagastcaacaaggtatgtggggcagcatgtagcagtaaaaggagcccaattatagatgtgaaaaatgatagggacagagtggggcataaatccattccaatgag

SEQ ID NO: 15419 - DNA, 201 bp, Homo sapiens; identical to SEQ ID NO: 15367

SEQ ID NO: 15420 - DNA, 197 bp, Homo sapiens; identical to SEQ ID NO: 15369

SEQ ID NO: 15421 - DNA, 201 bp, Homo sapiens; identical to SEQ ID NO: 15370

SEQ ID NO: 15422 - DNA, 201 bp, Homo sapiens; identical to SEQ ID NO: 15371

SEQ ID NO: 15423 - DNA, 201 bp, Homo sapiens
aaaattctgaattttggggattttcaaaagataatattttacatacactgtatgttatagaacttcatggatcagatctggggcagcaacctataaatcamcaccttaatatgctgcaacaaaatgtagaatattcagacaaaatggatacataaagactaagtagcccataaggggtcaaaatttgctgccaaatgcgta

SEQ ID NO: 15424 - DNA, 201 bp, Homo sapiens
gtttattaaaattctgaattttggggattttcaaaagataatattttacatacactgtatgttatagaacttcatggatcagatctggggcagcaacctahaaatcaacaccttaatatgctgcaacaaaatgtagaatattcagacaaaatggatacataaagactaagtagcccataaggggtcaaaatttgctgccaa

SEQ ID NO: 15425 - DNA, 201 bp, Homo sapiens
aggttcttcattttgaaaatgtcaaagatataccctttggatttcaaacagtaacatcggatgtaaacaaacttagttccttttactcactgaaactaatmaagcggctctacgtagacaaatctctgaatctttctacagagttcatcagctctacgaagagaccctatgcaaaggaattggaaactgttgacttcaaag

SEQ ID NO: 15426 - DNA, 201 bp, Homo sapiens; identical to SEQ ID NO: 15371

SEQ ID NO: 15427 - DNA, 201 bp, Homo sapiens
aggatctcacagatggccactttgagaacattttagctgacaacagtgtgaacgaccagaccaaaatccttgtggttaatgctgcctactttgttggcaartggatgaagaaatttcctgaatcagaaacaaaagaatgtcctttcagactcaacaagacagacaccaaaccagtgcagatgatgaacatggaggccacgt

SEQ ID NO: 15428 - DNA, 201 bp, Homo sapiens
ccactttgagaacattttagctgacaacagtgtgaacgaccagaccaaaatccttgtggttaatgctgcctactttgttggcaagtggatgaagaaatttyctgaatcagaaacaaaagaatgtcctttcagactcaacaagacagacaccaaaccagtgcagatgatgaacatggaggccacgttctgtatgggaaacat

SEQ ID NO: 15429 - DNA, 201 bp, Homo sapiens
gaacgaccagaccaaaatccttgtggttaatgctgcctactttgttggcaagtggatgaagaaatttcctgaatcagaaacaaaagaatgtcctttcagastcaacaagacagacaccaaaccagtgcagatgatgaacatggaggccacgttctgtatgggaaacattgacagtatcaattgtaagatcatagagcttcc

SEQ ID NO: 15430 - DNA, 201 bp, Homo sapiens
ttgacacatagtttttcagtctatgggtttagttactttagatggcaagcatgtaacttatattaatagtaatttgtaaagttgggtggataagctatccrtgttgccggttcatggattacttctctataaaaaatatatatttaccaaaaaattttgtgacattccttctcccatctcttccttgacatgcattgtaaa

SEQ ID NO: 15431 - DNA, 201 bp, Homo sapiens; identical to SEQ ID NO: 15364

SEQ ID NO: 15432 - DNA, 201 bp, Homo sapiens; identical to SEQ ID NO: 15365

SEQ ID NO: 15433 - DNA, 201 bp, Homo sapiens; identical to SEQ ID NO: 15374

SEQ ID NO: 15434 - DNA, 201 bp, Homo sapiens; identical to SEQ ID NO: 15373
  misc_feature (1)...(201): n = A,T,C or G, or insertion/deletion polymorphism (see Tables 1-2)

SEQ ID NO: 15435 - DNA, 201 bp, Homo sapiens
tgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttatt

SEQ ID NO: 15436 - DNA, 201 bp, Homo sapiens
cccatctggagtgggagtgggcacttccaccccgcccacaggccatccggctgtgcaggccagcccctaggagcaggtcccgggtgactggcagttttcayggtctagggccgagacgatggcatggggcctagagcatgaggtagagcagaatgcagaccacgccgctggatgccgagagaccctgctctccgagggagg

SEQ ID NO: 15437 - DNA, 201 bp, Homo sapiens
tgtgtgttctctttctcgtcaccctggagtggtgactggcatctgtgggtagttcgtctttggtgtgattttctcagcagttctcaacactgtgttcaacrgcccctcgggagccacattgagggagacccaggtgtggtcatggcaagagggtggctgcctgtccctgtcctctggctgccagacagtcagcagttgccc

SEQ ID NO: 15438 - DNA, 201 bp, Homo sapiens
agattgctgaagagtatggcggggtgatggtcagcttcccacgctctggcacacagagcgacaaagtcaccctcaagggcgccaaggactgtgtggaggcrgccaagaaacgcattcaggagatcattgaggacctggaagctcaggtgacattagaatgtgctataccccagaaattccatcgatctgtcatgggcccca

SEQ ID NO: 15439 - DNA, 201 bp, Homo sapiens
tagaccccaaataccatcccaagattatcgggagaaagggggcagtaattacccaaatccggttggagcatgacgtgaacatccagtttcctgataaggaygatgggaaccagccccaggaccaaattaccatcacagggtacgaaaagaacacagaagctgccagggatgctatactgagaattgtgggtgaacttgagc

SEQ ID NO: 15440 - DNA, 201 bp, Homo sapiens
gaggagaacgcagttcacagtacagagccagttgtccaggagaatggggacgaagctggggaggggagagaggctaaagattgtgaccccggctctccaasgaggtgtgacatcatcatcatctctggccggaaagaaaagtgtgaggctgccaaggaagctctggaggcattggttcctgtcaccattgaagtagaggtg

SEQ ID NO: 15441 - DNA, 201 bp, Homo sapiens
ctctggccggaaagaaaagtgtgaggctgccaaggaagctctggaggcattggttcctgtcaccattgaagtagaggtgccctttgaccttcaccgttacrttattgggcagaaaggaagtgggatccgcaagatgatggatgagtttgaggtgaacatacatgtcccggcacctgagctgcagtctgacatcatcgccat

SEQ ID NO: 15442 - DNA, 201 bp, Homo sapiens
cagaacctggccaaaatcactcagcagatgccaaaggttcacatcgagttcacagagggcgaagacaagatcaccctggagggccctacagaggatgtcartgtggcccaggaacagatagaaggcatggtcaaagatttgattaaccggatggactatgtggagatcaacatcgaccacaagttccacaggcacctcatt

SEQ ID NO: 15443 - DNA, 201 bp, Homo sapiens
cagctttggggctcaggtggctcccaagaccctcccttggggccccaaacgataatgatcaaaaagaacagaaccctctccagccagcggctggaccctcygtaaattgttgacgctcttcccccttcccgaggtcccgcagggagcctagcgcctggctgtgtgtgcggccgctcctccaggcctggccgtgcccgctca

SEQ ID NO: 15444 - DNA, 201 bp, Homo sapiens
ttcccttggtccagacagtcctgtttgtggagtgcaatcagcctcctccagctgccagagcgcctcagcacaggtgtcagggtgcaaggaagacctggcartggacagcaggaggcaggttcctggagctggggggtgacctgagaggcagagggtgacgggttctcaggcagtcctgattttacctgccgtggggtctga

SEQ ID NO: 15445 - DNA, 201 bp, Homo sapiens
gcaccctggaccgccagcagcagtgagaaggctcctgacatgagcagctctgaggaatttcccagctttggggctcaggtggctcccaagaccctcccttkgggccccaaacgataatgatcaaaaagaacagaaccctctccagccagcggctggaccctccgtaaattgttgacgctcttcccccttcccgaggtcccg

SEQ ID NO: 15446 - DNA, 201 bp, Homo sapiens
atttgattaaccggatggactatgtggagatcaacatcgaccacaagttccacaggcacctcattgggaagagcggtgccaacataaacagaatcaaagaycagtacaaggtgtccgtgcgcatccctcctgacagtgagaagagcaatttgatccgcatcgagggggacccacagggcgtgcagcaggccaagcgagagc

SEQ ID NO: 15447 - DNA, 201 bp, Homo sapiens
actcacgcccatccatctcacagcccttccctggggacagtcgcttccgccttgacacctcactctcagttgaataactcaagcttggtcatcttcagackcgaattcttgagtagacccagacggcttagcccaagtctagttgcagctgcctcggcaagtccccatttgctcaggcagccctgaatgggcctgtttaca

SEQ ID NO: 15448 - DNA, 201 bp, Homo sapiens
tcaccctggagtggtgactggcatctgtgggtagttcgtctttggtgtgattttctcagcagttctcaacactgtgttcaacggcccctcgggagccacaytgagggagacccaggtgtggtcatggcaagagggtggctgcctgtccctgtcctctggctgccagacagtcagcagttgccctgcagccctcattgaggg

SEQ ID NO: 15449 - DNA, 201 bp, Homo sapiens
ctgtgtcatgctgtgagggctgaggacggggccctagtctctggttttctggtcttaacatccttatctgtgtccgccacggaggtgactgagctgctagygagttgtcctgtcccaggtacttgagttttggaaaagctgactcacgcccatccatctcacagcccttccctggggacagtcgcttccgccttgacacct

SEQ ID NO: 15450 - DNA, 201 bp, Homo sapiens
cctcggcaagtccccatttgctcaggcagccctgaatgggcctgtttacaggaatggtaaattgggattggaaggaatatagcttccagcttcataggctrgggtgaccacggcttaggaaacagggaaagaaagcaaggcccttttcctgcctttcccgggatctgtctactccacctccacgggggaggccagtgggga

SEQ ID NO: 15451 - DNA, 201 bp, Homo sapiens
ctgaggaatttcccagctttggggctcaggtggctcccaagaccctcccttggggccccaaacgataatgatcaaaaagaacagaaccctctccagccagyggctggaccctccgtaaattgttgacgctcttcccccttcccgaggtcccgcagggagcctagcgcctggctgtgtgtgcggccgctcctccaggcctgg

SEQ ID NO: 15452 - DNA, 201 bp, Homo sapiens
ataatgtggtggaagactccatgctggtggaccccaagcaccaccgccacttcgtcatccgcagaggccaggtcttgcgggagattgctgaagagtatggyggggtgatggtcagcttcccacgctctggcacacagagcgacaaagtcaccctcaagggcgccaaggactgtgtggaggcagccaagaaacgcattcagg

SEQ ID NO: 15453 - DNA, 201 bp, Homo sapiens
aggaatttcccagctttggggctcaggtggctcccaagaccctcccttggggccccaaacgataatgatcaaaaagaacagaaccctctccagcctgctgrcccaaacccaaccacacaatggtttgtctcaatctgacccagcggctggaccctccgtaaattgttgacgctcttcccccttcccgaggtcccgcaggga

SEQ ID NO: 15454 - DNA, 201 bp, Homo sapiens; identical to SEQ ID NO: 15436

SEQ ID NO: 15455 - DNA, 161 bp, Homo sapiens
cggcttctcccgcgcggggggcgagtaagccagcggcaggaccagcgggcgggggcccacraacacatgcctcactcctgtcagcagttccaccttttcatggttgaggagcacatgtggtcgccagcctcccatctccagagtcccctaaggcaagatcc

SEQ ID NO: 15456 - DNA, 201 bp, Homo sapiens; identical to SEQ ID NO: 15439

SEQ ID NO: 15457 - DNA, 201 bp, Homo sapiens; identical to SEQ ID NO: 15440

SEQ ID NO: 15458 - DNA, 201 bp, Homo sapiens; identical to SEQ ID NO: 15441

SEQ ID NO: 15459 - DNA, 201 bp, Homo sapiens; identical to SEQ ID NO: 15442

SEQ ID NO: 15460 - DNA, 201 bp, Homo sapiens
aaacgataatgatcaaaaagaacagaaccctctccagcctgctgacccaaacccaaccacacaatggtttgtctcaatctgacccagcggctggaccctcygtaaattgttgacgctcttcccccttcccgaggtcccgcagggagcctagcgcctggctgtgtgtgcggccgctcctccaggcctggccgtgcccgctca

SEQ ID NO: 15461 - DNA, 201 bp, Homo sapiens
gcaccctggaccgccagcagcagtgagaaggctcctgacatgagcagctctgaggaatttcccagctttggggctcaggtggctcccaagaccctcccttkgggccccaaacgataatgatcaaaaagaacagaaccctctccagcctgctgacccaaacccaaccacacaatggtttgtctcaatctgacccagcggctg

SEQ ID NO: 15462 - DNA, 201 bp, Homo sapiens; identical to SEQ ID NO: 15447

SEQ ID NO: 15463 - DNA, 201 bp, Homo sapiens; identical to SEQ ID NO: 15449

SEQ ID NO: 15464 - DNA, 201 bp, Homo sapiens; identical to SEQ ID NO: 15450

SEQ ID NO: 15465 - DNA, 201 bp, Homo sapiens; identical to SEQ ID NO: 15452

SEQ ID NO: 15466 - DNA, 142 bp, Homo sapiens
cacctccacgggggaggccagtggggaagggctgtcacctcttccccatctgcatgagttctggaactctgtcctgttggctgcttgcttccagctccccscaatctccatcgcagcgggttcctcctgtcttttctacagt

SEQ ID NO: 15467 - DNA, 125 bp, Homo sapiens
ccagtggggaagggctgtcacctcttccccatctgcatgagttctggaactctgtcctgttggctgcttgcttccagctccccccaatctccatcgcagcrggttcctcctgtcttttctacagt

SEQ ID NO: 15468 - DNA, 201 bp, Homo sapiens; identical to SEQ ID NO: 15438

SEQ ID NO: 15469 - DNA, 201 bp, Homo sapiens
atttcccagctttggggctcaggtggctcccaagaccctcccttggggccccaaacgataatgatcaaaaagaacagaaccctctccagcctgctgacccraacccaaccacacaatggtttgtctcaatctgacccagcggctggaccctccgtaaattgttgacgctcttcccccttcccgaggtcccgcagggagcct

SEQ ID NO: 15470 - DNA, 201 bp, Homo sapiens; identical to SEQ ID NO: 15444

SEQ ID NO: 15471 - DNA, 201 bp, Homo sapiens; identical to SEQ ID NO: 15446

SEQ ID NO: 15472 - DNA, 201 bp, Homo sapiens
ctttggggctcaggtggctcccaagaccctcccttggggccccaaacgataatgatcaaaaagaacagaaccctctccagcctgctgacccaaacccaacyacacaatggtttgtctcaatctgacccagcggctggaccctccgtaaattgttgacgctcttcccccttcccgaggtcccgcagggagcctagcgcctgg

SEQ ID NO: 15473 - DNA, 201 bp, Homo sapiens
cccttggggccccaaacgataatgatcaaaaagaacagaaccctctccagcctgctgacccaaacccaaccacacaatggtttgtctcaatctgacccagyggctggaccctccgtaaattgttgacgctcttcccccttcccgaggtcccgcagggagcctagcgcctggctgtgtgtgcggccgctcctccaggcctgg

SEQ ID NO: 15474 - DNA, 201 bp, Homo sapiens; identical to SEQ ID NO: 15453

SEQ ID NO: 15475 - DNA, 201 bp, Homo sapiens; identical to SEQ ID NO: 15436

SEQ ID NO: 15476 - DNA, 175 bp, Homo sapiens
gcctcggagcgtcccggcttctcccgcgcggggggcgagtaagccagcggcaggaccagcgggcgggggcccacracaaaagctggcaggctgacagaggcggcctcaggacggaccttctggctactgaccgttttgctgtggttttcccggattgtgtgtaggtgtgagatca

SEQ ID NO: 15477 - DNA, 201 bp, Homo sapiens; identical to SEQ ID NO: 15439

SEQ ID NO: 15478 - DNA, 201 bp, Homo sapiens; identical to SEQ ID NO: 15440

SEQ ID NO: 15479 - DNA, 201 bp, Homo sapiens; identical to SEQ ID NO: 15441

SEQ ID NO: 15480 - DNA, 201 bp, Homo sapiens; identical to SEQ ID NO: 15442

SEQ ID NO: 15481 - DNA, 201 bp, Homo sapiens; identical to SEQ ID NO: 15460

SEQ ID NO: 15482 - DNA, 201 bp, Homo sapiens; identical to SEQ ID NO: 15461

SEQ ID NO: 15483 - DNA, 201 bp, Homo sapiens; identical to SEQ ID NO: 15447

SEQ ID NO: 15484 - DNA, 201 bp, Homo sapiens; identical to SEQ ID NO: 15449

SEQ ID NO: 15485 - DNA, 201 bp, Homo sapiens; identical to SEQ ID NO: 15450

SEQ ID NO: 15486 - DNA, 201 bp, Homo sapiens; identical to SEQ ID NO: 15452

SEQ ID NO: 15487 - DNA, 142 bp, Homo sapiens; identical to SEQ ID NO: 15466

SEQ ID NO: 15488 - DNA, 125 bp, Homo sapiens; identical to SEQ ID NO: 15467

SEQ ID NO: 15489 - DNA, 201 bp, Homo sapiens; identical to SEQ ID NO: 15438

SEQ ID NO: 15490 - DNA, 201 bp, Homo sapiens; identical to SEQ ID NO: 15469

SEQ ID NO: 15491 - DNA, 201 bp, Homo sapiens; identical to SEQ ID NO: 15444

SEQ ID NO: 15492 - DNA, 201 bp, Homo sapiens; identical to SEQ ID NO: 15446

SEQ ID NO: 15493 - DNA, 201 bp, Homo sapiens; identical to SEQ ID NO: 15472

SEQ ID NO: 15494 - DNA, 201 bp, Homo sapiens; identical to SEQ ID NO: 15473

SEQ ID NO: 15495 - DNA, 201 bp, Homo sapiens
atctcagtcaggataagctcacagatgtggccatcggggcccccctggaaggttttggggcagatgatggtgccagcttcggcagtgtgtatatctacaayggacactgggacggcctctccgccagcccctcgcagcggatcagagcctccacggtggccccaggactccagtacttcggcatgtccatggctggtggct

SEQ ID NO: 15496 - DNA, 201 bp, Homo sapiens
cacaaagaattcctcttccatgtacatggggagaacctctttggagcagaataccagttgcaaatttgcgtcccaaccaaattacgaggtctccaggttgyagcagtgaagaagctgacgaggactcaggcctccacggtgtgcacctggagtcaggagcgcgcttgtgcgtacagttcggttcagcatgtggaagaatgg

SEQ ID NO: 15497 - DNA, 162 bp, Homo sapiens
tctgtccccgcctcctggcctcctggctgaggggaagctgagtgggccacggcccatgtgtygcactcgcctcggctcccacacagccgcctctgctccagcaaggatgtggctcttccacactctgctctgcatagccagcctggccctgctggccgcttt

SEQ ID NO: 15498 - DNA, 103 bp, Homo sapiens
tagtttttaaccatacattgtcccaaaagtgtctgtgcattgtgcaaaaagtaaacttaggaaacatttggtattaaataaatttacacttttctttgcarta

SEQ ID NO: 15499 - DNA, 201 bp, Homo sapiens
gcggcggcagacgcggaggctgcgcagtacagctacctgggttacgctgtggccgtgctgcacaagacctgcagcctctcctacgtcgcgggggctccacrgtacaaacatcatggggccgtgtttgagctccagaaggagggcagagaggccagcttcctgccagtgctggagggagagcagatggggtcctattttggc

SEQ ID NO: 15500 - DNA, 201 bp, Homo sapiens
ctaactccggggaagattcctacatgacaagcatggccttgaattaccccagaaacctgcagttgaagaggatgcaaaagcctccctctccaaacattcastgtgatgaccctcagccggttgcttctgtcctgatcatgaactgcaggattggtcaccccgtcctcaagaggtcatctgctcatgtttcagtcgtttggc

SEQ ID NO: 15501 - DNA, 201 bp, Homo sapiens
cctggaccgctacactgagccctttgccatcttccagctgccctatgagaaggcctgcaagaataagctgttttgtgtcgcagaattacagttggccaccrccgtctctcagcaggagttggtggtgggtctcacaaaggagctgaccctgaacattaacctaactaactccggggaagattcctacatgacaagcatggc

SEQ ID NO: 15502 - DNA, 201 bp, Homo sapiens
ggccgtgctgcacaagacctgcagcctctcctacgtcgcgggggctccacggtacaaacatcatggggccgtgtttgagctccagaaggagggcagagagkccagcttcctgccagtgctggagggagagcagatggggtcctattttggctctgagctgtgccctgtggacattgacatggatggaagcacggacttctt

SEQ ID NO: 15503 - DNA, 201 bp, Homo sapiens
gtcatctgctcatgtttcagtcgtttggcagctagaggagaatgcctttccaaacaggacagcagacatcactgtgactgtcaccaattccaatgaaagayggtctttggccaacgagacccacacccttcaattcaggcatggcttcgttgcagttctgtccaaaccatccataatgtacgtgaacacaggccaggggct

SEQ ID NO: 15504 - DNA, 201 bp, Homo sapiens
tgtagcagtgaagaagctgacgaggactcaggcctccacggtgtgcacctggagtcaggagcgcgcttgtgcgtacagttcggttcagcatgtggaagaakggcattcagtgagctgtgtcatcgcttcagataaagaaaatgtcaccgtggctgcagagatctcctgggatcactctgaggagttactaaaagatgtaac

SEQ ID NO: 15505 - DNA, 201 bp, Homo sapiens
tcacccccagcgcactgcccatcggcttcaacggcgtcgtgaatgtccgtttatgttttgaaatcagctctgtaaccacagcctctgagtcaggcctccgygaggcacttctcaacttcacgctggatgtggatgtggggaagcagaggagacggctgcagtgttcagacgtaagaagctgtctgggctgcctgagggagt

SEQ ID NO: 15506 - DNA, 201 bp, Homo sapiens
gaaccagacagcggcggcggcggcagacgcggaggctgcgcagtacagctacctgggttacgctgtggccgtgctgcacaagacctgcagcctctcctacrtcgcgggggctccacggtacaaacatcatggggccgtgtttgagctccagaaggagggcagagaggccagcttcctgccagtgctggagggagagcagat

SEQ ID NO: 15507 - DNA, 201 bp, Homo sapiens
cagagatctcctgggatcactctgaggagttactaaaagatgtaactgaactgcagatccttggtgaaatatctttcaacaaatctctatatgagggactkaatgcagagaaccacagaactaagatcactgtcgtcttcctgaaagatgagaagtaccattctttgcctatcatcattaaaggcagcgttggtggacttc

SEQ ID NO: 15508 - DNA, 201 bp, Homo sapiens; identical to SEQ ID NO: 15501

SEQ ID NO: 15509 - DNA, 201 bp, Homo sapiens; identical to SEQ ID NO: 15500

SEQ ID NO: 15510 - DNA, 201 bp, Homo sapiens; identical to SEQ ID NO: 15496

SEQ ID NO: 15511 - DNA, 201 bp, Homo sapiens
ggccgtgctgcacaagacctgcagcctctcctacgtcgcgggggctccacagtacaaacatcatggggccgtgtttgagctccagaaggagggcagagagkccagcttcctgccagtgctggagggagagcagatggggtcctattttggctctgagctgtgccctgtggacattgacatggatggaagcacggacttctt

SEQ ID NO: 15512 - DNA, 201 bp, Homo sapiens; identical to SEQ ID NO: 15503

SEQ ID NO: 15513 - DNA, 201 bp, Homo sapiens; identical to SEQ ID NO: 15499

SEQ ID NO: 15514 - DNA, 201 bp, Homo sapiens; identical to SEQ ID NO: 15495

SEQ ID NO: 15515 - DNA, 201 bp, Homo sapiens
tgcagcagtgaagaagctgacgaggactcaggcctccacggtgtgcacctggagtcaggagcgcgcttgtgcgtacagttcggttcagcatgtggaagaakggcattcagtgagctgtgtcatcgcttcagataaagaaaatgtcaccgtggctgcagagatctcctgggatcactctgaggagttactaaaagatgtaac

SEQ ID NO: 15516 - DNA, 201 bp, Homo sapiens; identical to SEQ ID NO: 15505

SEQ ID NO: 15517 - DNA, 201 bp, Homo sapiens; identical to SEQ ID NO: 15507

SEQ ID NO: 15518 - DNA, 201 bp, Homo sapiens
gaaccagacagcggcggcggcggcagacgcggaggctgcgcagtacagctacctgggttacgctgtggccgtgctgcacaagacctgcagcctctcctacrtcgcgggggctccacagtacaaacatcatggggccgtgtttgagctccagaaggagggcagagaggccagcttcctgccagtgctggagggagagcagat

SEQ ID NO: 15519 - DNA, 201 bp, Homo sapiens
ggcagctggctccggttttggggtatctgggctccaggcagaagcacagcctccccgacctgccctacgactacggcgccctggaacctcacatcaacgckcagatcatgcagctgcaccacagcaagcaccacgcggcctacgtgaacaacctgaacgtcaccgaggagaagtaccaggaggcgttggccaagggtaggt

SEQ ID NO: 15520 - DNA, 167 bp, Homo sapiens
tacacatattgccagcactggtgaattgtagggcctgaaaagaaagctctactgtgtcactcgttttttttgcaaattgaaattgttcttgttgtataatrtgctttggggaaatgtttggtctctcaggtaggtgtgccagccgtttgcaggagggctgagagcgc

SEQ ID NO: 15521 - DNA, 201 bp, Homo sapiens
cggcagcggcttcagcagatcggcggcatcagcggtagcaccagcactagcagcatgttgagccgggcagtgtgcggcaccagcaggcagctggctccggytttggggtatctgggctccaggcagaagcacagcctccccgacctgccctacgactacggcgccctggaacctcacatcaacgcgcagatcatgcagctg

SEQ ID NO: 15522 - DNA, 201 bp, Homo sapiens
caacgcgcagatcatgcagctgcaccacagcaagcaccacgcggcctacgtgaacaacctgaacgtcaccgaggagaagtaccaggaggcgttggccaagrgtaggttccaggctgagcggcgggaggcagtccccggcagaggcgaccccagggagccaggccccatacggacgggcctctccgtggaggagaactcgct

SEQ ID NO: 15523 - DNA, 166 bp, Homo sapiens
acacatattgccagcactggtgaattgtagggcctgaaaagaaagctctactgtgtcactcgttttttttgcaaattgaaattgttcttgttgtataataygctttggggaaatgtttggtctctcaggtaggtgtgccagccgtttgcaggagggctgagagcgc

SEQ ID NO: 15524 - DNA, 201 bp, Homo sapiens
ggcagctggctccggttttggggtatctgggctccaggcagaagcacagcctccccgacctgccctacgactacggcgccctggaacctcacatcaacgckcagatcatgcagctgcaccacagcaagcaccacgcggcctacgtgaacaacctgaacgtcaccgaggagaagtaccaggaggcgttggccaagggagatg

SEQ ID NO: 15525 - DNA, 177 bp, Homo sapiens
cctattggaatattttctttatataggcgttttttttttttctttttttttggagacagagtcttgctctgttgcccaggctggagtgcagtggcgcgacyggagctcactgcaacctccacttcccgggttcaagtgattgtcccacctcagcctcctgaatagctgggattacag

SEQ ID NO: 15526 - DNA, 201 bp, Homo sapiens
aatgctttgtgtgattgaatctgattggacattttcttcagagagctaaattacaattgtcatttataaaaccatcaaaaatattccatccatatactttsgggacttgtagggatgcctttctagtcctattctattgcagttatagaaaatctagtcttttgccccagttacttaaaaataaaatattaacactttccc

SEQ ID NO: 15527 - DNA, 201 bp, Homo sapiens; identical to SEQ ID NO: 15521

SEQ ID NO: 15528 - DNA, 201 bp, Homo sapiens
tatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccggg

SEQ ID NO: 15529 - DNA, 201 bp, Homo sapiens
atcgttatgctgagtatgttaagctctttatgactgtttttgtagtggtatagagtactgcagaatacagtaagctgctctattgtagcatttcttgatgytgcttagtcacttatttcataaacaacttaatgttctgaataatttcttactaaacattttgttattgggcaagtgattgaaaatagtaaatgctttgtg

SEQ ID NO: 15530 - DNA, 201 bp, Homo sapiens
caacgcgcagatcatgcagctgcaccacagcaagcaccacgcggcctacgtgaacaacctgaacgtcaccgaggagaagtaccaggaggcgttggccaagrgagatgttacagcccagatagctcttcagcctgcactgaagttcaatggtggtggtcatatcaatcatagcattttctggacaaacctcagccctaacgg

SEQ ID NO: 15531 - DNA, 103 bp, Homo sapiens
cccaggctggagtgcagtggcgcgaccggagctcactgcaacctccacttcccgggttcaagtgattgtcccacctcagcctcctgaatagctgggattayag

SEQ ID NO: 15532 - DNA, 201 bp, Homo sapiens; identical to SEQ ID NO: 15524

SEQ ID NO: 15533 - DNA, 201 bp, Homo sapiens; identical to SEQ ID NO: 15526

SEQ ID NO: 15534 - DNA, 201 bp, Homo sapiens; identical to SEQ ID NO: 15521

SEQ ID NO: 15535 - DNA, 201 bp, Homo sapiens; identical to SEQ ID NO: 15529

SEQ ID NO: 15536 - DNA, 201 bp, Homo sapiens; identical to SEQ ID NO: 15530

SEQ ID NO: 15537 - DNA, 201 bp, Homo sapiens; identical to SEQ ID NO: 15524

SEQ ID NO: 15538 - DNA, 201 bp, Homo sapiens
cctattggaatattttctttatataggcgttttttttttttctttttttttggagacagagtcttgctctgttgcccaggctggagtgcagtggcgcgacyggagctcactgcaacctccacttcccgggttcaagtgattgtcccacctcagcctcctgaatagctgggattacaggtgtgagccactgcacctggccta

SEQ ID NO: 15539 - DNA, 201 bp, Homo sapiens; identical to SEQ ID NO: 15526

SEQ ID NO: 15540 - DNA, 201 bp, Homo sapiens; identical to SEQ ID NO: 15521

SEQ ID NO: 15541 - DNA, 201 bp, Homo sapiens
ttttgtgactgaatcagcagtgcctgccctagtcatagctgtgcttcaaaaacctcagcatgattagtgttggagcaaaacaaggaagcaaagcaaatacwgtttttgaaattctatctgttgcttgaactattttgtaataattaaactttgatgttgagaaatcacaactttattgtacacttcattgcaacttgaaat

SEQ ID NO: 15542 - DNA, 201 bp, Homo sapiens; identical to SEQ ID NO: 15528

SEQ ID NO: 15543 - DNA, 201 bp, Homo sapiens
ttcccgggttcaagtgattgtcccacctcagcctcctgaatagctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagt

SEQ ID NO: 15544 - DNA, 201 bp, Homo sapiens; identical to SEQ ID NO: 15529

SEQ ID NO: 15545 - DNA, 201 bp, Homo sapiens; identical to SEQ ID NO: 15530

SEQ ID NO: 15546 - DNA, 201 bp, Homo sapiens
tgtgtatgcatgcttgtggattggaaaaactttggagactgattacttttcattatatatgtgtcacagtgaaacagcttttatgtgtcatgtaagattaytgcttgcctctctaaggaaggtcgtgactgtttaaatagacgggcaaggtggaaccttttgaaagatgagcttttgaatataagttgtctgctagatcat

SEQ ID NO: 15547 - DNA, 201 bp, Homo sapiens
cccaggctggagtgcagtggcgcgaccggagctcactgcaacctccacttcccgggttcaagtgattgtcccacctcagcctcctgaatagctgggattayaggtgtgagccactgcacctggcctatataggcttttttcttaaacctatttagtaatgttttcccaagtttattttttatttttaattttttccccaag

SEQ ID NO: 15548 - DNA, 201 bp, Homo sapiens
ttatttttaattttttccccaagtttatttttctatttttttttcatggaaaaatggggtaacttagcagtttcaatattgaagactgaagtttaaaaaamatttaaattcaaggtacttttaaaattcagttagaaaagtaggctttaaaaattattagagacaagagtaccaaagcggtgtgtgtatgtgtgtgtgtgt

SEQ ID NO: 15549 - DNA, 201 bp, Homo sapiens; identical to SEQ ID NO: 15529

SEQ ID NO: 15550 - DNA, 201 bp, Homo sapiens
ggcagctgcctccggttttggggtatctgggctccaggcagaagcacagcctccccgacctgccctacgactacggcgccctggaacctcacatcaacgckcagatcatgcagctgcaccacagcaagcaccacgcggcctacgtgaacaacctgaacgtcaccgaggagaagtaccaggaggcgttggccaagggagatg

SEQ ID NO: 15551 - DNA, 201 bp, Homo sapiens
atggcccagaagaggtttcccatctgcacctgtggataggccagcagtcatcccgggatgagcagggggcctgtgccgtgctggctgtgcacctcaacacrctgctgggagagcggcctgtgcagcaccgcgaggtgcagggcaatgagtctgacctcttcatgagctacttcccacggggcctcaagtaccaggaaggtg

SEQ ID NO: 15552 - DNA, 201 bp, Homo sapiens
ggtggttggggcagccagagaagtaagagggaagtgagaagccgggtggggcaggctggaaggaagacgaacctacgaagcagagatctgaagacagcatrtacacagccattccccagagtggctctccattcccaggctcagtgcaggatccaggcctgcatgtgtggcgggtggagaagctgaagccggtgcctgtgg

SEQ ID NO: 15553 - DNA, 201 bp, Homo sapiens
gagtggctctccattcccaggctcagtgcaggatccaggcctgcatgtgtggcgggtggagaagctgaagccggtgcctgtggcgcaagagaaccagggcrtcttcttctcgggggactcctacctagtgctgcacaatggcccagaagaggtttcccatctgcacctgtggataggccagcagtcatcccgggatgagca

SEQ ID NO: 15554 - DNA, 201 bp, Homo sapiens
aatgagaaggagcggcaggcagccctgcaggtggccgagggcttcatctcgcgcatgcagtacgccccgaacactcaggtggagattctgcctcagggccrtgagagtcccatcttcaagcaatttttcaaggactggaaatgagggtgggcgtcttcctgccccatgctcccctgccccccaccacctgcctgcttgctt

SEQ ID NO: 15555 - DNA, 201 bp, Homo sapiens
ggcttcatctcgcgcatgcagtacgccccgaacactcaggtggagattctgcctcagggccgtgagagtcccatcttcaagcaatttttcaaggactggawatgagggtgggcgtcttcctgccccatgctcccctgccccccaccacctgcctgcttgcttctctggctgcctggtcagtgcagaggtgccccctgcaga

SEQ ID NO: 15556 - DNA, 201 bp, Homo sapiens
acctcacagctgacaaggcaaatgcccaggccgcagctctgtataaggtctctgatgccactggacagatgaacctgaccaaggtggctgactccagcccmtttgcccttgaactgctgatatctgatgactgctttgtgctggacaacgggctctgtggcaagatctatatctggaaggggcgaaaagcgaatgagaagg

SEQ ID NO: 15557 - DNA, 201 bp, Homo sapiens
ttcaagcaatttttcaaggactggaaatgagggtgggcgtcttcctgccccatgctcccctgccccccaccacctgcctgcttgcttctctggctgcctgrtcagtgcagaggtgccccctgcagatgttcaataaaggagacaagtgctttcccagctcttttcctgcaccacctgccctgggctgattctcactgtcac

SEQ ID NO: 15558 - DNA, 201 bp, Homo sapiens
cagcagtcatcccgggatgagcagggggcctgtgccgtgctggctgtgcacctcaacacgctgctgggagagcggcctgtgcagcaccgcgaggtgcaggrcaatgagtctgacctcttcatgagctacttcccacggggcctcaagtaccaggaaggtggtgtggagtcagcatttcacaagacctccacaggagcccca

SEQ ID NO: 15559 - DNA, 201 bp, Homo sapiens; identical to SEQ ID NO: 15551

SEQ ID NO: 15560 - DNA, 201 bp, Homo sapiens
ttagccggttcgggggcgccccgctccctcctcttctcccacagccggggtcctctcttaggggcgcgccgtctcctggcttcctatctgaagacagcatrtacacagccattccccagagtggctctccattcccaggctcagtgcaggatccaggcctgcatgtgtggcgggtggagaagctgaagccggtgcctgtgg

SEQ ID NO: 15561 - DNA, 201 bp, Homo sapiens; identical to SEQ ID NO: 15553

SEQ ID NO: 15562 - DNA, 201 bp, Homo sapiens; identical to SEQ ID NO: 15554

SEQ ID NO: 15563 - DNA, 201 bp, Homo sapiens; identical to SEQ ID NO: 15555

SEQ ID NO: 15564 - DNA, 201 bp, Homo sapiens; identical to SEQ ID NO: 15556

SEQ ID NO: 15565 - DNA, 201 bp, Homo sapiens; identical to SEQ ID NO: 15557

SEQ ID NO: 15566 - DNA, 201 bp, Homo sapiens; identical to SEQ ID NO: 15558

SEQ ID NO: 15567 - DNA, 201 bp, Homo sapiens; identical to SEQ ID NO: 15551

SEQ ID NO: 15568 - DNA, 201 bp, Homo sapiens
acagctgagtgtgaggaacagtgattcccattgatccttgttccctccgtgggtcacagagtccagaacttaagagccacccaagatctgaagacagcatrtacacagccattccccagagtggctctccattcccaggctcagtgcaggatccaggcctgcatgtgtggcgggtggagaagctgaagccggtgcctgtgg

SEQ ID NO: 15569 - DNA, 201 bp, Homo sapiens; identical to SEQ ID NO: 15553

SEQ ID NO: 15570 - DNA, 201 bp, Homo sapiens; identical to SEQ ID NO: 15554

SEQ ID NO: 15571 - DNA, 201 bp, Homo sapiens; identical to SEQ ID NO: 15555

SEQ ID NO: 15572 - DNA, 201 bp, Homo sapiens; identical to SEQ ID NO: 15556

SEQ ID NO: 15573 - DNA, 201 bp, Homo sapiens; identical to SEQ ID NO: 15557

SEQ ID NO: 15574 - DNA, 201 bp, Homo sapiens; identical to SEQ ID NO: 15558

SEQ ID NO: 15575 - DNA, 201 bp, Homo sapiens; identical to SEQ ID NO: 15551

SEQ ID NO: 15576 - DNA, 201 bp, Homo sapiens
aggccctcaactccggctgggctcccggtggcactttctgccgaccctgagatgtacccgccacgcctgcgggactgacctctagatctgaagacagcatrtacacagccattccccagagtggctctccattcccaggctcagtgcaggatccaggcctgcatgtgtggcgggtggagaagctgaagccggtgcctgtgg

SEQ ID NO: 15577 - DNA, 201 bp, Homo sapiens; identical to SEQ ID NO: 15553

SEQ ID NO: 15578 - DNA, 201 bp, Homo sapiens; identical to SEQ ID NO: 15554

SEQ ID NO: 15579 - DNA, 201 bp, Homo sapiens; identical to SEQ ID NO: 15555

SEQ ID NO: 15580 - DNA, 201 bp, Homo sapiens; identical to SEQ ID NO: 15556

SEQ ID NO: 15581 - DNA, 201 bp, Homo sapiens; identical to SEQ ID NO: 15557

SEQ ID NO: 15582 - DNA, 201 bp, Homo sapiens; identical to SEQ ID NO: 15558

SEQ ID NO: 15583 - DNA, 201 bp, Homo sapiens
ctggtgtcttgaaatccgagcaattcctaaaaaggcatttttgcgagcccttgtggactataccagtgacagtgctgaaaagcgcaggctacaggagctgygcagtaaacaaggggcagccgattatagccgctttgtacgagatgcctgtgcctgcttgttggatctcctcctcgctttcccttcttgccagccaccact

SEQ ID NO: 15584 - DNA, 201 bp, Homo sapiens
ttcgtgtgcaagctcaagtttatttcacccaggaaagctccattttgtcttcaacattgtggaatttctgtctactgccacaacagaggttctgcggaagrgagtatgtacaggctggctggccttgttggttgcttcagttcttcagccaaacatacatgcatcccatgaagacagcgggaaagccctggctcctaagat

SEQ ID NO: 15585 - DNA, 201 bp, Homo sapiens
attgcctacagagggatttatttttatgatgctggaaatatgaaatgtattttaaaatttcactctggcatatgatttatctatcaccattactttttttwaagtcacaatttcagaattttgggacatttgcattcaatttacaggtaccagtacgtacatattttaatagaaagatacaacctttttattttcactcct

SEQ ID NO: 15586 - DNA, 201 bp, Homo sapiens
gaatgctcatattaatgtacttaaattacacatgtagagcatatctgttatatgtttatgtaactatcaaatggttatttgttactaaagctatatttctrataaaaaatattttaggataattgcctacagagggatttatttttatgatgctggaaatatgaaatgtattttaaaatttcactctggcatatgatttat

SEQ ID NO: 15587 - DNA, 201 bp, Homo sapiens
caaaggcttcctgaaatagggagactgactgagtagctcattcttgtgacttacagtgccaacatttaaaaaagtatgaaaatgatttatttttatatgaygtatacccataaagaatgctcatattaatgtacttaaattacacatgtagagcatatctgttatatgtttatgtaactatcaaatggttatttgttacta

SEQ ID NO: 15588 - DNA, 201 bp, Homo sapiens
catttcaaatacagacttttcctatcagcctggagatgccttcagcgtgatctgccctaacagtgattctgaggtacaaagcctactccaaagactgcagsttgaagataaaagagagcactgcgtccttttgaaaataaaggcagacacaaggaagaaaggagctaccttaccccagcatatacctgcgggatgttctct

SEQ ID NO: 15589 - DNA, 201 bp, Homo sapiens
aaggagctaccttaccccagcatatacctgcgggatgttctctccagttcatttttacctggtgtcttgaaatccgagcaattcctaaaaaggcatttttrcgagcccttgtggactataccagtgacagtgctgaaaagcgcaggctacaggagctgtgcagtaaacaaggggcagccgattatagccgctttgtacgag

SEQ ID NO: 15590 - DNA, 201 bp, Homo sapiens
aaaggcatttttgcgagcccttgtggactataccagtgacagtgctgaaaagcgcaggctacaggagctgtgcagtaaacaaggggcagccgattatagcygctttgtacgagatgcctgtgcctgcttgttggatctcctcctcgctttcccttcttgccagccaccactcagtctcctgctcgaacatcttcctaaact

SEQ ID NO: 15591 - DNA, 201 bp, Homo sapiens
atctaaaggtttccttctcaagagatgctcctgttggggaggaggaagccccagcaaagtatgtgcaagacaacatccagcttcatggccagcaggtggcragaatcctcctccaggagaacggccatatttatgtgtgtggagatgcaaagaatatggccaaggatgtacatgatgcccttgtgcaaataataagcaaag

SEQ ID NO: 15592 - DNA, 201 bp, Homo sapiens
agctcagacatttccttaagcatgggatcttaactcatctaaaggtttccttctcaagagatgctcctgttggggaggaggaagccccagcaaagtatgtrcaagacaacatccagcttcatggccagcaggtggcgagaatcctcctccaggagaacggccatatttatgtgtgtggagatgcaaagaatatggccaagg

SEQ ID NO: 15593 - DNA, 201 bp, Homo sapiens
ggttcctacaacatagagagaaactccaagaacaacacccagatggaaattttggagcaatgtggttgttttttggctgcaggcataaggatagggattayctattcagaaaagagctcagacatttccttaagcatgggatcttaactcatctaaaggtttccttctcaagagatgctcctgttggggaggaggaagccc

SEQ ID NO: 15594 - DNA, 201 bp, Homo sapiens
tgccctaacagtgattctgaggtacaaagcctactccaaagactgcagcttgaagataaaagagagcactgcgtccttttgaaaataaaggcagacacaargaagaaaggagctaccttaccccagcatatacctgcgggatgttctctccagttcatttttacctggtgtcttgaaatccgagcaattcctaaaaaggca

SEQ ID NO: 15595 - DNA, 201 bp, Homo sapiens
acagtgccaacatttaaaaaagtatgaaaatgatttatttttatatgatgtatacccataaagaatgctcatattaatgtacttaaattacacatgtagakcatatctgttatatgtttatgtaactatcaaatggttatttgttactaaagctatatttctgataaaaaatattttaggataattgcctacagagggatt

SEQ ID NO: 15596 - DNA, 201 bp, Homo sapiens
tctggccagccctcagaaagcattttaggtcaagcagaggacaagaggagataagtggcgcactcccggtggcatcacctgcatcctcgaggacagacctygtgaagtcagagctgctacacattgaatctcaagtcgagcttctgagattcgatgattcaggaagaaaggattctgaggttttgaagcaaaatgcagtga

SEQ ID NO: 15597 - DNA, 201 bp, Homo sapiens
actccaagaacaacacccagatggaaattttggagcaatgtggttgttttttggctgcaggcataaggatagggattatctattcagaaaagagctcagayatttccttaagcatgggatcttaactcatctaaaggtttccttctcaagagatgctcctgttggggaggaggaagccccagcaaagtatgtgcaagacaa

SEQ ID NO: 15598 - DNA, 201 bp, Homo sapiens
tggattgctggactctggccagccctcagaaagcattttaggtcaagcagaggacaagaggagataagtggcgcactcccggtggcatcacctgcatcctygaggacagaccttgtgaagtcagagctgctacacattgaatctcaagtcgagcttctgagattcgatgattcaggaagaaaggattctgaggttttgaag

SEQ ID NO: 15599 - DNA, 201 bp, Homo sapiens
ctttgagtcctcacttacccgttcggtacccccactctcacaagcctctctgaatattcctggtttacccccagaatatttacaggtacatctgcaggagwctcttggccaggaggaaagccaagtatctgtgacttcagcagatccagtttttcaagtgccaatttcaaaggcagttcaacttactacgaatgatgccat

SEQ ID NO: 15600 - DNA, 201 bp, Homo sapiens
tctcggtgattcagaatacacctacttttgcaatggggggaagataattgataaacgacttcaagagcttggagcccggcatttctatgacactggacatrcagatgactgtgtaggtttagaacttgtggttgagccgtggattgctggactctggccagccctcagaaagcattttaggtcaagcagaggacaagagga

SEQ ID NO: 15601 - DNA, 201 bp, Homo sapiens
gcctcctttacttcccagagaacttcacagagactctgtccttccatgcaaaggcttcctgaaatagggagactgactgagtagctcattcttgtgacttrcagtgccaacatttaaaaaagtatgaaaatgatttatttttatatgatgtatacccataaagaatgctcatattaatgtacttaaattacacatgtagag

SEQ ID NO: 15602 - DNA, 201 bp, Homo sapiens
atccatctctcctcgaacaacaaattctttccacttaccagatgacccctcaatccccatcataatggtgggtccaggaaccggcatagccccgtttattrggttcctacaacatagagagaaactccaagaacaacacccagatggaaattttggagcaatgtggttgttttttggctgcaggcataaggatagggatta

SEQ ID NO: 15603 - DNA, 201 bp, Homo sapiens
aagtcagctttactagtgccaaacctttaaattttcaaaagaaaattttctttcaacatttcttgaaggacatggagtggagattggatcatttaacaatrtaacaaaacttcctgatttgattttacgtatcttctatctacgcccttcctgtgcctgtgactctccccaaattgccctgttgccttgagctcttctgag

SEQ ID NO: 15604 - DNA, 201 bp, Homo sapiens
agaagaaaaacgctaccttcaggatatttggtcataaaaccagaaattaaagaaagaggattaagcttttttgactgaaagtactaaaagtcagctttacyagtgccaaacctttaaattttcaaaagaaaattttctttcaacatttcttgaaggacatggagtggagattggatcatttaacaatataacaaaacttcc

SEQ ID NO: 15605 - DNA, 201 bp, Homo sapiens
cgcggcgtggtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataagtatgacctaaaaaccgaaacagctcctcttgttgttg

SEQ ID NO: 15606 - DNA, 201 bp, Homo sapiens
gagacccacccgacacagcccgcaagtttgttaaggaaatacagaaccaaacactgccggttgatttctttgctcacctgcggtatgggttactgggtctyggtgattcagaatacacctacttttgcaatggggggaagataattgataaacgacttcaagagcttggagcccggcatttctatgacactggacatgcag

SEQ ID NO: 15607 - DNA, 201 bp, Homo sapiens
tttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaaca

SEQ ID NO: 15608 - DNA, 201 bp, Homo sapiens
cctggccactttaaaagaagaaaaacgctaccttcaggatatttggtcataaaaccagaaattaaagaaagaggattaagcttttttgactgaaagtactraaagtcagctttactagtgccaaacctttaaattttcaaaagaaaattttctttcaacatttcttgaaggacatggagtggagattggatcatttaacaa

SEQ ID NO: 15609 - DNA, 201 bp, Homo sapiens
gtgcaagctcaagtttatttcacccaggaaagctccattttgtcttcaacattgtggaatttctgtctactgccacaacagaggttctgcggaagggagtrtgtacaggctggctggccttgttggttgcttcagttcttcagccaaacatacatgcatcccatgaagacagcgggaaagccctggctcctaagatatcca

SEQ ID NO: 15610 - DNA, 201 bp, Homo sapiens
ccacaacagaggttctgcggaagggagtatgtacaggctggctggccttgttggttgcttcagttcttcagccaaacatacatgcatcccatgaagacagygggaaagccctggctcctaagatatccatctctcctcgaacaacaaattctttccacttaccagatgacccctcaatccccatcataatggtgggtccag

SEQ ID NO: 15611 - DNA, 201 bp, Homo sapiens
gtgcccggctggcgcggcgtggtttcactgttacatgccttgaagtgatgaggaggtttctgttactatatgctacacagcagggacaggcaaaggccatygcagaagaaatatgtgagcaagctgtggtacatggattttctgcagatcttcactgtattagtgaatccgataagtatgacctaaaaaccgaaacagctc

SEQ ID NO: 15612 - DNA, 201 bp, Homo sapiens
actgccggttgatttctttgctcacctgcggtatgggttactgggtctcggtgattcagaatacacctacttttgcaatggggggaagataattgataaaygacttcaagagcttggagcccggcatttctatgacactggacatgcagatgactgtgtaggtttagaacttgtggttgagccgtggattgctggactctg

SEQ ID NO: 15613 - DNA, 201 bp, Homo sapiens; identical to SEQ ID NO: 15583

SEQ ID NO: 15614 - DNA, 201 bp, Homo sapiens; identical to SEQ ID NO: 15584

SEQ ID NO: 15615 - DNA, 119 bp, Homo sapiens
ggagctttctattggtccygggtaccgagcatgggcgctgcgtcagtgcgcgctggcgcaaggttggtggaagtcgcgttgtgcagtttcactgttacatgccttgaagtgatgaggag

SEQ ID NO: 15616 - DNA, 201 bp, Homo sapiens; identical to SEQ ID NO: 15585

SEQ ID NO: 15617 - DNA, 201 bp, Homo sapiens; identical to SEQ ID NO: 15586

SEQ ID NO: 15618 - DNA, 201 bp, Homo sapiens; identical to SEQ ID NO: 15587

SEQ ID NO: 15619 - DNA, 201 bp, Homo sapiens; identical to SEQ ID NO: 15588

SEQ ID NO: 15620 - DNA, 201 bp, Homo sapiens; identical to SEQ ID NO: 15589

SEQ ID NO: 15621 - DNA, 201 bp, Homo sapiens; identical to SEQ ID NO: 15590

SEQ ID NO: 15622 - DNA, 201 bp, Homo sapiens; identical to SEQ ID NO: 15591

SEQ ID NO: 15623 - DNA, 201 bp, Homo sapiens; identical to SEQ ID NO: 15592

SEQ ID NO: 15624 - DNA, 201 bp, Homo sapiens; identical to SEQ ID NO: 15593

SEQ ID NO: 15625 - DNA, 201 bp, Homo sapiens; identical to SEQ ID NO: 15594

SEQ ID NO: 15626 - DNA, 201 bp, Homo sapiens; identical to SEQ ID NO: 15595

SEQ ID NO: 15627 - DNA, 201 bp, Homo sapiens; identical to SEQ ID NO: 15596

SEQ ID NO: 15628 - DNA, 201 bp, Homo sapiens; identical to SEQ ID NO: 15597

SEQ ID NO: 15629 - DNA, 201 bp, Homo sapiens; identical to SEQ ID NO: 15598

SEQ ID NO: 15630 - DNA, 201 bp, Homo sapiens; identical to SEQ ID NO: 15599

SEQ ID NO: 15631 - DNA, 201 bp, Homo sapiens; identical to SEQ ID NO: 15600

SEQ ID NO: 15632 - DNA, 201 bp, Homo sapiens; identical to SEQ ID NO: 15601

SEQ ID NO: 15633 - DNA, 201 bp, Homo sapiens; identical to SEQ ID NO: 15602

SEQ ID NO: 15634 - DNA, 201 bp, Homo sapiens; identical to SEQ ID NO: 15603

SEQ ID NO: 15635 - DNA, 201 bp, Homo sapiens; identical to SEQ ID NO: 15604

SEQ ID NO: 15636 - DNA, 201 bp, Homo sapiens
cgttgtgcagtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataagtatgacctaaaaaccgaaacagctcctcttgttgttg

SEQ ID NO: 15637 - DNA, 201 bp, Homo sapiens; identical to SEQ ID NO: 15606

SEQ ID NO: 15638 - DNA, 201 bp, Homo sapiens; identical to SEQ ID NO: 15607

SEQ ID NO: 15639 - DNA, 201 bp, Homo sapiens; identical to SEQ ID NO: 15608

SEQ ID NO: 15640 - DNA, 201 bp, Homo sapiens; identical to SEQ ID NO: 15609

SEQ ID NO: 15641 - DNA, 201 bp, Homo sapiens; identical to SEQ ID NO: 15610

SEQ ID NO: 15642 - DNA, 201 bp, Homo sapiens
tggtggaagtcgcgttgtgcagtttcactgttacatgccttgaagtgatgaggaggtttctgttactatatgctacacagcagggacaggcaaaggccatygcagaagaaatatgtgagcaagctgtggtacatggattttctgcagatcttcactgtattagtgaatccgataagtatgacctaaaaaccgaaacagctc

SEQ ID NO: 15643 - DNA, 201 bp, Homo sapiens; identical to SEQ ID NO: 15612

SEQ ID NO: 15644 - DNA, 201 bp, Homo sapiens
ccacctgcagcctgactgcgccgcaagacccggatccggctggaatggcaacctacagctggagtcgagagtctggggcaatggggcaggaaaagtgttaytacattaccatctttgcctctgcgcaccccgagaagctcaccttgtggtctacggtcctgtccacctaccactttgggggcaatgcctcagcagctggga

SEQ ID NO: 15645 - DNA, 201 bp, Homo sapiens
agtggctctgaatatcagcgtcggaaccaacgggaccaccatgtattggccagcccgggctcagagcatgacgtattgcattgaatggcagcctgtgggcyaggacgggggccttgccacctgcagcctgactgcgccgcaagacccggatccggctggaatggcaacctacagctggagtcgagagtctggggcaatggg

SEQ ID NO: 15646 - DNA, 201 bp, Homo sapiens
gggtgagtgactcgcccgaggctacgtagcacacacaggagtcacatttggacccaaataacccagagctcctccaggctccagtgcacctgcctcctctytgccccgtgcctgttgccacccatcctgcgggggaaccctagatgctgccatgaaatggaagctgctgcaccctgctgggcctggcatccgtggggcagg

SEQ ID NO: 15647 - DNA, 201 bp, Homo sapiens
cctgcgggggaaccctagatgctgccatgaaatggaagctgctgcaccctgctgggcctggcatccgtggggcaggagcagaccctgccatttacctgttytggcgtagaatggactgggaatgggggcaaggggggctcagatggatccctggaccctgggctgggcatccacccccaggagcactggatggggagtctg

SEQ ID NO: 15648 - DNA, 201 bp, Homo sapiens
tccttgctcagcttcaatgtgttccggagtggggacggggtggctgaacctcgcaggtggcagagaggctcccctggggctgtggggctctacgtggatcygatggagccgctggtgacctgggtggtccccctcctcttcctcttcctgctgtccaggcagggcgctgcctgcagaaccagtgagtgctgttttcaggac

SEQ ID NO: 15649 - DNA, 153 bp, Homo sapiens
gccttagggatgggctgtgacactttactttttttcttttttcttttttttcwgtcttttctccttgctcagcttcaatgtgttccggagtggggacggggtggctgaacctcgcaggtggcagagaggctcccctggggctgtggggctcta

SEQ ID NO: 15650 - DNA, 201 bp, Homo sapiens
tacctgagggtgcccctgagctggccctggatacagagttgtccttggaggatggagacagatgtgatcgttgaggctcagagagggtgagtgactcgccygaggctacgtagcacacacaggagtcacatttggacccaaataacccagagctcctccaggctccagtgcacctgcctcctctctgccccgtgcctgttg

SEQ ID NO: 15651 - DNA, 201 bp, Homo sapiens
cccatggaagttgggcgactgcggacctcaggatgatgatactgagtcctgcctctgccccctggagatgaatgtggcccaggaattccagctccgacgayggcagctggggagccaaggaagttcctggagcaagtggagcagccccgtgtgcgttccccctgaaaaccccccacagcctcaggtgagattctcggtgga

SEQ ID NO: 15652 - DNA, 201 bp, Homo sapiens
tcaagggctggcgcctggcacggaggtcacttaccgactacagctccacatgctgtcctgcccgtgtaaggccaaggccaccaggaccctgcacctggggwagatgccctatctctcgggtgctgcctacaacgtggctgtcatctcctcgaaccaatttggtcctggcctgaaccagacgtggcacattcctgccgacac

SEQ ID NO: 15653 - DNA, 201 bp, Homo sapiens
ggctgcagttctccgaccaggctggggtgtctgtgctgtacactgtcacactctgggtggaatcctgggccaggaaccagacagagaagtctcctgaggtsaccctgcagctctacaactcagttaaatatgagcctcctctgggagacatcaaggtgtccaagttggccgggcagctgcgtatggagtgggagaccccgg

SEQ ID NO: 15654 - DNA, 201 bp, Homo sapiens
tctgaatatcagcgtcggaaccaacgggaccaccatgtattggccagcccgggctcagagcatgacgtattgcattgaatggcagcctgtgggccaggacsggggccttgccacctgcagcctgactgcgccgcaagacccggatccggctggaatggcaacctacagctggagtcgagagtctggggcaatggggcagga

SEQ ID NO: 15655 - DNA, 201 bp, Homo sapiens
tctcctcgaaccaatttggtcctggcctgaaccagacgtggcacattcctgccgacacccacacagaaccagtggctctgaatatcagcgtcggaaccaaygggaccaccatgtattggccagcccgggctcagagcatgacgtattgcattgaatggcagcctgtgggccaggacgggggccttgccacctgcagcctga

SEQ ID NO: 15656 - DNA, 201 bp, Homo sapiens
acattcctgccgacacccacacagaaccagtggctctgaatatcagcgtcggaaccaacgggaccaccatgtattggccagcccgggctcagagcatgacrtattgcattgaatggcagcctgtgggccaggacgggggccttgccacctgcagcctgactgcgccgcaagacccggatccggctggaatggcaacctaca

SEQ ID NO: 15657 - DNA, 201 bp, Homo sapiens
acagagaagtctcctgaggtgaccctgcagctctacaactcagttaaatatgagcctcctctgggagacatcaaggtgtccaagttggccgggcagctgcrtatggagtgggagaccccggataaccaggttggtgctgaggtgcagttccggcaccggacacccagcagcccatggaagttgggcgactgcggacctcag

SEQ ID NO: 15658 - DNA, 201 bp, Homo sapiens
tggaagttgggcgactgcggacctcaggatgatgatactgagtcctgcctctgccccctggagatgaatgtggcccaggaattccagctccgacgacggcrgctggggagccaaggaagttcctggagcaagtggagcagccccgtgtgcgttccccctgaaaaccccccacagcctcaggtgagattctcggtggagcag

SEQ ID NO: 15659 - DNA, 201 bp, Homo sapiens
tggcacattcctgccgacacccacacagaaccagtggctctgaatatcagcgtcggaaccaacgggaccaccatgtattggccagcccgggctcagagcaygacgtattgcattgaatggcagcctgtgggccaggacgggggccttgccacctgcagcctgactgcgccgcaagacccggatccggctggaatggcaacc

SEQ ID NO: 15660 - DNA, 201 bp, Homo sapiens
aggagcactggatggggagtctggactcaagggctccctgcagcattgcggggtcttgtagcttggaggatccaggcatatagggaagggggctgtaaacwttgtgggaaaaatgacggtcctcccatcccaccccccaccccaccctcacccccctataaaatgggggtggtgataatgaccttacacagctgttcaaaa

SEQ ID NO: 15661 - DNA, 201 bp, Homo sapiens
ttctggcgtagaatggactgggaatgggggcaaggggggctcagatggatccctggaccctgggctgggcatccacccccaggagcactggatggggagtytggactcaagggctccctgcagcattgcggggtcttgtagcttggaggatccaggcatatagggaagggggctgtaaactttgtgggaaaaatgacggtc

SEQ ID NO: 15662 - DNA, 201 bp, Homo sapiens
gagggtgagtgactcgcccgaggctacgtagcacacacaggagtcacatttggacccaaataacccagagctcctccaggctccagtgcacctgcctcctytctgccccgtgcctgttgccacccatcctgcgggggaaccctagatgctgccatgaaatggaagctgctgcaccctgctgggcctggcatccgtggggca

SEQ ID NO: 15663 - DNA, 201 bp, Homo sapiens; identical to SEQ ID NO: 15644

SEQ ID NO: 15664 - DNA, 201 bp, Homo sapiens; identical to SEQ ID NO: 15645

SEQ ID NO: 15665 - DNA, 201 bp, Homo sapiens; identical to SEQ ID NO: 15646

SEQ ID NO: 15666 - DNA, 201 bp, Homo sapiens; identical to SEQ ID NO: 15647

SEQ ID NO: 15667 - DNA, 201 bp, Homo sapiens; identical to SEQ ID NO: 15648

SEQ ID NO: 15668 - DNA, 201 bp, Homo sapiens
ccctgagctggccctggatacagagttgtccttggaggatggagacaggtgcaaggccaagatgtgatcgttgaggctcagagagggtgagtgactcgccygaggctacgtagcacacacaggagtcacatttggacccaaataacccagagctcctccaggctccagtgcacctgcctcctctctgccccgtgcctgttg

SEQ ID NO: 15669 - DNA, 201 bp, Homo sapiens; identical to SEQ ID NO: 15651

SEQ ID NO: 15670 - DNA, 201 bp, Homo sapiens; identical to SEQ ID NO: 15652

SEQ ID NO: 15671 - DNA, 201 bp, Homo sapiens; identical to SEQ ID NO: 15653

SEQ ID NO: 15672 - DNA, 201 bp, Homo sapiens; identical to SEQ ID NO: 15654

SEQ ID NO: 15673 - DNA, 201 bp, Homo sapiens; identical to SEQ ID NO: 15655

SEQ ID NO: 15674 - DNA, 201 bp, Homo sapiens; identical to SEQ ID NO: 15656

SEQ ID NO: 15675 - DNA, 201 bp, Homo sapiens; identical to SEQ ID NO: 15657

SEQ ID NO: 15676 - DNA, 201 bp, Homo sapiens; identical to SEQ ID NO: 15658

SEQ ID NO: 15677 - DNA, 201 bp, Homo sapiens; identical to SEQ ID NO: 15659

SEQ ID NO: 15678 - DNA, 201 bp, Homo sapiens; identical to SEQ ID NO: 15660

SEQ ID NO: 15679 - DNA, 201 bp, Homo sapiens; identical to SEQ ID NO: 15662

SEQ ID NO: 15680 - DNA, 201 bp, Homo sapiens; identical to SEQ ID NO: 15661

SEQ ID NO: 15681 - DNA, 201 bp, Homo sapiens; identical to SEQ ID NO: 15644

SEQ ID NO: 15682 - DNA, 201 bp, Homo sapiens; identical to SEQ ID NO: 15645

SEQ ID NO: 15683 - DNA, 201 bp, Homo sapiens; identical to SEQ ID NO: 15646

SEQ ID NO: 15684 - DNA, 201 bp, Homo sapiens; identical to SEQ ID NO: 15647

SEQ ID NO: 15685 - DNA, 201 bp, Homo sapiens; identical to SEQ ID NO: 15648

SEQ ID NO: 15686 - DNA, 153 bp, Homo sapiens; identical to SEQ ID NO: 15649

SEQ ID NO: 15687 - DNA, 201 bp, Homo sapiens; identical to SEQ ID NO: 15668

SEQ ID NO: 15688 - DNA, 201 bp, Homo sapiens; identical to SEQ ID NO: 15651

SEQ ID NO: 15689 - DNA, 201 bp, Homo sapiens; identical to SEQ ID NO: 15652

SEQ ID NO: 15690 - DNA, 201 bp, Homo sapiens; identical to SEQ ID NO: 15653

SEQ ID NO: 15691 - DNA, 201 bp, Homo sapiens; identical to SEQ ID NO: 15654

SEQ ID NO: 15692 - DNA, 201 bp, Homo sapiens; identical to SEQ ID NO: 15655

SEQ ID NO: 15693 - DNA, 201 bp, Homo sapiens; identical to SEQ ID NO: 15656

SEQ ID NO: 15694 - DNA, 201 bp, Homo sapiens; identical to SEQ ID NO: 15657

SEQ ID NO: 15695 - DNA, 201 bp, Homo sapiens; identical to SEQ ID NO: 15658

SEQ ID NO: 15696 - DNA, 201 bp, Homo sapiens; identical to SEQ ID NO: 15659

SEQ ID NO: 15697 - DNA, 201 bp, Homo sapiens; identical to SEQ ID NO: 15660

SEQ ID NO: 15698 - DNA, 201 bp, Homo sapiens; identical to SEQ ID NO: 15661

SEQ ID NO: 15699 - DNA, 201 bp, Homo sapiens; identical to SEQ ID NO: 15662

SEQ ID NO: 15700 - DNA, 201 bp, Homo sapiens; identical to SEQ ID NO: 15644

SEQ ID NO: 15701 - DNA, 201 bp, Homo sapiens; identical to SEQ ID NO: 15645

SEQ ID NO: 15702 - DNA, 201 bp, Homo sapiens; identical to SEQ ID NO: 15652

SEQ ID NO: 15703 - DNA, 201 bp, Homo sapiens; identical to SEQ ID NO: 15653

SEQ ID NO: 15704 - DNA, 201 bp, Homo sapiens; identical to SEQ ID NO: 15648

SEQ ID NO: 15705 - DNA, 201 bp, Homo sapiens
caggttggggtttctaggagggcagctccagaggttgcagaacactccgctgcctctccagagccaggcacacagcaggcgctccataaatgttcgttggwcttttctccttgctcagcttcaatgtgttccggagtggggacggggtggctgaacctcgcaggtggcagagaggctcccctggggctgtggggctctacg

SEQ ID NO: 15706 - DNA, 201 bp, Homo sapiens; identical to SEQ ID NO: 15655

SEQ ID NO: 15707 - DNA, 201 bp, Homo sapiens; identical to SEQ ID NO: 15654

SEQ ID NO: 15708 - DNA, 201 bp, Homo sapiens; identical to SEQ ID NO: 15656

SEQ ID NO: 15709 - DNA, 201 bp, Homo sapiens; identical to SEQ ID NO: 15651

SEQ ID NO: 15710 - DNA, 201 bp, Homo sapiens; identical to SEQ ID NO: 15657

SEQ ID NO: 15711 - DNA, 201 bp, Homo sapiens; identical to SEQ ID NO: 15658

SEQ ID NO: 15712 - DNA, 201 bp, Homo sapiens; identical to SEQ ID NO: 15659

SEQ ID NO: 15713 - DNA, 201 bp, Homo sapiens; identical to SEQ ID NO: 15644

SEQ ID NO: 15714 - DNA, 201 bp, Homo sapiens; identical to SEQ ID NO: 15645

SEQ ID NO: 15715 - DNA, 201 bp, Homo sapiens; identical to SEQ ID NO: 15646

SEQ ID NO: 15716 - DNA, 201 bp, Homo sapiens; identical to SEQ ID NO: 15647

SEQ ID NO: 15717 - DNA, 201 bp, Homo sapiens; identical to SEQ ID NO: 15648

SEQ ID NO: 15718 - DNA, 201 bp, Homo sapiens; identical to SEQ ID NO: 15705

SEQ ID NO: 15719 - DNA, 201 bp, Homo sapiens; identical to SEQ ID NO: 15668

SEQ ID NO: 15720 - DNA, 201 bp, Homo sapiens; identical to SEQ ID NO: 15651

SEQ ID NO: 15721 - DNA, 201 bp, Homo sapiens; identical to SEQ ID NO: 15652

SEQ ID NO: 15722 - DNA, 201 bp, Homo sapiens; identical to SEQ ID NO: 15653

SEQ ID NO: 15723 - DNA, 201 bp, Homo sapiens; identical to SEQ ID NO: 15654

SEQ ID NO: 15724 - DNA, 201 bp, Homo sapiens; identical to SEQ ID NO: 15655

SEQ ID NO: 15725 - DNA, 201 bp, Homo sapiens; identical to SEQ ID NO: 15656

SEQ ID NO: 15726 - DNA, 201 bp, Homo sapiens; identical to SEQ ID NO: 15660

SEQ ID NO: 15727 - DNA, 201 bp, Homo sapiens; identical to SEQ ID NO: 15657

SEQ ID NO: 15728 - DNA, 201 bp, Homo sapiens; identical to SEQ ID NO: 15658

SEQ ID NO: 15729 - DNA, 201 bp, Homo sapiens; identical to SEQ ID NO: 15659

SEQ ID NO: 15730 - DNA, 201 bp, Homo sapiens; identical to SEQ ID NO: 15662

SEQ ID NO: 15731 - DNA, 201 bp, Homo sapiens; identical to SEQ ID NO: 15661

SEQ ID NO: 15732 - DNA, 201 bp, Homo sapiens
gaggctttggcccaatgcctataaaatgcccatttcgaagatatacaaaaacatacttcaaaaatgttaaacccttaccaacagcttttcccaggagaccrtttgtattaccattacttgtataaatacacttcctgcttaaacttgacccaggtggctagcaaattagaaacaccattcatctctaacatatgatactga

SEQ ID NO: 15733 - DNA, 201 bp, Homo sapiens
ctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttgagtgtactgctga

SEQ ID NO: 15734 - DNA, 201 bp, Homo sapiens
ggtggctagcaaattagaaacaccattcatctctaacatatgatactgatgccatgtaaaggcctttaataagtcattgaaatttactgtgagactgtatsttttaattgcatttaaaaatatatagcttgaaagcagttaaactgattagtattcaggcactgagaatgatagtaataggatacaatgtataagctactc

SEQ ID NO: 15735 - DNA, 201 bp, Homo sapiens
cctcaactaacccttaaaaatgcacacctcatgagtctacctgagcattcaggcagcactgacaatagttatgcctgtactaaggagcatgattttaagakgctttggcccaatgcctataaaatgcccatttcgaagatatacaaaaacatacttcaaaaatgttaaacccttaccaacagcttttcccaggagaccgtt

SEQ ID NO: 15736 - DNA, 201 bp, Homo sapiens
gttactcagcagcagagagccctgggtgacttcaggtggagagcactagaagtggtttcctgataacaagcaaggatatcagagctgggaaattcatgtgsatctggggactgagtgtgggagtgcagagaaagaaagggaaactggctgaggggataccataaaaagaggatgatttcagaaggagaaggaaaaagaaag

SEQ ID NO: 15737 - DNA, 201 bp, Homo sapiens
atctggggacctggtttgaatggagattctgattcagtgggttgggggcagagtttctgcagttccatcaggtcccccccaggtgcaggtgctgacaataytgctgccttacccgccatacattaaggagcagggtcctggtcctaaagagttattcaaatgaaggtggttcgacgccccgaacctcacctgacctcaact

SEQ ID NO: 15738 - DNA, 201 bp, Homo sapiens
tttggccagaaaaagatacccagagaggaaatctaagataattataatggtccatactttttattgtatgaatcaaactcaagcataacattggccaaggraaattaaataccattgctaacttgtgaaatggaagtctgtgatttcggagatgcaaagcattgtagtaaaaacaccaatgtgacctcgaccatctcagcc

SEQ ID NO: 15739 - DNA, 201 bp, Homo sapiens
gtttagaacagagggaccaaattgcttctaggagtcaactggctggccagtctgggtctgggtttggatctccaattgcctcttgcaggctgagtccctcmatgcaaaagtggggctaaatgaagtgtgttaaggggtcggctaagtgggacattagtaactgcacactatttccctctactgagtaaaccctatctgtga

SEQ ID NO: 15740 - DNA, 201 bp, Homo sapiens
tagtttattaacctggggacattcccattgctgtcttaagtaagtctcatagccagctcctgtcacgtgactctcatatggattcattttcgggccagctytgaacaaagcatcatgaacatatgtgcttttggtcgtttgcaatgtgatggtggtggaggtaggtattggtttccttggaaggcatgataagaaagattc

SEQ ID NO: 15741 - DNA, 201 bp, Homo sapiens; identical to SEQ ID NO: 15732

SEQ ID NO: 15742 - DNA, 201 bp, Homo sapiens
ctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctt

SEQ ID NO: 15743 - DNA, 201 bp, Homo sapiens; identical to SEQ ID NO: 15734

SEQ ID NO: 15744 - DNA, 201 bp, Homo sapiens; identical to SEQ ID NO: 15735

SEQ ID NO: 15745 - DNA, 201 bp, Homo sapiens; identical to SEQ ID NO: 15736

SEQ ID NO: 15746 - DNA, 201 bp, Homo sapiens
gttggtagttccctgctctgttttgaacatgctctagtttattaacctggggacattcccattgctgtcttaagtaagtctcatagccagctcctgtcacrtgactctcatatggattcattttcgggccagctctgaacaaagcatcatgaacatatgtgcttttggtcgtttgcaatgtgatggtggtggaggtaggta

SEQ ID NO: 15747 - DNA, 201 bp, Homo sapiens; identical to SEQ ID NO: 15737

SEQ ID NO: 15748 - DNA, 201 bp, Homo sapiens; identical to SEQ ID NO: 15738

SEQ ID NO: 15749 - DNA, 201 bp, Homo sapiens; identical to SEQ ID NO: 15739

SEQ ID NO: 15750 - DNA, 201 bp, Homo sapiens; identical to SEQ ID NO: 15732

SEQ ID NO: 15751 - DNA, 201 bp, Homo sapiens; identical to SEQ ID NO: 15742

SEQ ID NO: 15752 - DNA, 201 bp, Homo sapiens; identical to SEQ ID NO: 15734

SEQ ID NO: 15753 - DNA, 201 bp, Homo sapiens; identical to SEQ ID NO: 15735

SEQ ID NO: 15754 - DNA, 118 bp, Homo sapiens
gttggtagttccctgctctgttttgaacatgctctagtttattaacctggggacattcccattgctgtcttaagtaagtctcatagccagctcctgtcacrtgactctcatatggatt

SEQ ID NO: 15755 - DNA, 201 bp, Homo sapiens; identical to SEQ ID NO: 15737

SEQ ID NO: 15756 - DNA, 201 bp, Homo sapiens; identical to SEQ ID NO: 15738

SEQ ID NO: 15757 - DNA, 201 bp, Homo sapiens; identical to SEQ ID NO: 15739

SEQ ID NO: 15758 - DNA, 201 bp, Homo sapiens; identical to SEQ ID NO: 15732

SEQ ID NO: 15759 - DNA, 201 bp, Homo sapiens; identical to SEQ ID NO: 15737

SEQ ID NO: 15760 - DNA, 201 bp, Homo sapiens; identical to SEQ ID NO: 15739

SEQ ID NO: 15761 - DNA, 201 bp, Homo sapiens; identical to SEQ ID NO: 15738

SEQ ID NO: 15762 - DNA, 201 bp, Homo sapiens; identical to SEQ ID NO: 15733

SEQ ID NO: 15763 - DNA, 201 bp, Homo sapiens; identical to SEQ ID NO: 15734

SEQ ID NO: 15764 - DNA, 201 bp, Homo sapiens; identical to SEQ ID NO: 15735

SEQ ID NO: 15765 - DNA, 201 bp, Homo sapiens; identical to SEQ ID NO: 15740

SEQ ID NO: 15766 - DNA, 201 bp, Homo sapiens; identical to SEQ ID NO: 15732

SEQ ID NO: 15767 - DNA, 201 bp, Homo sapiens; identical to SEQ ID NO: 15742

SEQ ID NO: 15768 - DNA, 201 bp, Homo sapiens; identical to SEQ ID NO: 15734

SEQ ID NO: 15769 - DNA, 201 bp, Homo sapiens; identical to SEQ ID NO: 15735

SEQ ID NO: 15770 - DNA, 201 bp, Homo sapiens; identical to SEQ ID NO: 15736

SEQ ID NO: 15771 - DNA, 201 bp, Homo sapiens; identical to SEQ ID NO: 15746

SEQ ID NO: 15772 - DNA, 201 bp, Homo sapiens; identical to SEQ ID NO: 15737

SEQ ID NO: 15773 - DNA, 201 bp, Homo sapiens; identical to SEQ ID NO: 15738

SEQ ID NO: 15774 - DNA, 201 bp, Homo sapiens; identical to SEQ ID NO: 15739

SEQ ID NO: 15775 - DNA, 201 bp, Homo sapiens; identical to SEQ ID NO: 15740

SEQ ID NO: 15776 - DNA, 201 bp, Homo sapiens; identical to SEQ ID NO: 15732

SEQ ID NO: 15777 - DNA, 201 bp, Homo sapiens; identical to SEQ ID NO: 15742

SEQ ID NO: 15778 - DNA, 201 bp, Homo sapiens; identical to SEQ ID NO: 15734

SEQ ID NO: 15779 - DNA, 201 bp, Homo sapiens; identical to SEQ ID NO: 15735

SEQ ID NO: 15780 - DNA, 201 bp, Homo sapiens; identical to SEQ ID NO: 15736

SEQ ID NO: 15781 - DNA, 201 bp, Homo sapiens; identical to SEQ ID NO: 15746

SEQ ID NO: 15782 - DNA, 201 bp, Homo sapiens; identical to SEQ ID NO: 15737

SEQ ID NO: 15783 - DNA, 201 bp, Homo sapiens; identical to SEQ ID NO: 15738

SEQ ID NO: 15784 - DNA, 201 bp, Homo sapiens; identical to SEQ ID NO: 15739

SEQ ID NO: 15785 - DNA, 201 bp, Homo sapiens
ttgccagccctggtcatgcagtggccatggagaatgtgtagaaatcatcaataattacacctgcaactgtgatgtggggtactatgggccccagtgtcagyttgtgattcagtgtgagcctttggaggccccagagctgggtaccatggactgtactcaccctttgggaaacttcagcttcagctcacagtgtgccttcag

SEQ ID NO: 15786 - DNA, 201 bp, Homo sapiens
ctgcaactgtgatgtggggtactatgggccccagtgtcagtttgtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaa

SEQ ID NO: 15787 - DNA, 201 bp, Homo sapiens
agtatctggagaagactctgcctttcagtcgttcttactactggataggaatccggaagataggaggaatatggacgtgggtgggaaccaacaaatctctyactgaagaagcagagaactggggagatggtgagcccaacaacaagaagaacaaggaggactgcgtggagatctatatcaagagaaacaaagatgcaggca

SEQ ID NO: 15788 - DNA, 201 bp, Homo sapiens
cagcttccatttcgcccctcatttatccctcaacccccagcccacaggtgtttatacagctcagctttttgtcttttctgaggagaaacaaataagaccayaaagggaaaggattcatgtggaatataaagatggctgactttgctctttcttgactcttgttttcagtttcaattcagtgctgtacttgatgacagacac

SEQ ID NO: 15789 - DNA, 201 bp, Homo sapiens
gtgtttccttcagtgcatctgggaagatttctacctgaccaacagttccttcagcttccatttcgcccctcatttatccctcaacccccagcccacaggtstttatacagctcagctttttgtcttttctgaggagaaacaaataagaccataaagggaaaggattcatgtggaatataaagatggctgactttgctcttt

SEQ ID NO: 15790 - DNA, 201 bp, Homo sapiens
gagatcctttaaatccttccatgaaacgttttgtgtggtggcacctcctacgtcaaacatgaagtgtgtttccttcagtgcatctgggaagatttctaccygaccaacagttccttcagcttccatttcgcccctcatttatccctcaacccccagcccacaggtgtttatacagctcagctttttgtcttttctgaggag

SEQ ID NO: 15791 - DNA, 201 bp, Homo sapiens
gttcttactactggataggaatccggaagataggaggaatatggacgtgggtgggaaccaacaaatctcttactgaagaagcagagaactggggagatggygagcccaacaacaagaagaacaaggaggactgcgtggagatctatatcaagagaaacaaagatgcaggcaaatggaacgatgacgcctgccacaaactaa

SEQ ID NO: 15792 - DNA, 201 bp, Homo sapiens; identical to SEQ ID NO: 15788

SEQ ID NO: 15793 - DNA, 201 bp, Homo sapiens; identical to SEQ ID NO: 15789

SEQ ID NO: 15794 - DNA, 201 bp, Homo sapiens
gctgcaagtgacatctctttgatgtcatatggaagagttaaaacaggtggagaaattccttgattcacaatgaaatgctctcctttcccctgcccccagamcttttatccacttacctagattctacatattctttaaatttcatctcaggcctccctcaaccccaccacttcttttataactagtcctttactaatccaa

SEQ ID NO: 15795 - DNA, 201 bp, Homo sapiens; identical to SEQ ID NO: 15790

SEQ ID NO: 15796 - DNA, 201 bp, Homo sapiens; identical to SEQ ID NO: 15785

SEQ ID NO: 15797 - DNA, 201 bp, Homo sapiens; identical to SEQ ID NO: 15786

SEQ ID NO: 15798 - DNA, 201 bp, Homo sapiens; identical to SEQ ID NO: 15787

SEQ ID NO: 15799 - DNA, 201 bp, Homo sapiens; identical to SEQ ID NO: 15791

SEQ ID NO: 15800 - DNA, 201 bp, Homo sapiens; identical to SEQ ID NO: 15785

SEQ ID NO: 15801 - DNA, 201 bp, Homo sapiens; identical to SEQ ID NO: 15786

SEQ ID NO: 15802 - DNA, 201 bp, Homo sapiens; identical to SEQ ID NO: 15787

SEQ ID NO: 15803 - DNA, 201 bp, Homo sapiens; identical to SEQ ID NO: 15794

SEQ ID NO: 15804 - DNA, 201 bp, Homo sapiens; identical to SEQ ID NO: 15791

SEQ ID NO: 15805 - DNA, 201 bp, Homo sapiens; identical to SEQ ID NO: 15785

SEQ ID NO: 15806 - DNA, 201 bp, Homo sapiens; identical to SEQ ID NO: 15786

SEQ ID NO: 15807 - DNA, 201 bp, Homo sapiens; identical to SEQ ID NO: 15787

SEQ ID NO: 15808 - DNA, 201 bp, Homo sapiens; identical to SEQ ID NO: 15794

SEQ ID NO: 15809 - DNA, 201 bp, Homo sapiens; identical to SEQ ID NO: 15791

SEQ ID NO: 15810 - DNA, 201 bp, Homo sapiens; identical to SEQ ID NO: 15788

SEQ ID NO: 15811 - DNA, 201 bp, Homo sapiens; identical to SEQ ID NO: 15789

SEQ ID NO: 15812 - DNA, 201 bp, Homo sapiens; identical to SEQ ID NO: 15794

SEQ ID NO: 15813 - DNA, 201 bp, Homo sapiens; identical to SEQ ID NO: 15790

SEQ ID NO: 15814 - DNA, 201 bp, Homo sapiens; identical to SEQ ID NO: 15785

SEQ ID NO: 15815 - DNA, 201 bp, Homo sapiens; identical to SEQ ID NO: 15786

SEQ ID NO: 15816 - DNA, 201 bp, Homo sapiens; identical to SEQ ID NO: 15787

SEQ ID NO: 15817 - DNA, 201 bp, Homo sapiens; identical to SEQ ID NO: 15791

SEQ ID NO: 15818 - DNA, 201 bp, Homo sapiens; identical to SEQ ID NO: 15791

SEQ ID NO: 15819 - DNA, 201 bp, Homo sapiens; identical to SEQ ID NO: 15794

SEQ ID NO: 15820 - DNA, 201 bp, Homo sapiens; identical to SEQ ID NO: 15789

SEQ ID NO: 15821 - DNA, 201 bp, Homo sapiens; identical to SEQ ID NO: 15790

SEQ ID NO: 15822 - DNA, 201 bp, Homo sapiens; identical to SEQ ID NO: 15785

SEQ ID NO: 15823 - DNA, 201 bp, Homo sapiens; identical to SEQ ID NO: 15786

SEQ ID NO: 15824 - DNA, 201 bp, Homo sapiens; identical to SEQ ID NO: 15788

SEQ ID NO: 15825 - DNA, 201 bp, Homo sapiens; identical to SEQ ID NO: 15787

SEQ ID NO: 15826 - DNA, 201 bp, Homo sapiens
ggtcctgggcgtcctggtgggcagtttcatcattgctggtgtggctgtaggcatcttcctgtgcacaggtggacggcgatgttaattactctccagccccstcagaaggggctggattgatggaggctggcaagggaaagtttcagctcactgtgaagccagactccccaactgaaacaccagaaggtttggagtgacagc

SEQ ID NO: 15827 - DNA, 201 bp, Homo sapiens
ctgtgtgcagtatgtgcagaaacatatttccgcggaaaacacgaaagggagccaaacaagccgctcctacacttcgctggtcctgggcgtcctggtgggcrgtttcatcattgctggtgtggctgtaggcatcttcctgtgcacaggtggacggcgatgttaattactctccagccccgtcagaaggggctggattgatgg

SEQ ID NO: 15828 - DNA, 201 bp, Homo sapiens
cacccaggtcacctccggagtggtcaccttcaccctgcagcagctcaatgcctacaaccgcactcggtatgaactgcgggaattcctggaggacacctgtstgcagtatgtgcagaaacatatttccgcggaaaacacgaaagggagccaaacaagccgctcctacacttcgctggtcctgggcgtcctggtgggcagttt

SEQ ID NO: 15829 - DNA, 201 bp, Homo sapiens
agataatggagttggggcaggaagcctatggcccatcctccaaagacagacagaatcacctgaggcgttcaaaagatataaccaaataaacaagtcatccmcaatcaaaatacaacattcaatacttccaggtgtgtcagacttgggatgggacgctgatataatagggtagaaagaagtaacacgaagaagtggtggaaa

SEQ ID NO: 15830 - DNA, 201 bp, Homo sapiens
tgaagccagactccccaactgaaacaccagaaggtttggagtgacagctcctttcttctcccacatctgcccactgaagatttgagggaggggagatggaraggagaggtggacaaagtacttggtttgctaagaacctaagaacgtgtatgctttgctgaattagtctgataagtgaatgtttatctatctttgtggaaa

SEQ ID NO: 15831 - DNA, 201 bp, Homo sapiens
tcactgtgaagccagactccccaactgaaacaccagaaggtttggagtgacagctcctttcttctcccacatctgcccactgaagatttgagggaggggaratggagaggagaggtggacaaagtacttggtttgctaagaacctaagaacgtgtatgctttgctgaattagtctgataagtgaatgtttatctatctttg

SEQ ID NO: 15832 - DNA, 201 bp, Homo sapiens; identical to SEQ ID NO: 15826

SEQ ID NO: 15833 - DNA, 201 bp, Homo sapiens; identical to SEQ ID NO: 15827

SEQ ID NO: 15834 - DNA, 201 bp, Homo sapiens; identical to SEQ ID NO: 15828

SEQ ID NO: 15835 - DNA, 201 bp, Homo sapiens; identical to SEQ ID NO: 15829

SEQ ID NO: 15836 - DNA, 201 bp, Homo sapiens; identical to SEQ ID NO: 15830

SEQ ID NO: 15837 - DNA, 201 bp, Homo sapiens; identical to SEQ ID NO: 15831

SEQ ID NO: 15838 - DNA, 201 bp, Homo sapiens; identical to SEQ ID NO: 15826

SEQ ID NO: 15839 - DNA, 201 bp, Homo sapiens; identical to SEQ ID NO: 15827

SEQ ID NO: 15840 - DNA, 201 bp, Homo sapiens; identical to SEQ ID NO: 15828

SEQ ID NO: 15841 - DNA, 201 bp, Homo sapiens; identical to SEQ ID NO: 15829

SEQ ID NO: 15842 - DNA, 201 bp, Homo sapiens; identical to SEQ ID NO: 15830

SEQ ID NO: 15843 - DNA, 201 bp, Homo sapiens; identical to SEQ ID NO: 15831

SEQ ID NO: 15844 - DNA, 201 bp, Homo sapiens
accagagcgttcacggtgagcatgaaaggcagccgcgtggagcgcgcggaagaggcacttgcccacatgggcagctccgtgttcagtggaatcacacttasaaaatttggagggattgtggtgttggcttttgccaaatctcaaattttccagatattctacttcaggatgtatttggccatggtcttactgggagccact

SEQ ID NO: 15845 - DNA, 201 bp, Homo sapiens
tttctggtgaccatggtcctcctgggctgtgagctctggtctgcagtcatcatgtgtgccaccatcgccatggtcttggtcaacatgtttggagttatgtrgctctggggcatcagtctgaacgctgtatccttggtcaacctggtgatgagctgtggcatctccgtggagttctgcagccacataaccagagcgttcacg

SEQ ID NO: 15846 - DNA, 201 bp, Homo sapiens
atatttctggtgaccatggtcctcctgggctgtgagctctggtctgcagtcatcatgtgtgccaccatcgccatggtcttggtcaacatgtttggagttaygtggctctggggcatcagtctgaacgctgtatccttggtcaacctggtgatgagctgtggcatctccgtggagttctgcagccacataaccagagcgttc

SEQ ID NO: 15847 - DNA, 201 bp, Homo sapiens
ttctgcagttaacatcctccttggccatggcaccagggtcggagccacgtacttcatgacctaccacaccgtgctgcagacctctgctgactttattgacrctctgaagaaagcccgacttatagccagtaatgtcaccgaaaccatgggcattaacggcagtgcctaccgagtatttccttacagtgtgttttatgtctt

SEQ ID NO: 15848 - DNA, 201 bp, Homo sapiens
tgggctgtgagctctggtctgcagtcatcatgtgtgccaccatcgccatggtcttggtcaacatgtttggagttatgtggctctggggcatcagtctgaaygctgtatccttggtcaacctggtgatgagctgtggcatctccgtggagttctgcagccacataaccagagcgttcacggtgagcatgaaaggcagccgcg

SEQ ID NO: 15849 - DNA, 201 bp, Homo sapiens
cagtgtgttttatgtcttctacgaacagtacctgaccatcattgacgacactatcttcaacctcggtgtgtccctgggcgcgatatttctggtgaccatgktcctcctgggctgtgagctctggtctgcagtcatcatgtgtgccaccatcgccatggtcttggtcaacatgtttggagttatgtggctctggggcatcag

SEQ ID NO: 15850 - DNA, 201 bp, Homo sapiens
ttgaagatgaactaaatcgtgaaagtgacagtgatgtcttcaccgttgtaattagctatgccatcatgtttctatatatttccctagccttggggcacatsaaaagctgtcgcaggcttctggtggattcgaaggtctcactaggcatcgcgggcatcttgatcgtgctgagctcggtggcttgctccttgggtgtcttca

SEQ ID NO: 15851 - DNA, 201 bp, Homo sapiens
agtagatattggattggatcagtctctttcgatgccagatgactcctacatggtggattatttcaaatccatcagtcagtacctgcatgcgggtccgcctrtgtactttgtcctggaggaagggcacgactacacttcttccaaggggcagaacatggtgtgcggcggcatgggctgcaacaatgattccctggtgcagca

SEQ ID NO: 15852 - DNA, 201 bp, Homo sapiens
actgcaccaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgta

SEQ ID NO: 15853 - DNA, 201 bp, Homo sapiens
ttcctttcggataaccctaaccccaagtgtggcaaagggggacatgctgcctatagttctgcagttaacatcctccttggccatggcaccagggtcggagycacgtacttcatgacctaccacaccgtgctgcagacctctgctgactttattgacgctctgaagaaagcccgacttatagccagtaatgtcaccgaaacc

SEQ ID NO: 15854 - DNA, 201 bp, Homo sapiens
taccatcactcctgtgttttcagattttccagtccatgggatggagcccatgaacaatgccaccaaaggctgtgacgagtctgtggatgaggtcacagcaycatgtagctgccaagactgctctattgtctgtggccccaagccccagcccccacctcctcctgctccctggacgatccttggcttggacgccatgtatgt

SEQ ID NO: 15855 - DNA, 201 bp, Homo sapiens
ctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgttttcacagtcctgtgttt

SEQ ID NO: 15856 - DNA, 201 bp, Homo sapiens
  misc_feature (1)...(201): n = A,T,C or G, or insertion/deletion polymorphism (see Tables 1-2)
agtggacaatatcactgaccagttctgcaatgcttcagtggttgaccctgcctgcgttcgctgcaggcctctgactccggaaggcaaacagaggcctcagnggggagacttcatgagattcctgcccatgttcctttcggataaccctaaccccaagtgtggcaaagggggacatgctgcctatagttctgcagttaacat

SEQ ID NO: 15857 - DNA, 201 bp, Homo sapiens
gttacaatactacgtcggacagagttttgccaatgcaatgtacaatgcctgccgggatgtggaggccccctcaagtaatgacaaggccctgggactcctgkgtgggaaggacgctgacgcctgtaatgccaccaactggattgaatacatgttcaataaggacaatggacaggcaccttttaccatcactcctgtgttttc

SEQ ID NO: 15858 - DNA, 201 bp, Homo sapiens
acagtcgtcttgctgtcgagtggacaatatcactgaccagttctgcaatgcttcagtggttgaccctgcctgcgttcgctgcaggcctctgactccggaargcaaacagaggcctcaggggggagacttcatgagattcctgcccatgttcctttcggataaccctaaccccaagtgtggcaaagggggacatgctgccta

SEQ ID NO: 15859 - DNA, 201 bp, Homo sapiens
tgattccctggtgcagcagatatttaacgcggcgcagctggacaactatacccgaataggcttcgccccctcgtcctggatcgacgattatttcgactggrtgaagccacagtcgtcttgctgtcgagtggacaatatcactgaccagttctgcaatgcttcagtggttgaccctgcctgcgttcgctgcaggcctctgac

SEQ ID NO: 15860 - DNA, 201 bp, Homo sapiens
ctttcggataaccctaaccccaagtgtggcaaagggggacatgctgcctatagttctgcagttaacatcctccttggccatggcaccagggtcggagccaygtacttcatgacctaccacaccgtgctgcagacctctgctgactttattgacgctctgaagaaagcccgacttatagccagtaatgtcaccgaaaccatg

SEQ ID NO: 15861 - DNA, 201 bp, Homo sapiens
aaaaatcggctagacatcttttgctgtgtcagaggtgctgaagatggaacaagcgtccaggcctcagagagctgtttgtttcgcttcttcaaaaactcctrttctccacttctgctaaaggactggatgagaccaattgtgatagcaatatttgtgggtgttctgtcattcagcatcgcagtcctgaacaaagtagatatt

SEQ ID NO: 15862 - DNA, 201 bp, Homo sapiens
gagactgtagcatttttcttaggagcattgtccgtgatgccagccgtgcacaccttctctctctttgcgggattggcagtcttcattgactttcttctgcmgattacctgtttcgtgagtctcttggggttagacattaaacgtcaagagaaaaatcggctagacatcttttgctgtgtcagaggtgctgaagatggaaca

SEQ ID NO: 15863 - DNA, 201 bp, Homo sapiens
gatgtccatcctgtttttataacctactgaacctgttttgtgagctgacatgtagccctcgacagagtcagtttttgaatgttacagctactgaagattaygttgatcctgttacaaaccagacgaaaacaaatgtgaaagagttacaatactacgtcggacagagttttgccaatgcaatgtacaatgcctgccgggatg

SEQ ID NO: 15864 - DNA, 201 bp, Homo sapiens
ccgttcctggtgctggctgttggagtggacaacatcttcattctggtgcaggcctaccagagagatgaacgtcttcaaggggaaaccctggatcagcagcygggcagggtcctaggagaagtggctcccagtatgttcctgtcatccttttctgagactgtagcatttttcttaggagcattgtccgtgatgccagccgtg

SEQ ID NO: 15865 - DNA, 201 bp, Homo sapiens
tagccttggggcacatcaaaagctgtcgcaggcttctggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatcttca

SEQ ID NO: 15866 - DNA, 201 bp, Homo sapiens
aatctgaccatttccttcactgctgaacgaagtattgaagatgaactaaatcgtgaaagtgacagtgatgtcttcaccgttgtaattagctatgccatcakgtttctatatatttccctagccttggggcacatcaaaagctgtcgcaggcttctggtggattcgaaggtctcactaggcatcgcgggcatcttgatcgtg

SEQ ID NO: 15867 - DNA, 201 bp, Homo sapiens
tacagagaagctccagagggcccaggcctgggaaaaagagtttattaattttgtgaaaaactacaagaatcccaatctgaccatttccttcactgctgaaygaagtattgaagatgaactaaatcgtgaaagtgacagtgatgtcttcaccgttgtaattagctatgccatcatgtttctatatatttccctagccttggg

SEQ ID NO: 15868 - DNA, 201 bp, Homo sapiens
acacttacaaaatttggagggattgtggtgttggcttttgccaaatctcaaattttccagatattctacttcaggatgtatttggccatggtcttactggragccactcacggattaatatttctccctgtcttactcagttacatagggccatcagtaaataaagccaaaagttgtgccactgaagagcgatacaaagga

SEQ ID NO: 15869 - DNA, 201 bp, Homo sapiens
gcttcagacactaaaagacaacctgcagctgcctctacagtttctgtccagatgtccatcctgtttttataacctactgaacctgttttgtgagctgacaygtagccctcgacagagtcagtttttgaatgttacagctactgaagattatgttgatcctgttacaaaccagacgaaaacaaatgtgaaagagttacaata

SEQ ID NO: 15870 - DNA, 201 bp, Homo sapiens
cagctggacaactatacccgaataggcttcgccccctcgtcctggatcgacgattatttcgactgggtgaagccacagtcgtcttgctgtcgagtggacartatcactgaccagttctgcaatgcttcagtggttgaccctgcctgcgttcgctgcaggcctctgactccggaaggcaaacagaggcctcaggggggagac

SEQ ID NO: 15871 - DNA, 201 bp, Homo sapiens
caacaatgattccctggtgcagcagatatttaacgcggcgcagctggacaactatacccgaataggcttcgccccctcgtcctggatcgacgattatttcractgggtgaagccacagtcgtcttgctgtcgagtggacaatatcactgaccagttctgcaatgcttcagtggttgaccctgcctgcgttcgctgcaggcc

SEQ ID NO: 15872 - DNA, 201 bp, Homo sapiens
gtgagtctcttggggttagacattaaacgtcaagagaaaaatcggctagacatcttttgctgtgtcagaggtgctgaagatggaacaagcgtccaggcctsagagagctgtttgtttcgcttcttcaaaaactcctattctccacttctgctaaaggactggatgagaccaattgtgatagcaatatttgtgggtgttctg

SEQ ID NO: 15873 - DNA, 201 bp, Homo sapiens
aatgatacagagaagctccagagggcccaggcctgggaaaaagagtttattaattttgtgaaaaactacaagaatcccaatctgaccatttccttcactgytgaacgaagtattgaagatgaactaaatcgtgaaagtgacagtgatgtcttcaccgttgtaattagctatgccatcatgtttctatatatttccctagcc

SEQ ID NO: 15874 - DNA, 201 bp, Homo sapiens
gtccgggtcacaaccaatccagttgacctctggtcagcccccagcagccaggctcgcctggaaaaagagtactttgaccagcactttgggcctttcttccrgacggagcagctcatcatccgggcccctctcactgacaaacacatttaccagccatacccttcgggagctgatgtaccctttggacctccgcttgacata

SEQ ID NO: 15875 - DNA, 201 bp, Homo sapiens
ttctgcgtccgaaaccctggctgtgtcattttcttctcgctggtcttcattactgcgtgttcgtcaggcctggtgtttgtccgggtcacaaccaatccagytgacctctggtcagcccccagcagccaggctcgcctggaaaaagagtactttgaccagcactttgggcctttcttccggacggagcagctcatcatccgg

SEQ ID NO: 15876 - DNA, 201 bp, Homo sapiens
actgaccagttctgcaatgcttcagtggttgaccctgcctgcgttcgctgcaggcctctgactccggaaggcaaacagaggcctcaggggggagacttcakgagattcctgcccatgttcctttcggataaccctaaccccaagtgtggcaaagggggacatgctgcctatagttctgcagttaacatcctccttggccat

SEQ ID NO: 15877 - DNA, 201 bp, Homo sapiens
ctattctccacttctgctaaaggactggatgagaccaattgtgatagcaatatttgtgggtgttctgtcattcagcatcgcagtcctgaacaaagtagatrttggattggatcagtctctttcgatgccagatgactcctacatggtggattatttcaaatccatcagtcagtacctgcatgcgggtccgcctgtgtactt

SEQ ID NO: 15878 - DNA, 201 bp, Homo sapiens
actacacttcttccaaggggcagaacatggtgtgcggcggcatgggctgcaacaatgattccctggtgcagcagatatttaacgcggcgcagctggacaaytatacccgaataggcttcgccccctcgtcctggatcgacgattatttcgactgggtgaagccacagtcgtcttgctgtcgagtggacaatatcactgacc

SEQ ID NO: 15879 - DNA, 201 bp, Homo sapiens
gcctttcttccggacggagcagctcatcatccgggcccctctcactgacaaacacatttaccagccatacccttcgggagctgatgtaccctttggacctycgcttgacatacagatactgcaccaggttcttgacttacaaatagccatcgaaaacattactgcctcttatgacaatgagactgtgacacttcaagacat

SEQ ID NO: 15880 - DNA, 201 bp, Homo sapiens
aaggcagccgcgtggagcgcgcggaagaggcacttgcccacatgggcagctccgtgttcagtggaatcacacttacaaaatttggagggattgtggtgttsgcttttgccaaatctcaaattttccagatattctacttcaggatgtatttggccatggtcttactgggagccactcacggattaatatttctccctgtct

SEQ ID NO: 15881 - DNA, 201 bp, Homo sapiens
gtgcaggaactctgtccaggattcttctttggcaatgtcagtctctgttgtgatgttcggcagcttcagacactaaaagacaacctgcagctgcctctacrgtttctgtccagatgtccatcctgtttttataacctactgaacctgttttgtgagctgacatgtagccctcgacagagtcagtttttgaatgttacagct

SEQ ID NO: 15882 - DNA, 201 bp, Homo sapiens
tgtgggaaggacgctgacgcctgtaatgccaccaactggattgaatacatgttcaataaggacaatggacaggcaccttttaccatcactcctgtgttttmagattttccagtccatgggatggagcccatgaacaatgccaccaaaggctgtgacgagtctgtggatgaggtcacagcaccatgtagctgccaagactgc

SEQ ID NO: 15883 - DNA, 201 bp, Homo sapiens
tgcaccattttgagtgtgttaaattacttccagaacagccattccgtgctggaccacaagaaaggggacgacttctttgtgtatgccgattaccacacgcrctttctgtactgcgtacgggctcctgcctctctgaatgatacaagtttgctccatgacccttgtctgggtacgtttggtggaccagtgttcccgtggctt

SEQ ID NO: 15884 - DNA, 201 bp, Homo sapiens
gttaaattacttccagaacagccattccgtgctggaccacaagaaaggggacgacttctttgtgtatgccgattaccacacgcactttctgtactgcgtaygggctcctgcctctctgaatgatacaagtttgctccatgacccttgtctgggtacgtttggtggaccagtgttcccgtggcttgtgttgggaggctatga

SEQ ID NO: 15885 - DNA, 201 bp, Homo sapiens
tgctccttgggtgtcttcagctacattgggttgcccttgaccctcattgtgattgaagtcatcccgttcctggtgctggctgttggagtggacaacatctycattctggtgcaggcctaccagagagatgaacgtcttcaaggggaaaccctggatcagcagctgggcagggtcctaggagaagtggctcccagtatgttc

SEQ ID NO: 15886 - DNA, 201 bp, Homo sapiens
atatttgtgggtgttctgtcattcagcatcgcagtcctgaacaaagtagatattggattggatcagtctctttcgatgccagatgactcctacatggtggwttatttcaaatccatcagtcagtacctgcatgcgggtccgcctgtgtactttgtcctggaggaagggcacgactacacttcttccaaggggcagaacatg

SEQ ID NO: 15887 - DNA, 201 bp, Homo sapiens
gaagggcacgactacacttcttccaaggggcagaacatggtgtgcggcggcatgggctgcaacaatgattccctggtgcagcagatatttaacgcggcgcmgctggacaactatacccgaataggcttcgccccctcgtcctggatcgacgattatttcgactgggtgaagccacagtcgtcttgctgtcgagtggacaat

SEQ ID NO: 15888 - DNA, 201 bp, Homo sapiens
actaaaagacaacctgcagctgcctctacagtttctgtccagatgtccatcctgtttttataacctactgaacctgttttgtgagctgacatgtagccctygacagagtcagtttttgaatgttacagctactgaagattatgttgatcctgttacaaaccagacgaaaacaaatgtgaaagagttacaatactacgtcgg

SEQ ID NO: 15889 - DNA, 201 bp, Homo sapiens
gacgcctgtaatgccaccaactggattgaatacatgttcaataaggacaatggacaggcaccttttaccatcactcctgtgttttcagattttccagtccrtgggatggagcccatgaacaatgccaccaaaggctgtgacgagtctgtggatgaggtcacagcaccatgtagctgccaagactgctctattgtctgtggc

SEQ ID NO: 15890 - DNA, 201 bp, Homo sapiens
cagcagatatttaacgcggcgcagctggacaactatacccgaataggcttcgccccctcgtcctggatcgacgattatttcgactgggtgaagccacagtygtcttgctgtcgagtggacaatatcactgaccagttctgcaatgcttcagtggttgaccctgcctgcgttcgctgcaggcctctgactccggaaggcaaa

SEQ ID NO: 15891 - DNA, 201 bp, Homo sapiens
gaaaggcagccgcgtggagcgcgcggaagaggcacttgcccacatgggcagctccgtgttcagtggaatcacacttacaaaatttggagggattgtggtgktggcttttgccaaatctcaaattttccagatattctacttcaggatgtatttggccatggtcttactgggagccactcacggattaatatttctccctgt

SEQ ID NO: 15892 - DNA, 201 bp, Homo sapiens
gttctgcagccacataaccagagcgttcacggtgagcatgaaaggcagccgcgtggagcgcgcggaagaggcacttgcccacatgggcagctccgtgttcrgtggaatcacacttacaaaatttggagggattgtggtgttggcttttgccaaatctcaaattttccagatattctacttcaggatgtatttggccatggt

SEQ ID NO: 15893 - DNA, 201 bp, Homo sapiens
aatggacaggcaccttttaccatcactcctgtgttttcagattttccagtccatgggatggagcccatgaacaatgccaccaaaggctgtgacgagtctgkggatgaggtcacagcaccatgtagctgccaagactgctctattgtctgtggccccaagccccagcccccacctcctcctgctccctggacgatccttggc

SEQ ID NO: 15894 - DNA, 201 bp, Homo sapiens
aatttggagggattgtggtgttggcttttgccaaatctcaaattttccagatattctacttcaggatgtatttggccatggtcttactgggagccactcayggattaatatttctccctgtcttactcagttacatagggccatcagtaaataaagccaaaagttgtgccactgaagagcgatacaaaggaacagagcgcg

SEQ ID NO: 15895 - DNA, 201 bp, Homo sapiens
gggcatcagtctgaacgctgtatccttggtcaacctggtgatgagctgtggcatctccgtggagttctgcagccacataaccagagcgttcacggtgagcrtgaaaggcagccgcgtggagcgcgcggaagaggcacttgcccacatgggcagctccgtgttcagtggaatcacacttacaaaatttggagggattgtggt

SEQ ID NO: 15896 - DNA, 201 bp, Homo sapiens
gtcttcaaggggaaaccctggatcagcagctgggcagggtcctaggagaagtggctcccagtatgttcctgtcatccttttctgagactgtagcatttttyttaggagcattgtccgtgatgccagccgtgcacaccttctctctctttgcgggattggcagtcttcattgactttcttctgcagattacctgtttcgtga

SEQ ID NO: 15897 - DNA, 201 bp, Homo sapiens
atccatcagtcagtacctgcatgcgggtccgcctgtgtactttgtcctggaggaagggcacgactacacttcttccaaggggcagaacatggtgtgcggcrgcatgggctgcaacaatgattccctggtgcagcagatatttaacgcggcgcagctggacaactatacccgaataggcttcgccccctcgtcctggatcga

SEQ ID NO: 15898 - DNA, 201 bp, Homo sapiens
acaaagtagatattggattggatcagtctctttcgatgccagatgactcctacatggtggattatttcaaatccatcagtcagtacctgcatgcgggtccrcctgtgtactttgtcctggaggaagggcacgactacacttcttccaaggggcagaacatggtgtgcggcggcatgggctgcaacaatgattccctggtgc

SEQ ID NO: 15899 - DNA, 201 bp, Homo sapiens
tggtgttggcttttgccaaatctcaaattttccagatattctacttcaggatgtatttggccatggtcttactgggagccactcacggattaatatttctycctgtcttactcagttacatagggccatcagtaaataaagccaaaagttgtgccactgaagagcgatacaaaggaacagagcgcgaacggcttctaaatt

SEQ ID NO: 15900 - DNA, 201 bp, Homo sapiens
agctgccaagactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacagaaaacggtattttgtctccgagtacactcccatc

SEQ ID NO: 15901 - DNA, 201 bp, Homo sapiens
gtcttactgggagccactcacggattaatatttctccctgtcttactcagttacatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggac

SEQ ID NO: 15902 - DNA, 201 bp, Homo sapiens
gttttcagattttccagtccatgggatggagcccatgaacaatgccaccaaaggctgtgacgagtctgtggatgaggtcacagcaccatgtagctgccaasactgctctattgtctgtggccccaagccccagcccccacctcctcctgctccctggacgatccttggcttggacgccatgtatgtcatcatgtggatcac

SEQ ID NO: 15903 - DNA, 201 bp, Homo sapiens
ttacaatactacgtcggacagagttttgccaatgcaatgtacaatgcctgccgggatgtggaggccccctcaagtaatgacaaggccctgggactcctgtrtgggaaggacgctgacgcctgtaatgccaccaactggattgaatacatgttcaataaggacaatggacaggcaccttttaccatcactcctgtgttttca

SEQ ID NO: 15904 - DNA, 201 bp, Homo sapiens
ggccatggcaccagggtcggagccacgtacttcatgacctaccacaccgtgctgcagacctctgctgactttattgacgctctgaagaaagcccgacttayagccagtaatgtcaccgaaaccatgggcattaacggcagtgcctaccgagtatttccttacagtgtgttttatgtcttctacgaacagtacctgaccatc

SEQ ID NO: 15905 - DNA, 201 bp, Homo sapiens
gtgaccctgtcagcgcagcatttgagggctgcttgaggcggctgttcacacgctgggggtctttctgcgtccgaaaccctggctgtgtcattttcttctcrctggtcttcattactgcgtgttcgtcaggcctggtgtttgtccgggtcacaaccaatccagttgacctctggtcagcccccagcagccaggctcgcctgg

SEQ ID NO: 15906 - DNA, 201 bp, Homo sapiens
cagtgtggtgctacagaaaacggtattttgtctccgagtacactcccatcgatagcaatatagctttttctgttaatgcaagtgacaaaggagaggcgtcytgctgtgaccctgtcagcgcagcatttgagggctgcttgaggcggctgttcacacgctgggggtctttctgcgtccgaaaccctggctgtgtcattttct

SEQ ID NO: 15907 - DNA, 201 bp, Homo sapiens
atatttaacgcggcgcagctggacaactatacccgaataggcttcgccccctcgtcctggatcgacgattatttcgactgggtgaagccacagtcgtcttrctgtcgagtggacaatatcactgaccagttctgcaatgcttcagtggttgaccctgcctgcgttcgctgcaggcctctgactccggaaggcaaacagagg

SEQ ID NO: 15908 - DNA, 201 bp, Homo sapiens
tcttccaaggggcagaacatggtgtgcggcggcatgggctgcaacaatgattccctggtgcagcagatatttaacgcggcgcagctggacaactatacccraataggcttcgccccctcgtcctggatcgacgattatttcgactgggtgaagccacagtcgtcttgctgtcgagtggacaatatcactgaccagttctgc

SEQ ID NO: 15909 - DNA, 201 bp, Homo sapiens
cgattatttcgactgggtgaagccacagtcgtcttgctgtcgagtggacaatatcactgaccagttctgcaatgcttcagtggttgaccctgcctgcgttygctgcaggcctctgactccggaaggcaaacagaggcctcaggggggagacttcatgagattcctgcccatgttcctttcggataaccctaaccccaagtg

SEQ ID NO: 15910 - DNA, 201 bp, Homo sapiens
ctgaagaaagcccgacttatagccagtaatgtcaccgaaaccatgggcattaacggcagtgcctaccgagtatttccttacagtgtgttttatgtcttctrcgaacagtacctgaccatcattgacgacactatcttcaacctcggtgtgtccctgggcgcgatatttctggtgaccatggtcctcctgggctgtgagctc

SEQ ID NO: 15911 - DNA, 201 bp, Homo sapiens
tctgcagtcatcatgtgtgccaccatcgccatggtcttggtcaacatgtttggagttatgtggctctggggcatcagtctgaacgctgtatccttggtcarcctggtgatgagctgtggcatctccgtggagttctgcagccacataaccagagcgttcacggtgagcatgaaaggcagccgcgtggagcgcgcggaagag

SEQ ID NO: 15912 - DNA, 201 bp, Homo sapiens
ttccaagctggctactcgacatctagagcccgcgaagctggcgcctcgcgcgcggagaaccagacagcgccgggagaagttcctgcgctcagtaacctgcrgccgcccagccgcgtggacggcatggtgggcgacgacccttacaacccctacaagtactctgacgacaacccttattacaactactacgatacttatgaa

SEQ ID NO: 15913 - DNA, 201 bp, Homo sapiens
ttactagtaatcattctgcactcactgggtgcatagcatggttagaggggctagagatggacagtcatcaactggcggatatagcggtacatatgatcctkagccaccagggcacaagcttaccagtagacaatacagacagagcttttgttgagctgtaactgagctatggaatagcttctttgatgtacctctttgcct

SEQ ID NO: 15914 - DNA, 201 bp, Homo sapiens
cggaggaaaactgtctggccagtacagcatacagggcagatgtcagagattatgatcacagggtgctgctcagatttccccaaagagtgaaaaaccaaggracatcagatttcttacccagccgaccaagatattcctgggaatggcacagttgtcatcaacattaccacagtatggatgagtttagccactatgacctgc

SEQ ID NO: 15915 - DNA, 201 bp, Homo sapiens
attactagtaatcattctgcactcactgggtgcatagcatggttagaggggctagagatggacagtcatcaactggcggatatagcggtacatatgatccwtagccaccagggcacaagcttaccagtagacaatacagacagagcttttgttgagctgtaactgagctatggaatagcttctttgatgtacctctttgcc

SEQ ID NO: 15916 - DNA, 201 bp, Homo sapiens
tgagtcctggctgttatgatacctatggtgcagacatagactgccagtggattgatattacagatgtaaaacctggaaactatatcctaaaggtcagtgtraaccccagctacctggttcctgaatctgactataccaacaatgttgtgcgctgtgacattcgctacacaggacatcatgcgtatgcctcaggctgcacaa

SEQ ID NO: 15917 - DNA, 201 bp, Homo sapiens
gcggaggaaaactgtctggccagtacagcatacagggcagatgtcagagattatgatcacagggtgctgctcagatttccccaaagagtgaaaaaccaagrgacatcagatttcttacccagccgaccaagatattcctgggaatggcacagttgtcatcaacattaccacagtatggatgagtttagccactatgacctg

SEQ ID NO: 15918 - DNA, 201 bp, Homo sapiens
ggcgccagcagatccaatgggagaacaacgggcaggtgttcagcttgctgagcctgggctcacagtaccagcctcagcgccgccgggacccgggcgccgcsgtccctggtgcagccaacgcctccgcccagcagccccgcactccgatcctgctgatccgcgacaaccgcaccgccgcggcgcgaacgcggacggccggct

SEQ ID NO: 15919 - DNA, 201 bp, Homo sapiens
tctttgatgtacctctttgccttaaattgctttttagttctaagattgtagaatgatcctttcaaattgtaatcttttctaacagagatattttaatatasttgctttcttaaaaaacaaaaaaactactgtcagtattaatactgagccagactggcatctacagatttcagatctatcattttattgattcttaagctt

SEQ ID NO: 15920 - DNA, 201 bp, Homo sapiens
gccagaacggcttgtgtaactttgcaaacgtgccagaaagtttaaaatctctcctccttccttcactccagacactgcccgctctccgggactgccgcgcsgctccccgttgccttccaggactgagaaaggggaaagggaagggtgccacgtccgagcagccgccttgactggggaagggtctgaatcccacccttggca

SEQ ID NO: 15921 - DNA, 201 bp, Homo sapiens
aacgcggacggccggctcatctggagtcaccgctggccgccccaggcccaccgcccgtcactggttccaagctggctactcgacatctagagcccgcgaasctggcgcctcgcgcgcggagaaccagacagcgccgggagaagttcctgcgctcagtaacctgcggccgcccagccgcgtggacggcatggtgggcgacga

SEQ ID NO: 15922 - DNA, 201 bp, Homo sapiens
cagatttcttacccagccgaccaagatattcctgggaatggcacagttgtcatcaacattaccacagtatggatgagtttagccactatgacctgcttgakgccaacacccagaggagagtggctgaaggccacaaagcaagtttctgtcttgaagacacatcctgtgactatggctaccacaggcgatttgcatgtactg

SEQ ID NO: 15923 - DNA, 201 bp, Homo sapiens
ctgactcaggcgcctggcacatttcagggagaaactccaaagtccacacaaagattttctaaggaatgcacaaattgaaaacacactcaaaagacaaacakgcaagtaaagaaaaaaaaaagaaagacttttgtttaaatttgtaaaatgcaaaactgaatgaaactgttactaccataaatcaggatatgtttcatgaat

SEQ ID NO: 15924 - DNA, 201 bp, Homo sapiens
aaatcagaagaagttcagaggaacacctaagacaaaccaggtcggagaccatgagaaacagcgtcaaatcatcttttcatgatcccaagctgaaaggcaakccctccagagagcgttatgtgacccacaaccgagcacattggtgacagaccttcggggcctgtctgaagccatagcctccacggagagccctgtggccga

SEQ ID NO: 15925 - DNA, 201 bp, Homo sapiens
aaaaaagatcattaaatcaggagattccctgtccttgatttttggagacacaatggtatagggttgtttatgaaatatattgaaaagtaagtgtttgttaygctttaaagcagtaaaattattttcctttatataaccggctaatgaaagaggttggattgaattttgatgtacttatttttttatagatatttatattca

SEQ ID NO: 15926 - DNA, 201 bp, Homo sapiens
gggtcaacactcccgagcacgttgttccgtatggacttggaagccctaggtccaagagagccttggagaatttacttcccacaaaggcaacagaccgtgaraatagatgccaatgtgctagccaaaaagacaagaagtgctggaatttttgccaagcaggaaaagaactcagggctgaagacattatggagaaagactgga

SEQ ID NO: 15927 - DNA, 201 bp, Homo sapiens; identical to SEQ ID NO: 15923

SEQ ID NO: 15928 - DNA, 201 bp, Homo sapiens; identical to SEQ ID NO: 15924

SEQ ID NO: 15929 - DNA, 201 bp, Homo sapiens; identical to SEQ ID NO: 15925

SEQ ID NO: 15930 - DNA, 201 bp, Homo sapiens; identical to SEQ ID NO: 15926

SEQ ID NO: 15931 - DNA, 108 bp, Homo sapiens
ctgactggcaaaggaccagcgtcctcgttcaaaactccaaagtccacacaaagattttctaaggaatgcacaaattgaaaacacactcaaaagacaaacakgcaagta

SEQ ID NO: 15932 - DNA, 201 bp, Homo sapiens; identical to SEQ ID NO: 15924

SEQ ID NO: 15933 - DNA, 201 bp, Homo sapiens; identical to SEQ ID NO: 15923

SEQ ID NO: 15934 - DNA, 201 bp, Homo sapiens; identical to SEQ ID NO: 15924

SEQ ID NO: 15935 - DNA, 201 bp, Homo sapiens; identical to SEQ ID NO: 15925

SEQ ID NO: 15936 - DNA, 201 bp, Homo sapiens
agaagagaatgtggtcaaaatacaggctttttggaaaggatataaacaacggaaggagtatatgcacaggcggcaaacgttcattgataatactgattctrttgtgaagattcagtcctggttccgaatggcaactgcaagaaagagctatctttcaagactacagtatttcagagatcataataatgaaattgtgaaaat

SEQ ID NO: 15937 - DNA, 201 bp, Homo sapiens
accaggatgttttataccatgctaaatcacagaaactcggagactctgagagtgtttccaaagtgctttggctggatgagatacagcaagccgtcgatgakgccaacgtggacgaggacagagcaaaacaatgggttactctggtggttgatgttaatcagtgtttggaaggaaaaaaatcaagtgatattttgtctgtat

SEQ ID NO: 15938 - DNA, 201 bp, Homo sapiens
gaaatactgaataacaccgacaaccaaggaataaaaagtttgagtaaggagaggagaaaaacactagaaacatatcagcagctgttttaccttttacagaycaaccctttatacttggctaagctgattttccagatgccacagaacaagtccactaaatttatggatactgttattttcacactatataattatgcctct

SEQ ID NO: 15939 - DNA, 201 bp, Homo sapiens
ccacttctaatgcaaatgacataatcccggagtgtgctgacaaatactatgatgcccttgtgaaggcaaaagagctcaaatctgaaagagtgtctagtgayggttcatggctcaaactcaacctgcacaaaaaatatgactactattacaacactgattcaaaagagagttcctgggtcacacctgaatcatgcttgtata

SEQ ID NO: 15940 - DNA, 201 bp, Homo sapiens
cccagcactaccaggatgttttataccatgctaaatcacagaaactcggagactctgagagtgtttccaaagtgctttggctggatgagatacagcaagcygtcgatgaggccaacgtggacgaggacagagcaaaacaatgggttactctggtggttgatgttaatcagtgtttggaaggaaaaaaatcaagtgatattt

SEQ ID NO: 15941 - DNA, 199 bp, Homo sapiens
ctggaggagaaaggaaacctgctgcgggaggcggcggcgaccggccagggagcgagggaggagagttcacttttacttcagtgtcagcgcgcggcggcygtggctggctctggcgagagagcaccgagggagtgggtcgcagatcttcgggcggctaggggaaatcggcgagaggcgggatccgagcgcgccggcgggg

SEQ ID NO: 15942 - DNA, 201 bp, Homo sapiens
gaaatcttagagacaccagcaactgcgcaacaggaggtagaccatgccacggacatggtgagccgtgcaatgatagattccaggactccagaagaaatgargcatagccaatctatgattgaagatgcacagctgcctcttgagcagaagaagaggaaaatccagaggaatcttcggacgttggaacagactggacacgtg

SEQ ID NO: 15943 - DNA, 201 bp, Homo sapiens
gtgacggttcatggctcaaactcaacctgcacaaaaaatatgactactattacaacactgattcaaaagagagttcctgggtcacacctgaatcatgcttstataaagaatcatggctcacaggaaaagaaatcgaggacattattgaggaagtcacagtaggttacattcgtgagaatatatggtctgcttcagaagagt

SEQ ID NO: 15944 - DNA, 201 bp, Homo sapiens
taaaaagctgaacaagaaaaaaggaggagaaatggaaatactgaataacaccgacaaccaaggaataaaaagtttgagtaaggagaggagaaaaacactasaaacatatcagcagctgttttaccttttacagaccaaccctttatacttggctaagctgattttccagatgccacagaacaagtccactaaatttatgga

SEQ ID NO: 15945 - DNA, 201 bp, Homo sapiens
agatgcaatatgaaggagtagctgtaatgaaaatgtttgataaggttaaagtgaatgtaaaccttctcatatacctgctgaacaagaagttctatggaaartgaagtgcctacagaaatttcttggattctgtatcatctggattaggaaatgaatttgtttaatatttttgtttttaaacatgattgaaatcactgctta

SEQ ID NO: 15946 - DNA, 201 bp, Homo sapiens
catgtaatgtccctgagccagaagagaagtttaatatggacaaatacacagacctggtgacagtcagcaaaccagtcatttatatttcaattgaagaaatmatcagcacacactcactcctgttggaacaccaggatgcaattgcccctgagaaaaatgacttactgagtgaattgctggggtcgctgggagaggtgccaa

SEQ ID NO: 15947 - DNA, 201 bp, Homo sapiens
tttcaattgaagaaatcatcagcacacactcactcctgttggaacaccaggatgcaattgcccctgagaaaaatgacttactgagtgaattgctggggtcrctgggagaggtgccaaccgtggaatcttttcttggggaaggagcagttgaccccaatgaccctaacaaggcaaatacactaagtcagctttcaaagaccg

SEQ ID NO: 15948 - DNA, 201 bp, Homo sapiens
caacactgattcaaaagagagttcctgggtcacacctgaatcatgcttgtataaagaatcatggctcacaggaaaagaaatcgaggacattattgaggaastcacagtaggttacattcgtgagaatatatggtctgcttcagaagagttgcttcttcgctttcaagccacaagctcaggacccatccttagggaagagtt

SEQ ID NO: 15949 - DNA, 201 bp, Homo sapiens
tagggtacatcaatgaagctattgatgaagggaatcctttgaggactttagaaactttgctcctacctactgcgaatattagtgatgtggacccagcccaygcccagcactaccaggatgttttataccatgctaaatcacagaaactcggagactctgagagtgtttccaaagtgctttggctggatgagatacagcaag

SEQ ID NO: 15950 - DNA, 201 bp, Homo sapiens
tagctgtagggtacatcaatgaagctattgatgaagggaatcctttgaggactttagaaactttgctcctacctactgcgaatattagtgatgtggacccwgcccatgcccagcactaccaggatgttttataccatgctaaatcacagaaactcggagactctgagagtgtttccaaagtgctttggctggatgagatac

SEQ ID NO: 15951 - DNA, 201 bp, Homo sapiens
aatgcacttaacaagaaggcagcattttatgaagagcaaatcaattattatgacacctacataaagacttgtttagacaacttaaaaagaaaaaatactcrgagatcaattaaactagatggaaaaggagaacccaaaggggcgaagagagcgaagccagtgaagtacactgcagcaaagctgcatgagaaaggtgtcctg

SEQ ID NO: 15952 - DNA, 201 bp, Homo sapiens
tgaagctagaaaatcatttttgcatgaacaagaagagaatgtggtcaaaatacaggctttttggaaaggatataaacaacggaaggagtatatgcacaggyggcaaacgttcattgataatactgattctattgtgaagattcagtcctggttccgaatggcaactgcaagaaagagctatctttcaagactacagtattt

SEQ ID NO: 15953 - DNA, 201 bp, Homo sapiens
ttcacagaggaggaaatcagtaatatgagaaaagaacttgagaaatatggaatacagatgccatctttcagcaaaataggtggtattctggccaatgaacwgtccgtggatgaagctgcattacatgctgcagttatagccattaatgaagcagttgaaaaaggaatagcagagcaaaccgttgtaacactaagaaaccca

SEQ ID NO: 15954 - DNA, 201 bp, Homo sapiens
ttcttggattctgtatcatctggattaggaaatgaatttgtttaatatttttgtttttaaacatgattgaaatcactgcttataaatgtgtgatttttttwaaacgaccaaaactgttctgaagaatgtacccaggtgcctttttgctaatttgatactataatagaatgagacataaaatgaattaatggaaacatatcc

SEQ ID NO: 15955 - DNA, 201 bp, Homo sapiens
tggattctgtatcatctggattaggaaatgaatttgtttaatatttttgtttttaaacatgattgaaatcactgcttataaatgtgtgattttttttaaaygaccaaaactgttctgaagaatgtacccaggtgcctttttgctaatttgatactataatagaatgagacataaaatgaattaatggaaacatatccacac

SEQ ID NO: 15956 - DNA, 201 bp, Homo sapiens
ttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgt

SEQ ID NO: 15957 - DNA, 201 bp, Homo sapiens
actggagaggccagcaagttgccttatgatgtgaccacagaacaagctctaacatacccagaagtgaaaaataaactggaggcttccattgagaacctgakaagggtcaccgacaaagtcctgaattctatcatttcttcccttgatctactgccttatggattgaggtatatagccaaagtactgaagaattcgatccat

SEQ ID NO: 15958 - DNA, 201 bp, Homo sapiens; identical to SEQ ID NO: 15936

SEQ ID NO: 15959 - DNA, 201 bp, Homo sapiens; identical to SEQ ID NO: 15937

SEQ ID NO: 15960 - DNA, 201 bp, Homo sapiens; identical to SEQ ID NO: 15938

SEQ ID NO: 15961 - DNA, 201 bp, Homo sapiens; identical to SEQ ID NO: 15939

SEQ ID NO: 15962 - DNA, 201 bp, Homo sapiens; identical to SEQ ID NO: 15940

SEQ ID NO: 15963 - DNA, 199 bp, Homo sapiens; identical to SEQ ID NO: 15941

SEQ ID NO: 15964 - DNA, 201 bp, Homo sapiens; identical to SEQ ID NO: 15942

SEQ ID NO: 15965 - DNA, 201 bp, Homo sapiens; identical to SEQ ID NO: 15943

SEQ ID NO: 15966 - DNA, 201 bp, Homo sapiens; identical to SEQ ID NO: 15944

SEQ ID NO: 15967 - DNA, 201 bp, Homo sapiens
atttaaaactttggacatcctgtgatctgttttaaagttggggggtgggaaatttagctgactagggacaaacatgtaaacctattttcctatgaaaaaarttttaaatgtcccacttgaataacgtaattcttcatagtttttttaatctatggataaatggaaacctaattatttgtaatgaattatttagacagttct

SEQ ID NO: 15968 - DNA, 201 bp, Homo sapiens; identical to SEQ ID NO: 15946

SEQ ID NO: 15969 - DNA, 201 bp, Homo sapiens; identical to SEQ ID NO: 15947

SEQ ID NO: 15970 - DNA, 201 bp, Homo sapiens; identical to SEQ ID NO: 15948

SEQ ID NO: 15971 - DNA, 201 bp, Homo sapiens; identical to SEQ ID NO: 15949

SEQ ID NO: 15972 - DNA, 201 bp, Homo sapiens; identical to SEQ ID NO: 15950

SEQ ID NO: 15973 - DNA, 201 bp, Homo sapiens; identical to SEQ ID NO: 15951

SEQ ID NO: 15974 - DNA, 201 bp, Homo sapiens; identical to SEQ ID NO: 15952

SEQ ID NO: 15975 - DNA, 201 bp, Homo sapiens; identical to SEQ ID NO: 15953

SEQ ID NO: 15976 - DNA, 201 bp, Homo sapiens; identical to SEQ ID NO: 15954

SEQ ID NO: 15977 - DNA, 201 bp, Homo sapiens; identical to SEQ ID NO: 15955

SEQ ID NO: 15978 - DNA, 201 bp, Homo sapiens; identical to SEQ ID NO: 15956

SEQ ID NO: 15979 - DNA, 201 bp, Homo sapiens; identical to SEQ ID NO: 15957

SEQ ID NO: 15980 - DNA, 201 bp, Homo sapiens; identical to SEQ ID NO: 15936

SEQ ID NO: 15981 - DNA, 201 bp, Homo sapiens; identical to SEQ ID NO: 15937

SEQ ID NO: 15982 - DNA, 201 bp, Homo sapiens; identical to SEQ ID NO: 15938

SEQ ID NO: 15983 - DNA, 201 bp, Homo sapiens; identical to SEQ ID NO: 15939

SEQ ID NO: 15984 - DNA, 201 bp, Homo sapiens; identical to SEQ ID NO: 15940

SEQ ID NO: 15985 - DNA, 199 bp, Homo sapiens; identical to SEQ ID NO: 15941

SEQ ID NO: 15986 - DNA, 201 bp, Homo sapiens; identical to SEQ ID NO: 15942

SEQ ID NO: 15987 - DNA, 201 bp, Homo sapiens; identical to SEQ ID NO: 15943

SEQ ID NO: 15988 - DNA, 201 bp, Homo sapiens; identical to SEQ ID NO: 15944

SEQ ID NO: 15989 - DNA, 201 bp, Homo sapiens; identical to SEQ ID NO: 15945

SEQ ID NO: 15990 - DNA, 201 bp, Homo sapiens; identical to SEQ ID NO: 15946

SEQ ID NO: 15991 - DNA, 201 bp, Homo sapiens; identical to SEQ ID NO: 15947

SEQ ID NO: 15992 - DNA, 201 bp, Homo sapiens; identical to SEQ ID NO: 15948

SEQ ID NO: 15993 - DNA, 201 bp, Homo sapiens; identical to SEQ ID NO: 15949

SEQ ID NO: 15994 - DNA, 201 bp, Homo sapiens; identical to SEQ ID NO: 15950

SEQ ID NO: 15995 - DNA, 201 bp, Homo sapiens; identical to SEQ ID NO: 15951

SEQ ID NO: 15996 - DNA, 201 bp, Homo sapiens; identical to SEQ ID NO: 15952

SEQ ID NO: 15997 - DNA, 201 bp, Homo sapiens; identical to SEQ ID NO: 15953

SEQ ID NO: 15998 - DNA, 201 bp, Homo sapiens; identical to SEQ ID NO: 15954

SEQ ID NO: 15999 - DNA, 201 bp, Homo sapiens; identical to SEQ ID NO: 15955

SEQ ID NO: 16000 - DNA, 201 bp, Homo sapiens; identical to SEQ ID NO: 15956

SEQ ID NO: 16001 - DNA, 201 bp, Homo sapiens; identical to SEQ ID NO: 15957

SEQ ID NO: 16002 - DNA, 199 bp, Homo sapiens; identical to SEQ ID NO: 15941

SEQ ID NO: 16003 - DNA, 201 bp, Homo sapiens
ggtgtgggcaacagttttcttatatatgctgccatttttcatactgaagcaggaatattatcttgttcagccagacatcaccacctgccatgatgttcacracacttgcgagtcctcatctcccttccaactctattacttcatctccttggcattctttggattcttaattccatttgtgcttatcatctactgctatgc

SEQ ID NO: 16004 - DNA, 201 bp, Homo sapiens
ctccttgcctgcatcagcatcaaccgctacctggccatcgtccatcctttcacctaccggggcctgcccaagcacacctatgccttggtaacatgtggacyggtgtgggcaacagttttcttatatatgctgccatttttcatactgaagcaggaatattatcttgttcagccagacatcaccacctgccatgatgttcac

SEQ ID NO: 16005 - DNA, 201 bp, Homo sapiens
tgttacattgccctttaagatagcttatcatctcaatgggaacaactgggtatttggagaggtcctgtgccgggccaccacagtcatcttctatggcaacrtgtactgctccattctgctccttgcctgcatcagcatcaaccgctacctggccatcgtccatcctttcacctaccggggcctgcccaagcacacctatgc

SEQ ID NO: 16006 - DNA, 133 bp, Homo sapiens
taatgcaggagaaaagatatcacaactctatggaaaatgacatttccatttgccttattgctacttcaagctctttaaatcaccatcttccctatttctgygagtggtattgccatccttgacatttgacatc

SEQ ID NO: 16007 - DNA, 180 bp, Homo sapiens
gtggattacatcctttccctgcggaggaccagggcaagtttcctgcctgcacggcacaggagagcaaacttctacagacrgaccaaggcttccatttgctgctgacacatggaactgaggtgaaattgtgctccatgattttacagatttcataacgtttaagagacgggactcaggtca

SEQ ID NO: 16008 - DNA, 201 bp, Homo sapiens
gaaatgatcttagagaacaaggacagccatcacagagaacgtctgttttcaagaacaacataagcatagtgcaaggagctccatttccgagctcctaagaratatgcttcaaaggtcaaacattacaaaagcattagtagtttgtttgtttgtttttgagactgagtctcactttatcacccagactggcgtgcagtggca

SEQ ID NO: 16009 - DNA, 201 bp, Homo sapiens
gaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcat

SEQ ID NO: 16010 - DNA, 201 bp, Homo sapiens
tacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttc

SEQ ID NO: 16011 - DNA, 119 bp, Homo sapiens
aaatttgctgttctggtattaccaaaccacacatttgtaccgaattggcagtaaatgttagccatttacagcaatgccaaatatggagaaacatcataatwaaaaaatctgctttttca

SEQ ID NO: 16012 - DNA, 201 bp, Homo sapiens
aatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcaccta

SEQ ID NO: 16013 - DNA, 201 bp, Homo sapiens
cgcgactccccccgggcccaaattgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 16014 - DNA, 201 bp, Homo sapiens
caacttggaggatcatgactacgctcaacatgttaggagggcggcaagtgattgcagcagtgaaatgggcaaaggcaataccaggtttcaggaacttacayctggatgaccaaatgaccctactgcagtactcctggatgtttcttatggcatttgctctggggtggagatcatatagacaatcaagtgcaaacctgctgt

SEQ ID NO: 16015 - DNA, 201 bp, Homo sapiens
gggcatgccatgaaggaaagccacgctcccttcagaattcagaggcagggagcaattccagtttcacctaagtctcataattttagttcccttttaaaaaycctgaaaactacatcaccatggaatgaaaaatattgttatacaatacattgatctgtcaaacttccagaaccatggtagccttcagtgagatttccatct

SEQ ID NO: 16016 - DNA, 201 bp, Homo sapiens
agagctaggaaaagccattgtcaagagggaaggaaactccagccagaactggcagcggttttatcaactgacaaaactcttggattctatgcatgaagtgrttgaaaatctccttaactattgcttccaaacatttttggataagaccatgagtattgaattccccgagatgttagctgaaatcatcaccaatcagatacc

SEQ ID NO: 16017 - DNA, 201 bp, Homo sapiens
aaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgat

SEQ ID NO: 16018 - DNA, 201 bp, Homo sapiens
tccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaagcaagagaaactgggcacagtttact

SEQ ID NO: 16019 - DNA, 201 bp, Homo sapiens
ggttttatcaactgacaaaactcttggattctatgcatgaagtggttgaaaatctccttaactattgcttccaaacatttttggataagaccatgagtatkgaattccccgagatgttagctgaaatcatcaccaatcagataccaaaatattcaaatggaaatatcaaaaaacttctgtttcatcaaaagtgactgcctt

SEQ ID NO: 16020 - DNA, 201 bp, Homo sapiens
tctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttca

SEQ ID NO: 16021 - DNA, 201 bp, Homo sapiens
atggagatctggttttgtcaagccccagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacct

SEQ ID NO: 16022 - DNA, 201 bp, Homo sapiens
aatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctagggg

SEQ ID NO: 16023 - DNA, 201 bp, Homo sapiens
agaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaa

SEQ ID NO: 16024 - DNA, 201 bp, Homo sapiens
ttaactattgcttccaaacatttttggataagaccatgagtattgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactat

SEQ ID NO: 16025 - DNA, 201 bp, Homo sapiens
cagatgtaccactatgacatgaatacagcatccctttctcaacagcaggatcagaagcctatttttaatgtcattccaccaattcccgttggttccgaaarttggaataggtgccaaggatctggagatgacaacttgacttctctggggactctgaacttccctggtcgaacagttttttctaatggctattcaagcccc

SEQ ID NO: 16026 - DNA, 201 bp, Homo sapiens
gcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctg

SEQ ID NO: 16027 - DNA, 201 bp, Homo sapiens
ctggaatgaacctggaagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagct

SEQ ID NO: 16028 - DNA, 201 bp, Homo sapiens
taccactatgacatgaatacagcatccctttctcaacagcaggatcagaagcctatttttaatgtcattccaccaattcccgttggttccgaaaattggartaggtgccaaggatctggagatgacaacttgacttctctggggactctgaacttccctggtcgaacagttttttctaatggctattcaagccccagcatg

SEQ ID NO: 16029 - DNA, 201 bp, Homo sapiens
ccacaactcacccctaccctggtgtcactgttggaggttattgaacctgaagtgttatatgcaggatatgatagctctgttccagactcaacttggaggawcatgactacgctcaacatgttaggagggcggcaagtgattgcagcagtgaaatgggcaaaggcaataccaggtttcaggaacttacacctggatgaccaa

SEQ ID NO: 16030 - DNA, 201 bp, Homo sapiens
acatgctgtatgtttcctctgagttacacaggcttcaggtatcttatgaagagtatctctgtatgaaaaccttactgcttctctcttcagttcctaaggayggtctgaagagccaagagctatttgatgaaattagaatgacctacatcaaagagctaggaaaagccattgtcaagagggaaggaaactccagccagaact

SEQ ID NO: 16031 - DNA, 201 bp, Homo sapiens
cgactccccccgggcccaaattgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 16032 - DNA, 201 bp, Homo sapiens; identical to SEQ ID NO: 16009

SEQ ID NO: 16033 - DNA, 201 bp, Homo sapiens; identical to SEQ ID NO: 16010

SEQ ID NO: 16034 - DNA, 119 bp, Homo sapiens; identical to SEQ ID NO: 16011

SEQ ID NO: 16035 - DNA, 201 bp, Homo sapiens; identical to SEQ ID NO: 16012

SEQ ID NO: 16036 - DNA, 201 bp, Homo sapiens
gcgagcggctcctctgccagagttgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 16037 - DNA, 201 bp, Homo sapiens; identical to SEQ ID NO: 16014

SEQ ID NO: 16038 - DNA, 201 bp, Homo sapiens; identical to SEQ ID NO: 16015

SEQ ID NO: 16039 - DNA, 201 bp, Homo sapiens; identical to SEQ ID NO: 16016

SEQ ID NO: 16040 - DNA, 201 bp, Homo sapiens; identical to SEQ ID NO: 16017

SEQ ID NO: 16041 - DNA, 201 bp, Homo sapiens; identical to SEQ ID NO: 16018

SEQ ID NO: 16042 - DNA, 201 bp, Homo sapiens; identical to SEQ ID NO: 16019

SEQ ID NO: 16043 - DNA, 201 bp, Homo sapiens; identical to SEQ ID NO: 16020

SEQ ID NO: 16044 - DNA, 201 bp, Homo sapiens; identical to SEQ ID NO: 16021

SEQ ID NO: 16045 - DNA, 201 bp, Homo sapiens; identical to SEQ ID NO: 16022

SEQ ID NO: 16046 - DNA, 201 bp, Homo sapiens; identical to SEQ ID NO: 16023

SEQ ID NO: 16047 - DNA, 201 bp, Homo sapiens; identical to SEQ ID NO: 16024

SEQ ID NO: 16048 - DNA, 201 bp, Homo sapiens; identical to SEQ ID NO: 16025

SEQ ID NO: 16049 - DNA, 201 bp, Homo sapiens; identical to SEQ ID NO: 16026

SEQ ID NO: 16050 - DNA, 201 bp, Homo sapiens; identical to SEQ ID NO: 16027

SEQ ID NO: 16051 - DNA, 201 bp, Homo sapiens; identical to SEQ ID NO: 16028

SEQ ID NO: 16052 - DNA, 201 bp, Homo sapiens; identical to SEQ ID NO: 16029

SEQ ID NO: 16053 - DNA, 201 bp, Homo sapiens; identical to SEQ ID NO: 16030

SEQ ID NO: 16054 - DNA, 201 bp, Homo sapiens
gagcggctcctctgccagagttgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 16055 - DNA, 201 bp, Homo sapiens
gaaaataaggaagtattacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattagtaagttcaaaggt

SEQ ID NO: 16056 - DNA, 201 bp, Homo sapiens
  misc_feature (1)...(201): n = A,T,C or G, or insertion/deletion polymorphism (see Tables 1-2)
aaagagttctactcatatcaaaatgaggcagtggccatagaaaatatcaagagaggcctggctagcctatttcagacacagttaagctctggaaccaccantgaggtagatatctctggaaattgtaaagtgacctaccaggctcatcaagacaaagtgatcaaaattaaggccttggattcatgcaaaatagcgaggtct

SEQ ID NO: 16057 - DNA, 201 bp, Homo sapiens
ctctgcaaagacctacgctccttcatctaatccatggaaaggtcaaagagttctactcatatcaaaatgaggcagtggccatagaaaatatcaagagaggyctggctagcctatttcagacacagttaagctctggaaccaccaatgaggtagatatctctggaaattgtaaagtgacctaccaggctcatcaagacaaag

SEQ ID NO: 16058 - DNA, 201 bp, Homo sapiens
gttccctaatcaggaaaaaaaaaaaaaaaaaaagtaagacacaaacaaaccattttttttctctttttttggagttgggggcccagggagaagggacaagrcttttaaaagacttgttagccaacttcaagaattaatatttatgtctctgttattgttagttttaagccttaaggtagaaggcacatagaaataacatct

SEQ ID NO: 16059 - DNA, 201 bp, Homo sapiens
aaaatgtttttatttgtatgaattaaaagatccatgttgaacatttgcaaatatttattaataaacagatgtggtgataaacccaaaacaaatgacaggtscttattttccactaaacacagacacatgaaatgaaagtttagctagcccactatttgttgtaaattgaaaacgaagtgtgataaaataaatatgtagaaa

SEQ ID NO: 16060 - DNA, 201 bp, Homo sapiens
aggcagtggccatagaaaatatcaagagaggcctggctagcctatttcagacacagttaagctctggaaccaccaatgaggtagatatctctggaaattgyaaagtgacctaccaggctcatcaagacaaagtgatcaaaattaaggccttggattcatgcaaaatagcgaggtctggatttacgaccccaaatcaggtct

SEQ ID NO: 16061 - DNA, 201 bp, Homo sapiens
gcccaagattgatgtctggaaagcaggctgcagccataatcaaagcagttgattcaaagtacacggccattcccattgtggggcaggtcttccagagccastgtaaaggatgtccttctctctcggagctctggcggtccaccaggaaatacctgcagcctgacaacctttccaaggctgaggctgtcagaaacttcctgg

SEQ ID NO: 16062 - DNA, 201 bp, Homo sapiens
aagcagttgattcaaagtacacggccattcccattgtggggcaggtcttccagagccagtgtaaaggatgtccttctctctcggagctctggcggtccacmaggaaatacctgcagcctgacaacctttccaaggctgaggctgtcagaaacttcctggccttcattcagcacctcaggactgcgaagaaagaagagatcc

SEQ ID NO: 16063 - DNA, 201 bp, Homo sapiens
agagtccacttctcagtgactcctagctgggcactggatgcagttgaggattgctggtcaatatgattcttcttgctgtgctttttctctgcttcatttcstcatattcagcttctgttaaaggtcacacaactggtctctcattaaataatgaccggctgtacaagctcacgtactccactgaagttcttcttgatcggg

SEQ ID NO: 16064 - DNA, 201 bp, Homo sapiens
agcaggcttggagtttatctccacagtgcagttttctcagtacccattcttagtttgcatgcagatggacaaggatgaagctccattcaggcaatttgagwaaaagtacgaaaggctgtccacaggcagaggttatgtctctcagaaaagaaaagaaagcgtattagcaggatgtgaattcccgctccatcaagagaactc

SEQ ID NO: 16065 - DNA, 201 bp, Homo sapiens
tggccttactatggaggaatcctgatggtgatgatgaccagttgatccaaataacgatgaaggatgtaaatgttgaaaatgtgaatcagcagagaggagasaagagcatcttcaaaggaaaaagcccatctaaaataatgggaaaggaaaacttggaagctctgcaaagacctacgctccttcatctaatccatggaaagg

SEQ ID NO: 16066 - DNA, 201 bp, Homo sapiens
gctctccagagatatgatctccctttcataactgatgaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaa

SEQ ID NO: 16067 - DNA, 201 bp, Homo sapiens
acgtggatgtggccttactatggaggaatcctgatggtgatgatgaccagttgatccaaataacgatgaaggatgtaaatgttgaaaatgtgaatcagcasagaggagagaagagcatcttcaaaggaaaaagcccatctaaaataatgggaaaggaaaacttggaagctctgcaaagacctacgctccttcatctaatcc

SEQ ID NO: 16068 - DNA, 201 bp, Homo sapiens
tggggcaggtcttccagagccagtgtaaaggatgtccttctctctcggagctctggcggtccaccaggaaatacctgcagcctgacaacctttccaaggcygaggctgtcagaaacttcctggccttcattcagcacctcaggactgcgaagaaagaagagatccttcaaatactaaagatggaaaataaggaagtattac

SEQ ID NO: 16069 - DNA, 201 bp, Homo sapiens
ccatctaaaataatgggaaaggaaaacttggaagctctgcaaagacctacgctccttcatctaatccatggaaaggtcaaagagttctactcatatcaaartgaggcagtggccatagaaaatatcaagagaggcctggctagcctatttcagacacagttaagctctggaaccaccaatgaggtagatatctctggaaat

SEQ ID NO: 16070 - DNA, 201 bp, Homo sapiens
caaggatgaagctccattcaggcaatttgagaaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacc

SEQ ID NO: 16071 - DNA, 201 bp, Homo sapiens
gttcaaaggttctattggtagcagtgacatcagagaaactgttatgatcatcactgggacacttgtcagaaagttgtgtcagaatgaaggctgcaaactcwaagcagtagtggaagctaagaagttaatcctgggaggacttgaaaaagcagagaaaaaagaggacaccaggatgtatctgctggctttgaagaatgccct

SEQ ID NO: 16072 - DNA, 201 bp, Homo sapiens
gtcaagaacatcctgctgtctattggggagcttccccaagaaatgaataaatacatgctcgccattgttcaagacatcctacgttttgaaatgcctgcaakcaaaattgtccgtcgagttctgaaggaaatggtcgctcacaattatgaccgtttctccaggagtggatcttcttctgcctacactggctacatagaacgt

SEQ ID NO: 16073 - DNA, 201 bp, Homo sapiens
actaaaagccaatatagaggtccagggtggtctagctattgatatttcaggtgcaatggagtttagcttgtggtatcgtgagtctaaaacccgagtgaaawatagggtgactgtggtaataaccactgacatcacagtggactcctcttttgtgaaagctggcctggaaaccagtacagaaacagaagcaggcttggagtt

SEQ ID NO: 16074 - DNA, 201 bp, Homo sapiens
cagagaggagagaagagcatcttcaaaggaaaaagcccatctaaaataatgggaaaggaaaacttggaagctctgcaaagacctacgctccttcatctaayccatggaaaggtcaaagagttctactcatatcaaaatgaggcagtggccatagaaaatatcaagagaggcctggctagcctatttcagacacagttaagc

SEQ ID NO: 16075 - DNA, 201 bp, Homo sapiens
gttctactcatatcaaaatgaggcagtggccatagaaaatatcaagagaggcctggctagcctatttcagacacagttaagctctggaaccaccaatgagrtagatatctctggaaattgtaaagtgacctaccaggctcatcaagacaaagtgatcaaaattaaggccttggattcatgcaaaatagcgaggtctggatt

SEQ ID NO: 16076 - DNA, 201 bp, Homo sapiens
ctcgatcgggacgctggacagactccccaccaatgtgtgaagccatcaagtgcccagaactctttgccccagagcagggcagcctggattgttctgacacycgtggagaattcaatgttggctccacctgccatttctcttgtgacaacggctttaagctggaggggcccaataatgtggaatgcacaacttctggaagat

SEQ ID NO: 16077 - DNA, 201 bp, Homo sapiens
atgttggctccacctgccatttctcttgtgacaacggctttaagctggaggggcccaataatgtggaatgcacaacttctggaagatggtcagctactccrccaacctgcaaaggcatagcatcacttcctactccaggggtgcaatgtccagccctcaccactcctgggcagggaaccatgtactgtaggcatcatccgg

SEQ ID NO: 16078 - DNA, 201 bp, Homo sapiens
taagctggaggggcccaataatgtggaatgcacaacttctggaagatggtcagctactccaccaacctgcaaaggcatagcatcacttcctactccagggktgcaatgtccagccctcaccactcctgggcagggaaccatgtactgtaggcatcatccgggaacctttggttttaataccacttgttactttggctgcaa

SEQ ID NO: 16079 - DNA, 201 bp, Homo sapiens
agtgcccagaactctttgccccagagcagggcagcctggattgttctgacactcgtggagaattcaatgttggctccacctgccatttctcttgtgacaayggctttaagctggaggggcccaataatgtggaatgcacaacttctggaagatggtcagctactccaccaacctgcaaaggcatagcatcacttcctactc

SEQ ID NO: 16080 - DNA, 201 bp, Homo sapiens
acctgcaaaggcatagcatcacttcctactccaggggtgcaatgtccagccctcaccactcctgggcagggaaccatgtactgtaggcatcatccgggaamctttggttttaataccacttgttactttggctgcaacgctggattcacactcataggagacagcactctcagctgcagaccttcaggacaatggacagca

SEQ ID NO: 16081 - DNA, 201 bp, Homo sapiens
catcaagtgcccagaactctttgccccagagcagggcagcctggattgttctgacactcgtggagaattcaatgttggctccacctgccatttctcttgtracaacggctttaagctggaggggcccaataatgtggaatgcacaacttctggaagatggtcagctactccaccaacctgcaaaggcatagcatcacttcc

SEQ ID NO: 16082 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaagcaggaccattgactatccaggaagccctgacttactttggtggagcggtggcttctacgataggtctgataatgggtgg

SEQ ID NO: 16083 - DNA, 201 bp, Homo sapiens
gcctttaggtaccagtcagtctgcagcttcacctgcaatgaaggcttgctcctggtgggagcaagtgtgctacagtgcttggctactggaaactggaattytgttcctccagaatgccaagccattccctgcacacctttgctaagccctcagaatggaacaatgacctgtgttcaacctcttggaagttccagttataaa

SEQ ID NO: 16084 - DNA, 201 bp, Homo sapiens
gtgcaatgtccagccctcaccactcctgggcagggaaccatgtactgtaggcatcatccgggaacctttggttttaataccacttgttactttggctgcarcgctggattcacactcataggagacagcactctcagctgcagaccttcaggacaatggacagcagtaactccagcatgcagagctgtgaaatgctcagaa

SEQ ID NO: 16085 - DNA, 201 bp, Homo sapiens
aagctggaatgcttggcttctggaatctggacaaataagcctccacagtgtttagctgcccagtgcccacccctgaagattcctgaacgaggaaacatgayctgccttcattctgcaaaagcattccagcatcagtctagctgcagcttcagttgtgaagagggatttgcattagttggaccggaagtggtgcaatgcaca

SEQ ID NO: 16086 - DNA, 201 bp, Homo sapiens
caatgtgtgaagccatcaagtgcccagaactctttgccccagagcagggcagcctggattgttctgacactcgtggagaattcaatgttggctccacctgycatttctcttgtgacaacggctttaagctggaggggcccaataatgtggaatgcacaacttctggaagatggtcagctactccaccaacctgcaaaggca

SEQ ID NO: 16087 - DNA, 201 bp, Homo sapiens
cctgctcctgttaccctggattctatgggccagaatgtgaatacgtgagagagtgtggagaacttgagctccctcaacacgtgctcatgaactgcagccaycctctgggaaacttctcttttaactcgcagtgcagcttccactgcactgacgggtaccaagtaaatgggcccagcaagctggaatgcttggcttctggaa

SEQ ID NO: 16088 - DNA, 201 bp, Homo sapiens
gccgatatagttcggtgtgataacttgggacagtggacagcaccagccccagtctgtcaagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacag

SEQ ID NO: 16089 - DNA, 201 bp, Homo sapiens
tccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaagccatcaagtgcccagaact

SEQ ID NO: 16090 - DNA, 201 bp, Homo sapiens
tgccatttctcttgtgacaacggctttaagctggaggggcccaataatgtggaatgcacaacttctggaagatggtcagctactccaccaacctgcaaagkcatagcatcacttcctactccaggggtgcaatgtccagccctcaccactcctgggcagggaaccatgtactgtaggcatcatccgggaacctttggtttt

SEQ ID NO: 16091 - DNA, 201 bp, Homo sapiens
ttctgacactcgtggagaattcaatgttggctccacctgccatttctcttgtgacaacggctttaagctggaggggcccaataatgtggaatgcacaactkctggaagatggtcagctactccaccaacctgcaaaggcatagcatcacttcctactccaggggtgcaatgtccagccctcaccactcctgggcagggaac

SEQ ID NO: 16092 - DNA, 201 bp, Homo sapiens
caacctgcaaaggcatagcatcacttcctactccaggggtgcaatgtccagccctcaccactcctgggcagggaaccatgtactgtaggcatcatccgggracctttggttttaataccacttgttactttggctgcaacgctggattcacactcataggagacagcactctcagctgcagaccttcaggacaatggacag

SEQ ID NO: 16093 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaagctatttcgtgtgagccgctggagagtcctgtccacggaagc

SEQ ID NO: 16094 - DNA, 201 bp, Homo sapiens
cgagaccatcgggaactacacctgctcctgttaccctggattctatgggccagaatgtgaatacgtgagagagtgtggagaacttgagctccctcaacacrtgctcatgaactgcagccaccctctgggaaacttctcttttaactcgcagtgcagcttccactgcactgacgggtaccaagtaaatgggcccagcaagct

SEQ ID NO: 16095 - DNA, 138 bp, Homo sapiens
gatggcaccagaggctgcagaaggccaagaatcaagctagaaggccacatgtcaccgtggaccttcctgccaccagtcactgtccctcaaatgacccaaasaccaatattcaaatgcgtaattaaaagaattttcccc

SEQ ID NO: 16096 - DNA, 201 bp, Homo sapiens
ccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacagcctcctgccaggacatgtcctgcagcaaacaaggag

SEQ ID NO: 16097 - DNA, 201 bp, Homo sapiens
aagagaatggccactggtcaactaccgtgccaacctgccaagcaggaccattgactatccaggaagccctgacttactttggtggagcggtggcttctacrataggtctgataatgggtgggacgctcctggctttgctaagaaagcgtttcagacaaaaagatgatgggaaatgccccttgaatcctcacagccacctag

SEQ ID NO: 16098 - DNA, 201 bp, Homo sapiens; identical to SEQ ID NO: 16076

SEQ ID NO: 16099 - DNA, 201 bp, Homo sapiens; identical to SEQ ID NO: 16077

SEQ ID NO: 16100 - DNA, 201 bp, Homo sapiens; identical to SEQ ID NO: 16078

SEQ ID NO: 16101 - DNA, 201 bp, Homo sapiens; identical to SEQ ID NO: 16079

SEQ ID NO: 16102 - DNA, 201 bp, Homo sapiens; identical to SEQ ID NO: 16080

SEQ ID NO: 16103 - DNA, 201 bp, Homo sapiens; identical to SEQ ID NO: 16081

SEQ ID NO: 16104 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaagatgatgggaaatgccccttgaatcctcacagccacctaggaacatatggagtttttacaaacgctgcatttgacccgag

SEQ ID NO: 16105 - DNA, 201 bp, Homo sapiens; identical to SEQ ID NO: 16083

SEQ ID NO: 16106 - DNA, 201 bp, Homo sapiens
tgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgaggctatttcgtgtgagccgctggagagtcctgtccacggaagcatgga

SEQ ID NO: 16107 - DNA, 201 bp, Homo sapiens; identical to SEQ ID NO: 16084

SEQ ID NO: 16108 - DNA, 201 bp, Homo sapiens
ttagttggaccggaagtggtgcaatgcacagcctcgggggtatggacagccccagccccagtgtgtaaagctgtgcagtgtcagcacctggaagcccccartgaaggaaccatggactgtgttcatccgctcactgcttttgcctatggctccagctgtaaatttgagtgccagcccggctacagagtgaggggcttggac

SEQ ID NO: 16109 - DNA, 201 bp, Homo sapiens; identical to SEQ ID NO: 16085

SEQ ID NO: 16110 - DNA, 201 bp, Homo sapiens; identical to SEQ ID NO: 16086

SEQ ID NO: 16111 - DNA, 201 bp, Homo sapiens; identical to SEQ ID NO: 16087

SEQ ID NO: 16112 - DNA, 201 bp, Homo sapiens; identical to SEQ ID NO: 16088

SEQ ID NO: 16113 - DNA, 201 bp, Homo sapiens; identical to SEQ ID NO: 16089

SEQ ID NO: 16114 - DNA, 201 bp, Homo sapiens; identical to SEQ ID NO: 16090

SEQ ID NO: 16115 - DNA, 201 bp, Homo sapiens; identical to SEQ ID NO: 16091

SEQ ID NO: 16116 - DNA, 201 bp, Homo sapiens; identical to SEQ ID NO: 16092

SEQ ID NO: 16117 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaagctgtgcagtgtcagcacctggaagcccccagtgaaggaacc

SEQ ID NO: 16118 - DNA, 201 bp, Homo sapiens; identical to SEQ ID NO: 16094

SEQ ID NO: 16119 - DNA, 138 bp, Homo sapiens; identical to SEQ ID NO: 16095

SEQ ID NO: 16120 - DNA, 201 bp, Homo sapiens; identical to SEQ ID NO: 16096

SEQ ID NO: 16121 - DNA, 201 bp, Homo sapiens; identical to SEQ ID NO: 16076

SEQ ID NO: 16122 - DNA, 201 bp, Homo sapiens; identical to SEQ ID NO: 16077

SEQ ID NO: 16123 - DNA, 201 bp, Homo sapiens; identical to SEQ ID NO: 16078

SEQ ID NO: 16124 - DNA, 201 bp, Homo sapiens; identical to SEQ ID NO: 16079

SEQ ID NO: 16125 - DNA, 201 bp, Homo sapiens; identical to SEQ ID NO: 16080

SEQ ID NO: 16126 - DNA, 201 bp, Homo sapiens; identical to SEQ ID NO: 16081

SEQ ID NO: 16127 - DNA, 201 bp, Homo sapiens; identical to SEQ ID NO: 16082

SEQ ID NO: 16128 - DNA, 201 bp, Homo sapiens; identical to SEQ ID NO: 16083

SEQ ID NO: 16129 - DNA, 201 bp, Homo sapiens; identical to SEQ ID NO: 16106

SEQ ID NO: 16130 - DNA, 201 bp, Homo sapiens; identical to SEQ ID NO: 16084

SEQ ID NO: 16131 - DNA, 201 bp, Homo sapiens; identical to SEQ ID NO: 16108

SEQ ID NO: 16132 - DNA, 201 bp, Homo sapiens; identical to SEQ ID NO: 16085

SEQ ID NO: 16133 - DNA, 201 bp, Homo sapiens; identical to SEQ ID NO: 16086

SEQ ID NO: 16134 - DNA, 201 bp, Homo sapiens; identical to SEQ ID NO: 16087

SEQ ID NO: 16135 - DNA, 201 bp, Homo sapiens; identical to SEQ ID NO: 16088

SEQ ID NO: 16136 - DNA, 201 bp, Homo sapiens; identical to SEQ ID NO: 16089

SEQ ID NO: 16137 - DNA, 201 bp, Homo sapiens; identical to SEQ ID NO: 16090

SEQ ID NO: 16138 - DNA, 201 bp, Homo sapiens; identical to SEQ ID NO: 16091

SEQ ID NO: 16139 - DNA, 201 bp, Homo sapiens; identical to SEQ ID NO: 16092

SEQ ID NO: 16140 - DNA, 201 bp, Homo sapiens; identical to SEQ ID NO: 16117

SEQ ID NO: 16141 - DNA, 201 bp, Homo sapiens; identical to SEQ ID NO: 16094

SEQ ID NO: 16142 - DNA, 138 bp, Homo sapiens; identical to SEQ ID NO: 16095

SEQ ID NO: 16143 - DNA, 201 bp, Homo sapiens; identical to SEQ ID NO: 16096

SEQ ID NO: 16144 - DNA, 201 bp, Homo sapiens; identical to SEQ ID NO: 16097

SEQ ID NO: 16145 - DNA, 201 bp, Homo sapiens; identical to SEQ ID NO: 16076

SEQ ID NO: 16146 - DNA, 201 bp, Homo sapiens; identical to SEQ ID NO: 16077

SEQ ID NO: 16147 - DNA, 201 bp, Homo sapiens; identical to SEQ ID NO: 16078

SEQ ID NO: 16148 - DNA, 201 bp, Homo sapiens; identical to SEQ ID NO: 16079

SEQ ID NO: 16149 - DNA, 201 bp, Homo sapiens; identical to SEQ ID NO: 16080

SEQ ID NO: 16150 - DNA, 201 bp, Homo sapiens; identical to SEQ ID NO: 16081

SEQ ID NO: 16151 - DNA, 201 bp, Homo sapiens; identical to SEQ ID NO: 16082

SEQ ID NO: 16152 - DNA, 201 bp, Homo sapiens; identical to SEQ ID NO: 16083

SEQ ID NO: 16153 - DNA, 201 bp, Homo sapiens; identical to SEQ ID NO: 16106

SEQ ID NO: 16154 - DNA, 201 bp, Homo sapiens; identical to SEQ ID NO: 16084

SEQ ID NO: 16155 - DNA, 201 bp, Homo sapiens; identical to SEQ ID NO: 16108

SEQ ID NO: 16156 - DNA, 201 bp, Homo sapiens; identical to SEQ ID NO: 16085

SEQ ID NO: 16157 - DNA, 201 bp, Homo sapiens; identical to SEQ ID NO: 16086

SEQ ID NO: 16158 - DNA, 201 bp, Homo sapiens; identical to SEQ ID NO: 16087

SEQ ID NO: 16159 - DNA, 201 bp, Homo sapiens; identical to SEQ ID NO: 16088

SEQ ID NO: 16160 - DNA, 201 bp, Homo sapiens; identical to SEQ ID NO: 16089

SEQ ID NO: 16161 - DNA, 201 bp, Homo sapiens; identical to SEQ ID NO: 16090

SEQ ID NO: 16162 - DNA, 201 bp, Homo sapiens; identical to SEQ ID NO: 16091

SEQ ID NO: 16163 - DNA, 201 bp, Homo sapiens; identical to SEQ ID NO: 16092

SEQ ID NO: 16164 - DNA, 201 bp, Homo sapiens; identical to SEQ ID NO: 16117

SEQ ID NO: 16165 - DNA, 201 bp, Homo sapiens; identical to SEQ ID NO: 16094

SEQ ID NO: 16166 - DNA, 138 bp, Homo sapiens; identical to SEQ ID NO: 16095

SEQ ID NO: 16167 - DNA, 201 bp, Homo sapiens; identical to SEQ ID NO: 16096

SEQ ID NO: 16168 - DNA, 201 bp, Homo sapiens; identical to SEQ ID NO: 16097

SEQ ID NO: 16169 - DNA, 201 bp, Homo sapiens
acctaaactccatattgagctattcaccaagttattactggattggaatcagaaaagtcaacaatgtgtgggtctgggtaggaacccagaaacctctgacrgaagaagccaagaactgggctccaggtgaacccaacaataggcaaaaagatgaggactgcgtggagatctacatcaagagagaaaaagatgtgggcatgt

SEQ ID NO: 16170 - DNA, 201 bp, Homo sapiens
tttccgttatgggtccagctgtgagttctcctgtgagcagggttttgtgttgaagggatccaaaaggctccaatgtggccccacaggggagtgggacaacsagaagcccacatgtgaagctgtgagatgcgatgctgtccaccagcccccgaagggtttggtgaggtgtgctcattcccctattggagaattcacctacaa

SEQ ID NO: 16171 - DNA, 201 bp, Homo sapiens
gtttccgttatgggtccagctgtgagttctcctgtgagcagggttttgtgttgaagggatccaaaaggctccaatgtggccccacaggggagtgggacaaygagaagcccacatgtgaagctgtgagatgcgatgctgtccaccagcccccgaagggtttggtgaggtgtgctcattcccctattggagaattcacctaca

SEQ ID NO: 16172 - DNA, 201 bp, Homo sapiens
cttcccatggaacacaacctgtacatttgactgtgaagaaggatttgaactaatgggagcccagagccttcagtgtacctcatctgggaattgggacaacragaagccaacgtgtaaagctgtgacatgcagggccgtccgccagcctcagaatggctctgtgaggtgcagccattcccctgctggagagttcaccttcaa

SEQ ID NO: 16173 - DNA, 201 bp, Homo sapiens
acctgccaagcagcatggagaccatgcagtgtatgtcctctggagaatggagtgctcctattccagcctgcaatgtggttgagtgtgatgctgtgacaaayccagccaatgggttcgtggaatgtttccaaaaccctggaagcttcccatggaacacaacctgtacatttgactgtgaagaaggatttgaactaatgggag

SEQ ID NO: 16174 - DNA, 138 bp, Homo sapiens
cagctgttcttggctgacttcacatcaaaactcctatrctgacctgagacagaggcagcagtgatacccacctgagagatcctgtgtttgaacaactgcttcccaaaacggaaagtatttcaagcctaaacctttggg

SEQ ID NO: 16175 - DNA, 201 bp, Homo sapiens
gccttgaggagtgtgagaatcaaaactctcctacacttccattaacttagcatgtgttgaaaaaaaagtttcagagaagttctggctgaacactggcaacracaaagccaacagtcaaaacagagatgtgataaggatcagaacagcagaggttcttttaaaggggcagaaaaactctgggaaataagagagaacaactac

SEQ ID NO: 16176 - DNA, 201 bp, Homo sapiens
ctgtacatttgactgtgaagaaggatttgaactaatgggagcccagagccttcagtgtacctcatctgggaattgggacaacgagaagccaacgtgtaaarctgtgacatgcagggccgtccgccagcctcagaatggctctgtgaggtgcagccattcccctgctggagagttcaccttcaaatcatcctgcaacttcac

SEQ ID NO: 16177 - DNA, 201 bp, Homo sapiens
tgtatgtcctctggagaatggagtgctcctattccagcctgcaatgtggttgagtgtgatgctgtgacaaatccagccaatgggttcgtggaatgtttccmaaaccctggaagcttcccatggaacacaacctgtacatttgactgtgaagaaggatttgaactaatgggagcccagagccttcagtgtacctcatctggg

SEQ ID NO: 16178 - DNA, 201 bp, Homo sapiens
ccctcctgacattagcaccatttctcctctggcttcggaaatgcttacggaaagcaaagaaatttgttcctgccagcagctgccaaagccttgaatcagayggaagctaccaaaagccttcttacatcctttaagttcaaaagaatcagaaacaggtgcatctggggaactagagggatacactgaagttaacagagacag

SEQ ID NO: 16179 - DNA, 201 bp, Homo sapiens
tttttactacagttgttttttgaaaacatggtagaattggagagtaaaaactgaatggaaggtttgtatattgtcagatattttttcagaaatatgtggtktccacgatgaaaaacttccatgaggccaaacgttttgaactaataaaagcataaatgcaaacacacaaaggtataattttatgaatgtctttgttggaaa

SEQ ID NO: 16180 - DNA, 201 bp, Homo sapiens
tgacctgagacagaggcagcagtgatacccacctgagagatcctgtgtttgaacaactgcttcccaaaacggaaagtatttcaagcctaaacctttgggtkaaaagaactcttgaagtcatgattgcttcacagtttctctcagctctcactttggtgcttctcattaaagagagtggagcctggtcttacaacacctcca

SEQ ID NO: 16181 - DNA, 201 bp, Homo sapiens
cagctcggacatgtggagccacaggacactggtctggcctgctacctacctgtgaagctcccactgagtccaacattcccttggtagctggactttctgcygctggactctccctcctgacattagcaccatttctcctctggcttcggaaatgcttacggaaagcaaagaaatttgttcctgccagcagctgccaaagcc

SEQ ID NO: 16182 - DNA, 201 bp, Homo sapiens
gcaaggcatgatgttaaccagaataaagttctgagtgtttttactacagttgttttttgaaaacatggtagaattggagagtaaaaactgaatggaaggtytgtatattgtcagatattttttcagaaatatgtggtttccacgatgaaaaacttccatgaggccaaacgttttgaactaataaaagcataaatgcaaaca

SEQ ID NO: 16183 - DNA, 201 bp, Homo sapiens
ccagcccccgaagggtttggtgaggtgtgctcattcccctattggagaattcacctacaagtcctcttgtgccttcagctgtgaggagggatttgaattayatggatcaactcaacttgagtgcacatctcagggacaatggacagaagaggttccttcctgccaagtggtaaaatgttcaagcctggcagttccgggaaa

SEQ ID NO: 16184 - DNA, 201 bp, Homo sapiens
accctggaagcttcccatggaacacaacctgtacatttgactgtgaagaaggatttgaactaatgggagcccagagccttcagtgtacctcatctgggaaytgggacaacgagaagccaacgtgtaaagctgtgacatgcagggccgtccgccagcctcagaatggctctgtgaggtgcagccattcccctgctggagagt

SEQ ID NO: 16185 - DNA, 201 bp, Homo sapiens
aatgcaaacacacaaaggtataattttatgaatgtctttgttggaaaagaatacagaaagatggatgtgctttgcattcctacaaagatgtttgtcagatrtgatatgtaaacataattcttgtatattatggaagattttaaattcacaatagaaactcaccatgtaaaagagtcatctggtagatttttaacgaatgaa

SEQ ID NO: 16186 - DNA, 201 bp, Homo sapiens
tggcctgctacctacctgtgaagctcccactgagtccaacattcccttggtagctggactttctgctgctggactctccctcctgacattagcaccatttytcctctggcttcggaaatgcttacggaaagcaaagaaatttgttcctgccagcagctgccaaagccttgaatcagatggaagctaccaaaagccttctta

SEQ ID NO: 16187 - DNA, 201 bp, Homo sapiens
ttctcctctggcttcggaaatgcttacggaaagcaaagaaatttgttcctgccagcagctgccaaagccttgaatcagatggaagctaccaaaagccttcytacatcctttaagttcaaaagaatcagaaacaggtgcatctggggaactagagggatacactgaagttaacagagacagataactctcctcgggtctctg

SEQ ID NO: 16188 - DNA, 201 bp, Homo sapiens
catcaagagagaaaaagatgtgggcatgtggaatgatgagaggtgcagcaagaagaagcttgccctatgctacacagctgcctgtaccaatacatcctgcmgtggccacggtgaatgtgtagagaccatcaataattacacttgcaagtgtgaccctggcttcagtggactcaagtgtgagcaaattgtgaactgtacagc

SEQ ID NO: 16189 - DNA, 201 bp, Homo sapiens
gggctccaggtgaacccaacaataggcaaaaagatgaggactgcgtggagatctacatcaagagagaaaaagatgtgggcatgtggaatgatgagaggtgsagcaagaagaagcttgccctatgctacacagctgcctgtaccaatacatcctgcagtggccacggtgaatgtgtagagaccatcaataattacacttgca

SEQ ID NO: 16190 - DNA, 201 bp, Homo sapiens
taaactccatattgagctattcaccaagttattactggattggaatcagaaaagtcaacaatgtgtgggtctgggtaggaacccagaaacctctgacagargaagccaagaactgggctccaggtgaacccaacaataggcaaaaagatgaggactgcgtggagatctacatcaagagagaaaaagatgtgggcatgtgga

SEQ ID NO: 16191 - DNA, 201 bp, Homo sapiens
actctcaatgatacttttctatcaaaggaatttaatccactggttatagtgggcctcagtaaagatggtacagattacattgagatcattccaaaggaagmggtccagagcagtgaagatgactatgctgaaattgattatgtgccctatgatgacccctacaaaactgatgttaggacaaacatcaactcctccagagat

SEQ ID NO: 16192 - DNA, 201 bp, Homo sapiens
ggcccagagggaaagtggatcatatcttctctcaccccaaaacatttgcaagctgggatgcaggcttacattgacattaaaaactgcccaaagaaaaccasgaatcttaagaaaataactcgtgagcagaggcggcacatgaagaggtgggaatacttcattgctgcagaggaagtcatttgggactatgcacctgtaata

SEQ ID NO: 16193 - DNA, 201 bp, Homo sapiens
tcagagacacactcaaaatcgtgttcaaaaatatggccagccgcccctatagcatttaccctcatggagtgaccttctcgccttatgaagatgaagtcaaytcttctttcacctcaggcaggaacaacaccatgatcagagcagttcaaccaggggaaacctatacttataagtggaacatcttagagtttgatgaaccca

SEQ ID NO: 16194 - DNA, 201 bp, Homo sapiens
gacctgagcccacaaactcaagtttgaatctttctgtaacttcctttaagaaaattgtctacagagagtatgaaccatattttaagaaagaaaaaccacartctaccatttcaggacttcttgggcctactttatatgctgaagtcggagacatcataaaagttcactttaaaaataaggcagataagcccttgagcatcc

SEQ ID NO: 16195 - DNA, 201 bp, Homo sapiens
tggctgcagcattaggaatcaggtcattccgaaactcatcattgaatcaggaagaagaagagttcaatcttactgccctagctctggagaatggcactgarttcgtttcttcaaacacagatataattgttggttcaaattattcttccccaagtaatattagtaagttcactgtcaataaccttgcagaacctcagaaag

SEQ ID NO: 16196 - DNA, 201 bp, Homo sapiens
taagaaagaaaaaccacaatctaccatttcaggacttcttgggcctactttatatgctgaagtcggagacatcataaaagttcactttaaaaataaggcasataagcccttgagcatccatcctcaaggaattaggtacagtaaattatcagaaggtgcttcttaccttgaccacacattccctgcggagaagatggacga

SEQ ID NO: 16197 - DNA, 201 bp, Homo sapiens
acggaaaatgcatgatcgtttagaacctgaagatgaagagagtgatgctgactatgattaccagaacagactggctgcagcattaggaatcaggtcattcygaaactcatcattgaatcaggaagaagaagagttcaatcttactgccctagctctggagaatggcactgaattcgtttcttcaaacacagatataattgt

SEQ ID NO: 16198 - DNA, 201 bp, Homo sapiens
gttttatgaatcaaacatcatgagcactatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgaccctcttccccat

SEQ ID NO: 16199 - DNA, 201 bp, Homo sapiens
aaagtggatcatatcttctctcaccccaaaacatttgcaagctgggatgcaggcttacattgacattaaaaactgcccaaagaaaaccaggaatcttaagwaaataactcgtgagcagaggcggcacatgaagaggtgggaatacttcattgctgcagaggaagtcatttgggactatgcacctgtaataccagcgaatat

SEQ ID NO: 16200 - DNA, 201 bp, Homo sapiens
ctactcagctgtgaacccagaaaaagatattcactcaggcttgataggtcccctcctaatctgccaaaaaggaatactacataaggacagcaacatgcctrtggacatgagagaatttgtcttactatttatgacctttgatgaaaagaagagctggtactatgaaaagaagtcccgaagttcttggagactcacatcctc

SEQ ID NO: 16201 - DNA, 201 bp, Homo sapiens
acccctgggtatggaaaatggaaagatagaaaacaagcaaatcacagcttcttcgtttaagaaatcttggtggggagattactgggaacccttccgtgccygtctgaatgcccagggacgtgtgaatgcctggcaagccaaggcaaacaacaataagcagtggctagaaattgatctactcaagatcaagaagataacggc

SEQ ID NO: 16202 - DNA, 201 bp, Homo sapiens
gctgtgtttgatgaaagcaagagctggagccagtcatcatccctaatgtacacagtcaatggatatgtgaatgggacaatgccagatataacagtttgtgyccatgaccacatcagctggcatctgctgggaatgagctcggggccagaattattctccattcatttcaacggccaggtcctggagcagaaccatcataag

SEQ ID NO: 16203 - DNA, 201 bp, Homo sapiens
cttaacaagaccatactacagtgacgtggacatcatgagagacatcgcctctgggctaataggactacttctaatctgtaagagcagatccctggacaggygaggaatacagagggcagcagacatcgaacagcaggctgtgtttgctgtgtttgatgagaacaaaagctggtaccttgaggacaacatcaacaagttttg

SEQ ID NO: 16204 - DNA, 201 bp, Homo sapiens
gataatgctgttcagccaaatagcagttatacctacgtatggcatgccactgagcgatcagggccagaaagtcctggctctgcctgtcgggcttgggcctrctactcagctgtgaacccagaaaaagatattcactcaggcttgataggtcccctcctaatctgccaaaaaggaatactacataaggacagcaacatgcct

SEQ ID NO: 16205 - DNA, 201 bp, Homo sapiens
ctctctccagaactcagccatatgactctctctccagaactcagtcagacaaacctttccccagccctcggtcagatgcccatttctccagacctcagccrtacaaccctttctctagacttcagccagacaaacctctctccagaactcagtcaaacaaacctttccccagccctcggtcagatgcccctttctccagac

SEQ ID NO: 16206 - DNA, 201 bp, Homo sapiens
agtcccgaagttcttggagactcacatcctcagaaatgaaaaaatcccatgagtttcacgccattaatgggatgatctacagcttgcctggcctgaaaatrtatgagcaagagtgggtgaggttacacctgctgaacataggcggctcccaagacattcacgtggttcactttcacggccagaccttgctggaaaatggca

SEQ ID NO: 16207 - DNA, 201 bp, Homo sapiens
cccctgggtatggaaaatggaaagatagaaaacaagcaaatcacagcttcttcgtttaagaaatcttggtggggagattactgggaacccttccgtgcccrtctgaatgcccagggacgtgtgaatgcctggcaagccaaggcaaacaacaataagcagtggctagaaattgatctactcaagatcaagaagataacggca

SEQ ID NO: 16208 - DNA, 201 bp, Homo sapiens
ataatttctcaaaccaaattggaaaacattataagaaagttatgtacacacagtacgaagatgagtccttcaccaaacatacagtgaatcccaatatgaargaagatgggattttgggtcctattatcagagcccaggtcagagacacactcaaaatcgtgttcaaaaatatggccagccgcccctatagcatttaccctc

SEQ ID NO: 16209 - DNA, 201 bp, Homo sapiens
ttggataatttctcaaaccaaattggaaaacattataagaaagttatgtacacacagtacgaagatgagtccttcaccaaacatacagtgaatcccaataygaaagaagatgggattttgggtcctattatcagagcccaggtcagagacacactcaaaatcgtgttcaaaaatatggccagccgcccctatagcatttac

SEQ ID NO: 16210 - DNA, 201 bp, Homo sapiens
gtttagaacctgaagatgaagagagtgatgctgactatgattaccagaacagactggctgcagcattaggaatcaggtcattccgaaactcatcattgaaycaggaagaagaagagttcaatcttactgccctagctctggagaatggcactgaattcgtttcttcaaacacagatataattgttggttcaaattattctt

SEQ ID NO: 16211 - DNA, 201 bp, Homo sapiens
gtcctccaggtctttatcagacagtgcccccagaggaacactatcaaacattccccattcaagaccctgatcaaatgcactctacttcagaccccagtcasagatcctcttctccagagctcagtgaaatgcttgagtatgaccgaagtcacaagtccttccccacagatataagtcaaatgtccccttcctcagaacatg

SEQ ID NO: 16212 - DNA, 201 bp, Homo sapiens
tcatggctacacggaaaatgcatgatcgtttagaacctgaagatgaagagagtgatgctgactatgattaccagaacagactggctgcagcattaggaatyaggtcattccgaaactcatcattgaatcaggaagaagaagagttcaatcttactgccctagctctggagaatggcactgaattcgtttcttcaaacacag

SEQ ID NO: 16213 - DNA, 201 bp, Homo sapiens
gaagtgaagcctacaacacattttcagaaagaagacttaagcattcgttggtgcttcataaatccaatgaaacatctcttcccacagacctcaatcagacrttgccctctatggattttggctggatagcctcacttcctgaccataatcagaattcctcaaatgacactggtcaggcaagctgtcctccaggtctttatc

SEQ ID NO: 16214 - DNA, 201 bp, Homo sapiens
aaattattcttccccaagtaatattagtaagttcactgtcaataaccttgcagaacctcagaaagccccttctcaccaacaagccaccacagctggttccycactgagacacctcattggcaagaactcagttctcaattcttccacagcagagcattccagcccatattctgaagaccctatagaggatcctctacagcc

SEQ ID NO: 16215 - DNA, 201 bp, Homo sapiens
agtggcacttctgtagtgtggggacccagaatgaaattttgaccatccacttcactgggcactcattcatctatggaaagaggcatgaggacaccttgacmctcttccccatgcgtggagaatctgtgacggtcacaatggataatgttggaacttggatgttaacttccatgaattctagtccaagaagcaaaaagctga

SEQ ID NO: 16216 - DNA, 201 bp, Homo sapiens
aatggagtatcagtgaggacagtggacccacccatgatgaccctccatgcctcacacacatctattactcccatgaaaatctgatcgaggatttcaactckgggctgattgggcccctgcttatctgtaaaaaagggaccctaactgagggtgggacacagaagacgtttgacaagcaaatcgtgctactatttgctgtgt

SEQ ID NO: 16217 - DNA, 201 bp, Homo sapiens
cagcagacatcgaacagcaggctgtgtttgctgtgtttgatgagaacaaaagctggtaccttgaggacaacatcaacaagttttgtgaaaatcctgatgargtgaaacgtgatgaccccaagttttatgaatcaaacatcatgagcactatcaatggctatgtgcctgagagcataactactcttggattctgctttgatg

SEQ ID NO: 16218 - DNA, 201 bp, Homo sapiens
ttaaaaataaggcagataagcccttgagcatccatcctcaaggaattaggtacagtaaattatcagaaggtgcttcttaccttgaccacacattccctgcrgagaagatggacgacgctgtggctccaggccgagaatacacctatgaatggagtatcagtgaggacagtggacccacccatgatgaccctccatgcctca

SEQ ID NO: 16219 - DNA, 201 bp, Homo sapiens
gtgaggacagtggacccacccatgatgaccctccatgcctcacacacatctattactcccatgaaaatctgatcgaggatttcaactcggggctgattggscccctgcttatctgtaaaaaagggaccctaactgagggtgggacacagaagacgtttgacaagcaaatcgtgctactatttgctgtgtttgatgaaagca

SEQ ID NO: 16220 - DNA, 201 bp, Homo sapiens
caaagtaactcatctaagattttggttgggagatggcatttggcttctgagaaaggtagctatgaaataatccaagatactgatgaagacacagctgttarcaattggctgatcagcccccagaatgcctcacgtgcttggggagaaagcacccctcttgccaacaagcctggaaagcagagtggccacccaaagtttcct

SEQ ID NO: 16221 - DNA, 201 bp, Homo sapiens
aagaactttttcaaccccccaatcatttccaggtttatccgtgtcattcctaaaacatggaatcaaagtattgcacttcgcctggaactctttggctgtgrtatttactagaattgaacattcaaaaacccctggaagagactctttaagacctcaaaccatttagaatgggcaatgtattttacgctgtgttaaatgtta

SEQ ID NO: 16222 - DNA, 201 bp, Homo sapiens
cggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctga

SEQ ID NO: 16223 - DNA, 201 bp, Homo sapiens
tgggtatggaaaatggaaagatagaaaacaagcaaatcacagcttcttcgtttaagaaatcttggtggggagattactgggaacccttccgtgcccgtctraatgcccagggacgtgtgaatgcctggcaagccaaggcaaacaacaataagcagtggctagaaattgatctactcaagatcaagaagataacggcaatta

SEQ ID NO: 16224 - DNA, 201 bp, Homo sapiens
tcagccatacaaccctttctccagacctcagccatacaaccctttctttagacctcagccagacaaacctctctccagaactcagtcagacaaacctttcyccagccctcggtcagatgcccctttctccagacctcagccatacaaccctttctctagacttcagccagacaaacctctctccagaactcagccatatga

SEQ ID NO: 16225 - DNA, 201 bp, Homo sapiens
gggcccagagggaaagtggatcatatcttctctcaccccaaaacatttgcaagctgggatgcaggcttacattgacattaaaaactgcccaaagaaaaccrggaatcttaagaaaataactcgtgagcagaggcggcacatgaagaggtgggaatacttcattgctgcagaggaagtcatttgggactatgcacctgtaat

SEQ ID NO: 16226 - DNA, 201 bp, Homo sapiens
aaacacagatataattgttggttcaaattattcttccccaagtaatattagtaagttcactgtcaataaccttgcagaacctcagaaagccccttctcacyaacaagccaccacagctggttccccactgagacacctcattggcaagaactcagttctcaattcttccacagcagagcattccagcccatattctgaaga

SEQ ID NO: 16227 - DNA, 201 bp, Homo sapiens
tcaaacattccccattcaagaccctgatcaaatgcactctacttcagaccccagtcacagatcctcttctccagagctcagtgaaatgcttgagtatgacygaagtcacaagtccttccccacagatataagtcaaatgtccccttcctcagaacatgaagtctggcagacagtcatctctccagacctcagccaggtgac

SEQ ID NO: 16228 - DNA, 201 bp, Homo sapiens
gagacacctaagccaagacactggttctccttccggaatgaggccctgggaggaccttcctagccaagacactggttctccttccagaatgaggccctggraggaccctcctagtgatctgttactcttaaaacaaagtaactcatctaagattttggttgggagatggcatttggcttctgagaaaggtagctatgaaat

SEQ ID NO: 16229 - DNA, 201 bp, Homo sapiens
tctgaagaccctatagaggatcctctacagccagatgtcacagggatacgtctactttcacttggtgctggagaattcaaaagtcaagaacatgctaagcrtaagggacccaaggtagaaagagatcaagcagcaaagcacaggttctcctggatgaaattactagcacataaagttgggagacacctaagccaagacact

SEQ ID NO: 16230 - DNA, 201 bp, Homo sapiens
ttaacaagaccatactacagtgacgtggacatcatgagagacatcgcctctgggctaataggactacttctaatctgtaagagcagatccctggacaggcraggaatacagagggcagcagacatcgaacagcaggctgtgtttgctgtgtttgatgagaacaaaagctggtaccttgaggacaacatcaacaagttttgt

SEQ ID NO: 16231 - DNA, 201 bp, Homo sapiens
agacctcagccagacaaacctctctccagaactcagtcagacaaacctttctccagccctcggtcagatgcccctttctccagacctcagccatacaaccmtttctctagacttcagccagacaaacctctctccagaactcagccatatgactctctctccagaactcagtcagacaaacctttccccagccctcggtca

SEQ ID NO: 16232 - DNA, 201 bp, Homo sapiens
atcagggccagaaagtcctggctctgcctgtcgggcttgggcctactactcagctgtgaacccagaaaaagatattcactcaggcttgataggtcccctcstaatctgccaaaaaggaatactacataaggacagcaacatgcctatggacatgagagaatttgtcttactatttatgacctttgatgaaaagaagagctg

SEQ ID NO: 16233 - DNA, 201 bp, Homo sapiens
gcagagcattccagcccatattctgaagaccctatagaggatcctctacagccagatgtcacagggatacgtctactttcacttggtgctggagaattcaraagtcaagaacatgctaagcataagggacccaaggtagaaagagatcaagcagcaaagcacaggttctcctggatgaaattactagcacataaagttggg

SEQ ID NO: 16234 - DNA, 201 bp, Homo sapiens
gaagtcacaagtccttccccacagatataagtcaaatgtccccttcctcagaacatgaagtctggcagacagtcatctctccagacctcagccaggtgacyctctctccagaactcagccagacaaacctctctccagacctcagccacacgactctctctccagaactcattcagagaaacctttccccagccctcggtc

SEQ ID NO: 16235 - DNA, 201 bp, Homo sapiens
acctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggcgaggaatacagagggcagcagacatcgaacagcaggct

SEQ ID NO: 16236 - DNA, 201 bp, Homo sapiens
agtaagttcactgtcaataaccttgcagaacctcagaaagccccttctcaccaacaagccaccacagctggttccccactgagacacctcattggcaagamctcagttctcaattcttccacagcagagcattccagcccatattctgaagaccctatagaggatcctctacagccagatgtcacagggatacgtctactt

SEQ ID NO: 16237 - DNA, 201 bp, Homo sapiens
gtggatgatgttatccaagttcgttttaaaaatttagcatccagaccgtattctctacatgcccatggactttcctatgaaaaatcatcagagggaaagasttatgaagatgactctcctgaatggtttaaggaagataatgctgttcagccaaatagcagttatacctacgtatggcatgccactgagcgatcagggcca

SEQ ID NO: 16238 - DNA, 201 bp, Homo sapiens
taggaatcaggtcattccgaaactcatcattgaatcaggaagaagaagagttcaatcttactgccctagctctggagaatggcactgaattcgtttcttcraacacagatataattgttggttcaaattattcttccccaagtaatattagtaagttcactgtcaataaccttgcagaacctcagaaagccccttctcacc

SEQ ID NO: 16239 - DNA, 201 bp, Homo sapiens
tagacttcagccagacaaacctctctccagaactcagtcaaacaaacctttccccagccctcggtcagatgcccctttctccagaccccagccatacaacyctttctctagacctcagccagacaaacctctctccagaactcagtcagacaaacctttccccagacctcagtgagatgcccctctttgcagatctcagtc

SEQ ID NO: 16240 - DNA, 201 bp, Homo sapiens
tcggaattcttggtcctattatcagagctgaagtggatgatgttatccaagttcgttttaaaaatttagcatccagaccgtattctctacatgcccatggrctttcctatgaaaaatcatcagagggaaagacttatgaagatgactctcctgaatggtttaaggaagataatgctgttcagccaaatagcagttatacct

SEQ ID NO: 16241 - DNA, 201 bp, Homo sapiens
atctgtaagagcagatccctggacaggcgaggaatacagagggcagcagacatcgaacagcaggctgtgtttgctgtgtttgatgagaacaaaagctggtmccttgaggacaacatcaacaagttttgtgaaaatcctgatgaggtgaaacgtgatgaccccaagttttatgaatcaaacatcatgagcactatcaatggc

SEQ ID NO: 16242 - DNA, 201 bp, Homo sapiens
ggggtggctgttgaacctcttccacaaccagattgagtccaagttccagaaagtactggagagcaggatttgcgaaatgatccagaaatcagtgtcctccratctacagccttatctccaaactctgccagttacaacagagattgacagtttcgccgacattgattatagcttagtggaagcccctcgggcaacagccca

SEQ ID NO: 16243 - DNA, 201 bp, Homo sapiens
cgggagacttggggtggctgttgaacctcttccacaaccagattgagtccaagttccagaaagtactggagagcaggatttgcgaaatgatccagaaatcrgtgtcctccgatctacagccttatctccaaactctgccagttacaacagagattgacagtttcgccgacattgattatagcttagtggaagcccctcggg

SEQ ID NO: 16244 - DNA, 201 bp, Homo sapiens
aaactacagggctcctttgatgtcagtgtcaagggcatcagcatttcggtcaacctcctgttgggcagcgagtcctccgggaggcccacagttactgcctscagctgcagcagtgacatcgctgacgtggaggtggacatgtcgggagacttggggtggctgttgaacctcttccacaaccagattgagtccaagttccag

SEQ ID NO: 16245 - DNA, 201 bp, Homo sapiens
tacagccttatctccaaactctgccagttacaacagagattgacagtttcgccgacattgattatagcttagtggaagcccctcgggcaacagcccagatrctggaggtgatgtttaagggtgaaatctttcatcgtaaccaccgttctccagttaccctccttgctgcagtcatgagccttcctgaggaacacaacaaaa

SEQ ID NO: 16246 - DNA, 201 bp, Homo sapiens
ggatcaccgacaagggactgcagtatgcggcccaggaggggctattggctctgcagagtgagctgctcaggatcacgctgcctgacttcaccggggacttraggatcccccacgtcggccgtgggcgctatgagttccacagcctgaacatccacagctgtgagctgcttcactctgcgctgaggcctgtccctggccagg

SEQ ID NO: 16247 - DNA, 201 bp, Homo sapiens
ttccacagcctgaacatccacagctgtgagctgcttcactctgcgctgaggcctgtccctggccagggcctgagtctcagcatctccgactcctccatccrggtccagggcaggtggaaggtgcgcaagtcattcttcaaactacagggctcctttgatgtcagtgtcaagggcatcagcatttcggtcaacctcctgttg

SEQ ID NO: 16248 - DNA, 152 bp, Homo sapiens
ctggcccactgcactgggaatctaggatgggggccttggccagagccctgcygtccatactgctggcattgctgcttacgtccaccccagaggctctgggtgccaaccccggcttggtcgccaggatcaccgacaagggactgcagtatgcg

SEQ ID NO: 16249 - DNA, 201 bp, Homo sapiens
atccataaggacttcctgttcttgggtgccaatgtccaatacatgagagtttgaggacaagaaagatgaagcttggaggtcacagctggatctgcttgttscatttccagctgtgcagcacgtctcagagattcttgaagaatgaagacatttctgctctcagctccgggggtgaggtgtgcctggcctctgcctccaccc

SEQ ID NO: 16250 - DNA, 201 bp, Homo sapiens
tgctgcttacgtccaccccagaggctctgggtgccaaccccggcttggtcgccaggatcaccgacaagggactgcagtatgcggcccaggaggggctattrgctctgcagagtgagctgctcaggatcacgctgcctgacttcaccggggacttgaggatcccccacgtcggccgtgggcgctatgagttccacagcctga

SEQ ID NO: 16251 - DNA, 201 bp, Homo sapiens
tgcgctgaggcctgtccctggccagggcctgagtctcagcatctccgactcctccatccgggtccagggcaggtggaaggtgcgcaagtcattcttcaaamtacagggctcctttgatgtcagtgtcaagggcatcagcatttcggtcaacctcctgttgggcagcgagtcctccgggaggcccacagttactgcctccag

SEQ ID NO: 16252 - DNA, 201 bp, Homo sapiens
gtgcctggcctctgcctccaccctcctcctcttcaccaggtgcatgcatgccctctctgagtctggactttgcttcccctccaggagggaccaccctcccygactggcctgggatatctttacaagcaggcactgtatttttttattcgccatctgatccccatgcctagcagagtgctggcacttagtaggtcctcaata

SEQ ID NO: 16253 - DNA, 201 bp, Homo sapiens
aagaatccaaagttggactattcaatgcagagctgttggaagcgctcctcaactattacatccttaacaccttctaccccaagttcaatgataagttggcygaaggcttcccccttcctctgctgaagcgtgttcagctctacgaccttgggctgcagatccataaggacttcctgttcttgggtgccaatgtccaataca

SEQ ID NO: 16254 - DNA, 201 bp, Homo sapiens
aacttctccatcacagatgacatgataccgcctgactctaatatccgactgaccaccaagtccttccgacccttcgtcccacggttagccaggctctaccycaacatgaacctggaactccagggatcagtgccctctgctccgctcctgaacttcagccctgggaatctgtctgtggacccctatatggagatagatgcc

SEQ ID NO: 16255 - DNA, 201 bp, Homo sapiens
gggcaggtggaaggtgcgcaagtcattcttcaaactacagggctcctttgatgtcagtgtcaagggcatcagcatttcggtcaacctcctgttgggcagcragtcctccgggaggcccacagttactgcctccagctgcagcagtgacatcgctgacgtggaggtggacatgtcgggagacttggggtggctgttgaacct

SEQ ID NO: 16256 - DNA, 201 bp, Homo sapiens
agtcattcttcaaactacagggctcctttgatgtcagtgtcaagggcatcagcatttcggtcaacctcctgttgggcagcgagtcctccgggaggcccacrgttactgcctccagctgcagcagtgacatcgctgacgtggaggtggacatgtcgggagacttggggtggctgttgaacctcttccacaaccagattgagt

SEQ ID NO: 16257 - DNA, 201 bp, Homo sapiens
cttgggtgccaatgtccaatacatgagagtttgaggacaagaaagatgaagcttggaggtcacagctggatctgcttgttgcatttccagctgtgcagcaygtctcagagattcttgaagaatgaagacatttctgctctcagctccgggggtgaggtgtgcctggcctctgcctccaccctcctcctcttcaccaggtgc

SEQ ID NO: 16258 - DNA, 201 bp, Homo sapiens
gaaagaatccaaagttggactattcaatgcagagctgttggaagcgctcctcaactattacatccttaacaccttctaccccaagttcaatgataagttgrccgaaggcttcccccttcctctgctgaagcgtgttcagctctacgaccttgggctgcagatccataaggacttcctgttcttgggtgccaatgtccaata

SEQ ID NO: 16259 - DNA, 201 bp, Homo sapiens
catgaggaaggatatctgaacttctccatcacagatgacatgataccgcctgactctaatatccgactgaccaccaagtccttccgacccttcgtcccacrgttagccaggctctaccccaacatgaacctggaactccagggatcagtgccctctgctccgctcctgaacttcagccctgggaatctgtctgtggacccc

SEQ ID NO: 16260 - DNA, 201 bp, Homo sapiens
gttccacagcctgaacatccacagctgtgagctgcttcactctgcgctgaggcctgtccctggccagggcctgagtctcagcatctccgactcctccatcygggtccagggcaggtggaaggtgcgcaagtcattcttcaaactacagggctcctttgatgtcagtgtcaagggcatcagcatttcggtcaacctcctgtt

SEQ ID NO: 16261 - DNA, 201 bp, Homo sapiens
accctccttgctgcagtcatgagccttcctgaggaacacaacaaaatggtctactttgccatctcggattatgtcttcaacacggccagcctggtttatcrtgaggaaggatatctgaacttctccatcacagatgacatgataccgcctgactctaatatccgactgaccaccaagtccttccgacccttcgtcccacgg

SEQ ID NO: 16262 - DNA, 201 bp, Homo sapiens
ctctaccccaacatgaacctggaactccagggatcagtgccctctgctccgctcctgaacttcagccctgggaatctgtctgtggacccctatatggagayagatgcctttgtgctcctgcccagctccagcaaggagcctgtcttccggctcagtgtggccactaatgtgtccgccaccttgaccttcaataccagcaag

SEQ ID NO: 16263 - DNA, 201 bp, Homo sapiens
gaaatctttcatcgtaaccaccgttctccagttaccctccttgctgcagtcatgagccttcctgaggaacacaacaaaatggtctactttgccatctcggrttatgtcttcaacacggccagcctggtttatcatgaggaaggatatctgaacttctccatcacagatgacatgataccgcctgactctaatatccgactg

SEQ ID NO: 16264 - DNA, 201 bp, Homo sapiens
gaagccaggaaaggtaaaagtggaactgaaagaatccaaagttggactattcaatgcagagctgttggaagcgctcctcaactattacatccttaacaccytctaccccaagttcaatgataagttggccgaaggcttcccccttcctctgctgaagcgtgttcagctctacgaccttgggctgcagatccataaggactt

SEQ ID NO: 16265 - DNA, 201 bp, Homo sapiens
ggttagccaggctctaccccaacatgaacctggaactccagggatcagtgccctctgctccgctcctgaacttcagccctgggaatctgtctgtggacccstatatggagatagatgcctttgtgctcctgcccagctccagcaaggagcctgtcttccggctcagtgtggccactaatgtgtccgccaccttgaccttca

SEQ ID NO: 16266 - DNA, 201 bp, Homo sapiens
gggacttgaggatcccccacgtcggccgtgggcgctatgagttccacagcctgaacatccacagctgtgagctgcttcactctgcgctgaggcctgtcccyggccagggcctgagtctcagcatctccgactcctccatccgggtccagggcaggtggaaggtgcgcaagtcattcttcaaactacagggctcctttgatg

SEQ ID NO: 16267 - DNA, 201 bp, Homo sapiens
tgtcaagggcatcagcatttcggtcaacctcctgttgggcagcgagtcctccgggaggcccacagttactgcctccagctgcagcagtgacatcgctgacrtggaggtggacatgtcgggagacttggggtggctgttgaacctcttccacaaccagattgagtccaagttccagaaagtactggagagcaggatttgcga

SEQ ID NO: 16268 - DNA, 201 bp, Homo sapiens
gcagcgagtcctccgggaggcccacagttactgcctccagctgcagcagtgacatcgctgacgtggaggtggacatgtcgggagacttggggtggctgttkaacctcttccacaaccagattgagtccaagttccagaaagtactggagagcaggatttgcgaaatgatccagaaatcagtgtcctccgatctacagcctt

SEQ ID NO: 16269 - DNA, 201 bp, Homo sapiens
aaggggctgagcgatccagggaagatcaagcggctgcgttcccaggtgcaggtgagcttggaggactacatcaacgaccgccagtatgactcgcgtggccrctttggagagctgctgctgctgctgcccaccttgcagagcatcacctggcagatgatcgagcagatccagttcatcaagctcttcggcatggccaagatt

SEQ ID NO: 16270 - DNA, 198 bp, Homo sapiens
tttgaaaggaaggcagagagggcactgggaggaggcagtgggagggcggagggcgggggccttcggggtgggcgcccagggtagggcaggtggccgcsgcgtggaggcagggagaatgcgactctccaaaaccctcgtcgacatggacatggccgactacagtgctgcactggacccagcctacaccaccctggaatt

SEQ ID NO: 16271 - DNA, 201 bp, Homo sapiens
acggcgacattcgggcgaagaagattgccagcatcgcagatgtgtgtgagtccatgaaggagcagctgctggttctcgttgagtgggccaagtacatcccrgctttctgcgagctccccctggacgaccaggtggccctgctcagagcccatgctggcgagcacctgctgctcggagccaccaagagatccatggtgttca

SEQ ID NO: 16272 - DNA, 201 bp, Homo sapiens
cctgttgcaggagatgctgctgggagggtcccccagcgatgcaccccatgcccaccaccccctgcaccctcacctgatgcaggaacatatgggaaccaacrtcatcgttgccaacacaatgcccactcacctcagcaacggacagatgtgtgagtggccccgacccaggggacaggcagccacccctgagaccccacagcc

SEQ ID NO: 16273 - DNA, 201 bp, Homo sapiens
ttgccaacacaatgcccactcacctcagcaacggacagatgtgtgagtggccccgacccaggggacaggcagccacccctgagaccccacagccctcacckccaggtggctcagggtctgagccctataagctcctgccgggagccgtcgccacaatcgtcaagcccctctctgccatcccccagccgaccatcaccaagc

SEQ ID NO: 16274 - DNA, 201 bp, Homo sapiens
cggagccaccaagagatccatggtgttcaaggacgtgctgctcctaggcaatgactacattgtccctcggcactgcccggagctggcggagatgagccggrtgtccatacgcatccttgacgagctggtgctgcccttccaggagctgcagatcgatgacaatgagtatgcctacctcaaagccatcatcttctttgaccc

SEQ ID NO: 16275 - DNA, 201 bp, Homo sapiens
cctcagcaacggacagatgtgtgagtggccccgacccaggggacaggcagccacccctgagaccccacagccctcaccgccaggtggctcagggtctgagycctataagctcctgccgggagccgtcgccacaatcgtcaagcccctctctgccatcccccagccgaccatcaccaagcaggaagttatctagcaagccgc

SEQ ID NO: 16276 - DNA, 201 bp, Homo sapiens
gtccagaatgagcgggaccggatcagcactcgaaggtcaagctatgaggacagcagcctgccctccatcaatgcgctcctgcaggcggaggtcctgtcccracagatcacctcccccgtctccgggatcaacggcgacattcgggcgaagaagattgccagcatcgcagatgtgtgtgagtccatgaaggagcagctgctg

SEQ ID NO: 16277 - DNA, 201 bp, Homo sapiens
acctgttgcaggagatgctgctgggagggtcccccagcgatgcaccccatgcccaccaccccctgcaccctcacctgatgcaggaacatatgggaaccaaygtcatcgttgccaacacaatgcccactcacctcagcaacggacagatgtgtgagtggccccgacccaggggacaggcagccacccctgagaccccacagc

SEQ ID NO: 16278 - DNA, 201 bp, Homo sapiens
gctcctaggcaatgactacattgtccctcggcactgcccggagctggcggagatgagccgggtgtccatacgcatccttgacgagctggtgctgcccttcyaggagctgcagatcgatgacaatgagtatgcctacctcaaagccatcatcttctttgacccagatgccaaggggctgagcgatccagggaagatcaagcg

SEQ ID NO: 16279 - DNA, 201 bp, Homo sapiens
cgtccagaatgagcgggaccggatcagcactcgaaggtcaagctatgaggacagcagcctgccctccatcaatgcgctcctgcaggcggaggtcctgtccygacagatcacctcccccgtctccgggatcaacggcgacattcgggcgaagaagattgccagcatcgcagatgtgtgtgagtccatgaaggagcagctgct

SEQ ID NO: 16280 - DNA, 201 bp, Homo sapiens
aaagacaagaggaaccagtgccgctactgcaggctcaagaaatgcttccgggctggcatgaagaaggaagccgtccagaatgagcgggaccggatcagcaytcgaaggtcaagctatgaggacagcagcctgccctccatcaatgcgctcctgcaggcggaggtcctgtcccgacagatcacctcccccgtctccgggatc

SEQ ID NO: 16281 - DNA, 201 bp, Homo sapiens
gttctccacagggagacacgtccccatcagaaggcaccaacctcaacgcgcccaacagcctgggtgtcagcgccctgtgtgccatctgcggggaccgggcyacgggcaaacactacggtgcctcgagctgtgacggctgcaagggcttcttccggaggagcgtgcggaagaaccacatgtactcctgcagatttagccggc

SEQ ID NO: 16282 - DNA, 201 bp, Homo sapiens
cgacttcatcccaaaggacagccgcctggagatgacttgaggccttacttaaacccagctcccttcttccctagcctggtgcttctcctctcctagcccckgtcatggtgtccagacagagccctgtgaggctgggtccaattgtggcacttggggcaccttgctcctccttctgctgctgcccccacctctgctgcctcc

SEQ ID NO: 16283 - DNA, 201 bp, Homo sapiens
ccctgagaccccacagccctcaccgccaggtggctcagggtctgagccctataagctcctgccgggagccgtcgccacaatcgtcaagcccctctctgccrtcccccagccgaccatcaccaagcaggaagttatctagcaagccgctggggcttgggggctccactggctccccccagccccctaagagagcacctggtg

SEQ ID NO: 16284 - DNA, 121 bp, Homo sapiens
gccttggaaacgattcccccagtcattctgggaacatgttgtaagcactgactgggaccaggcaccaggcagggtctagaaggctgtggtgagggaagacrcctttctcctccaacccaac

SEQ ID NO: 16285 - DNA, 201 bp, Homo sapiens; identical to SEQ ID NO: 16277

SEQ ID NO: 16286 - DNA, 201 bp, Homo sapiens; identical to SEQ ID NO: 16278

SEQ ID NO: 16287 - DNA, 201 bp, Homo sapiens; identical to SEQ ID NO: 16279

SEQ ID NO: 16288 - DNA, 201 bp, Homo sapiens; identical to SEQ ID NO: 16269

SEQ ID NO: 16289 - DNA, 201 bp, Homo sapiens; identical to SEQ ID NO: 16280

SEQ ID NO: 16290 - DNA, 201 bp, Homo sapiens
tggagagttcttacgacacgtccccatcagaaggcaccaacctcaacgcgcccaacagcctgggtgtcagcgccctgtgtgccatctgcggggaccgggcyacgggcaaacactacggtgcctcgagctgtgacggctgcaagggcttcttccggaggagcgtgcggaagaaccacatgtactcctgcagatttagccggc

SEQ ID NO: 16291 - DNA, 201 bp, Homo sapiens; identical to SEQ ID NO: 16282

SEQ ID NO: 16292 - DNA, 201 bp, Homo sapiens; identical to SEQ ID NO: 16271

SEQ ID NO: 16293 - DNA, 201 bp, Homo sapiens; identical to SEQ ID NO: 16272

SEQ ID NO: 16294 - DNA, 201 bp, Homo sapiens; identical to SEQ ID NO: 16273

SEQ ID NO: 16295 - DNA, 201 bp, Homo sapiens; identical to SEQ ID NO: 16274

SEQ ID NO: 16296 - DNA, 201 bp, Homo sapiens; identical to SEQ ID NO: 16275

SEQ ID NO: 16297 - DNA, 201 bp, Homo sapiens; identical to SEQ ID NO: 16283

SEQ ID NO: 16298 - DNA, 121 bp, Homo sapiens; identical to SEQ ID NO: 16284

SEQ ID NO: 16299 - DNA, 201 bp, Homo sapiens; identical to SEQ ID NO: 16276

SEQ ID NO: 16300 - DNA, 201 bp, Homo sapiens
catggtggatgccgtggggaacaaggatgtaaagcccttgataccacgtgcattgcaaagacacaatcaacatttatgtcatcaattgctgaggacagagrgccagggaatgacagaatcagggcctgatctcctgactctagtcaggaagaatcttctttgctttgacccccatcaaacaggaatatgtgatgcactgga

SEQ ID NO: 16301 - DNA, 201 bp, Homo sapiens; identical to SEQ ID NO: 16269

SEQ ID NO: 16302 - DNA, 198 bp, Homo sapiens; identical to SEQ ID NO: 16270

SEQ ID NO: 16303 - DNA, 201 bp, Homo sapiens; identical to SEQ ID NO: 16271

SEQ ID NO: 16304 - DNA, 201 bp, Homo sapiens; identical to SEQ ID NO: 16274

SEQ ID NO: 16305 - DNA, 201 bp, Homo sapiens; identical to SEQ ID NO: 16276

SEQ ID NO: 16306 - DNA, 201 bp, Homo sapiens; identical to SEQ ID NO: 16279

SEQ ID NO: 16307 - DNA, 201 bp, Homo sapiens; identical to SEQ ID NO: 16278

SEQ ID NO: 16308 - DNA, 201 bp, Homo sapiens; identical to SEQ ID NO: 16280

SEQ ID NO: 16309 - DNA, 201 bp, Homo sapiens
tgacgatgggcaatgacacgtccccatcagaaggcaccaacctcaacgcgcccaacagcctgggtgtcagcgccctgtgtgccatctgcggggaccgggcyacgggcaaacactacggtgcctcgagctgtgacggctgcaagggcttcttccggaggagcgtgcggaagaaccacatgtactcctgcagatttagccggc

SEQ ID NO: 16310 - DNA, 201 bp, Homo sapiens; identical to SEQ ID NO: 16269

SEQ ID NO: 16311 - DNA, 198 bp, Homo sapiens; identical to SEQ ID NO: 16270

SEQ ID NO: 16312 - DNA, 201 bp, Homo sapiens; identical to SEQ ID NO: 16271

SEQ ID NO: 16313 - DNA, 201 bp, Homo sapiens; identical to SEQ ID NO: 16272

SEQ ID NO: 16314 - DNA, 201 bp, Homo sapiens; identical to SEQ ID NO: 16273

SEQ ID NO: 16315 - DNA, 201 bp, Homo sapiens; identical to SEQ ID NO: 16274

SEQ ID NO: 16316 - DNA, 201 bp, Homo sapiens; identical to SEQ ID NO: 16275

SEQ ID NO: 16317 - DNA, 201 bp, Homo sapiens; identical to SEQ ID NO: 16276

SEQ ID NO: 16318 - DNA, 201 bp, Homo sapiens; identical to SEQ ID NO: 16277

SEQ ID NO: 16319 - DNA, 201 bp, Homo sapiens; identical to SEQ ID NO: 16278

SEQ ID NO: 16320 - DNA, 201 bp, Homo sapiens; identical to SEQ ID NO: 16279

SEQ ID NO: 16321 - DNA, 201 bp, Homo sapiens; identical to SEQ ID NO: 16280

SEQ ID NO: 16322 - DNA, 201 bp, Homo sapiens; identical to SEQ ID NO: 16309

SEQ ID NO: 16323 - DNA, 201 bp, Homo sapiens; identical to SEQ ID NO: 16282

SEQ ID NO: 16324 - DNA, 201 bp, Homo sapiens; identical to SEQ ID NO: 16283

SEQ ID NO: 16325 - DNA, 121 bp, Homo sapiens; identical to SEQ ID NO: 16284

SEQ ID NO: 16326 - DNA, 201 bp, Homo sapiens
actctgaacacgctggttatctaaatgagaagcagagaaataaagtcaagaaaatttacctggatgaaaagaggcttttggctggggaccatcccattgaycttctcttaagggactttaagaaaaactaccacatgtatgtgtatcctgtgcactggcagtttagtgaacttgaccaacaccctatggatagagtcttga

SEQ ID NO: 16327 - DNA, 201 bp, Homo sapiens
ggctttttttcctatgtctcttgggaactgcagctgcaatcccgacaaatgcaagattattatctgatcattccaaaccaactgctgaaacggtagcaccygacaacactgcaatccccagtttaagggctgaagctgaagaaaatgaaaaagaaacagcagtatccacagaagacgattcccaccataaggctgaaaaat

SEQ ID NO: 16328 - DNA, 201 bp, Homo sapiens
atcccgacaaatgcaagattattatctgatcattccaaaccaactgctgaaacggtagcacctgacaacactgcaatccccagtttaagggctgaagctgragaaaatgaaaaagaaacagcagtatccacagaagacgattcccaccataaggctgaaaaatcatcagtactaaagtcaaaagaggaaagccatgaacag

SEQ ID NO: 16329 - DNA, 201 bp, Homo sapiens
gcaaagagaaaaagtacatgaaaatgaaaatataggtaccactgagcctggagagcaccaagaggccaagaaagcagagaactcatcaaatgaggaggaarcgtcaagtgaaggcaacatgagggtgcatgctgtggattcttgcatgagcttccagtgtaaaagaggccacatctgtaaggcagaccaacagggaaaacc

SEQ ID NO: 16330 - DNA, 201 bp, Homo sapiens
agaaagacagaattgcccagggagcatgctaacagcaagcaggaggaagacaatacccaatctgatgatattttggaagagtctgatcaaccaactcaagwaagcaagatgcaggaggatgaatttgatcagggtaaccaagaacaagaagataactccaatgcagaaatggaagaggaaaatgcatcgaacgtcaataag

SEQ ID NO: 16331 - DNA, 201 bp, Homo sapiens
ccccaacaaggataagcacatcaccctgaaggagtggggccactgctttggaattaaagaagaggacatagatgaaaatctcttgttttgaacgaagattwtaaagaactcaactttccagcatcctcctctgttctaaccacttcagaaatatatgcagctgtgatacttgtagatttatatttagcaaaatgttagcat

SEQ ID NO: 16332 - DNA, 201 bp, Homo sapiens
gcaatcccgacaaatgcaagattattatctgatcattccaaaccaactgctgaaacggtagcacctgacaacactgcaatccccagtttaagggctgaagmtgaagaaaatgaaaaagaaacagcagtatccacagaagacgattcccaccataaggctgaaaaatcatcagtactaaagtcaaaagaggaaagccatgaa

SEQ ID NO: 16333 - DNA, 201 bp, Homo sapiens
agtactaaagtcaaaagaggaaagccatgaacagtcagcagaacagggcaagagttctagccaagagctgggattgaaggatcaagaggacagtgatggtsacttaagtgtgaatttggagtatgcaccaactgaaggtacattggacataaaagaagatatgagtgagcctcaggagaaaaaactctcagagaacactga

SEQ ID NO: 16334 - DNA, 201 bp, Homo sapiens; identical to SEQ ID NO: 16326

SEQ ID NO: 16335 - DNA, 201 bp, Homo sapiens; identical to SEQ ID NO: 16327

SEQ ID NO: 16336 - DNA, 201 bp, Homo sapiens; identical to SEQ ID NO: 16328

SEQ ID NO: 16337 - DNA, 201 bp, Homo sapiens; identical to SEQ ID NO: 16329

SEQ ID NO: 16338 - DNA, 201 bp, Homo sapiens; identical to SEQ ID NO: 16330

SEQ ID NO: 16339 - DNA, 201 bp, Homo sapiens; identical to SEQ ID NO: 16331

SEQ ID NO: 16340 - DNA, 201 bp, Homo sapiens; identical to SEQ ID NO: 16332

SEQ ID NO: 16341 - DNA, 201 bp, Homo sapiens; identical to SEQ ID NO: 16333

SEQ ID NO: 16342 - DNA, 201 bp, Homo sapiens
ctgaaatactctctggtgccaacctccaaattctcgtctgtcacttcagacccccactagttgacagagcagcagaatttcaactccagtagacttgaatrtgcctctgggcaaagaagcagagctaacgaggaaagggatttaaagagtttttcttgggtgtttgtcaaacttttattccctgtctgtgtgcagagggga

SEQ ID NO: 16343 - DNA, 201 bp, Homo sapiens
ctgcaacaaaaacgatgacagtctgaaatactctctggtgccaacctccaaattctcgtctgtcacttcagacccccactagttgacagagcagcagaatwtcaactccagtagacttgaatatgcctctgggcaaagaagcagagctaacgaggaaagggatttaaagagtttttcttgggtgtttgtcaaacttttatt

SEQ ID NO: 16344 - DNA, 201 bp, Homo sapiens
cctctaagaatctcacaggacctcttagtctctgccctatacgccgccttcactccacagcctcacccctcccacccccatactggtactgctgtaatgasccaagtggcagctaaaagttgggggtgttctgcccagtcccgtcattctgggctagaaggcaggggaccttggcatgtggctggccacaccaagcaggaa

SEQ ID NO: 16345 - DNA, 106 bp, Homo sapiens
tggccacaccaagcaggaagcacaaactcccccaagctgactcatcctaactaacagtcacgccgtgggatgtctctgtccacattaaactaacagcattratgca

SEQ ID NO: 16346 - DNA, 201 bp, Homo sapiens
acttccccaccgaggccatgggcccaggagttctgctgctcctgctggtggccacagcttggcatggtcagggaatcccagtgatagagcccagtgtcccygagctggtcgtgaagccaggagcaacggtgaccttgcgatgtgtgggcaatggcagcgtggaatgggatggccccccatcacctcactggaccctgtact

SEQ ID NO: 16347 - DNA, 201 bp, Homo sapiens
ccaggcctgcaaggttttaactggacctacctgggacccttttctgaccaccagcctgagcccaagcttgctaatgctaccaccaaggacacatacaggcrcaccttcaccctctctctgccccgcctgaagccctctgaggctggccgctactccttcctggccagaaacccaggaggctggagagctctgacgtttgag

SEQ ID NO: 16348 - DNA, 143 bp, Homo sapiens
attctgggctagaaggcaggggaccttggcatgtggctggccacaccaagcaggaagcacaaactcccccaagctgactcatcctaactaacagtcacgcmgtgggatgtctctgtccacattaaactaacagcattaatgca

SEQ ID NO: 16349 - DNA, 201 bp, Homo sapiens
ccagcagcatcctcagcaccaacaacgctaccttccaaaacacggggacctatcgctgcactgagcctggagaccccctgggaggcagcgccgccatccayctctatgtcaaagaccctgcccggccctggaacgtgctagcacaggaggtggtcgtgttcgaggaccaggacgcactactgccctgtctgctcacagacc

SEQ ID NO: 16350 - DNA, 201 bp, Homo sapiens
cctgctgcgagcaaggggatatcgcccagcccttgctgcagcccaacaactatcagttctgctgaggagttgacgacagggagtaccactctcccctcctmcaaacttcaactcctccatggatggggcgacacggggagaacatacaaactctgccttcggtcatttcactcaacagctcggcccagctctgaaacttgg

SEQ ID NO: 16351 - DNA, 201 bp, Homo sapiens
gctggtgcggattcgaggggaggctgcccagatcgtgtgctcagccagcagcgttgatgttaactttgatgtcttcctccaacacaacaacaccaagctckcaatccctcaacaatctgactttcataataaccgttaccaaaaagtcctgaccctcaacctcgatcaagtagatttccaacatgccggcaactactcctg

SEQ ID NO: 16352 - DNA, 201 bp, Homo sapiens
cttatcttcatggaaatggactgactttatgcctatgaagtccccaggagctacactgatactgagaaaaccaggctctttggggctagacagactggcasagagtgagatctccctctctgagaggagcagcagatgctcacagaccacactcagctcaggccccttggagcaggatggctcctctaagaatctcacagg

SEQ ID NO: 16353 - DNA, 201 bp, Homo sapiens
ttcactccacagcctcacccctcccacccccatactggtactgctgtaatgagccaagtggcagctaaaagttgggggtgttctgcccagtcccgtcattytgggctagaaggcaggggaccttggcatgtggctggccacaccaagcaggaagcacaaactcccccaagctgactcatcctaactaacagtcacgccgtg

SEQ ID NO: 16354 - DNA, 201 bp, Homo sapiens
ggcagcagcagcagtgagctggaggaggagagctctagtgagcacctgacctgctgcgagcaaggggatatcgcccagcccttgctgcagcccaacaactrtcagttctgctgaggagttgacgacagggagtaccactctcccctcctccaaacttcaactcctccatggatggggcgacacggggagaacatacaaact

SEQ ID NO: 16355 - DNA, 201 bp, Homo sapiens
aatccctcaacaatctgactttcataataaccgttaccaaaaagtcctgaccctcaacctcgatcaagtagatttccaacatgccggcaactactcctgcrtggccagcaacgtgcagggcaagcactccacctccatgttcttccgggtggtagagagtgcctacttgaacttgagctctgagcagaacctcatccagga

SEQ ID NO: 16356 - DNA, 201 bp, Homo sapiens
tcaactttctgcgaaggaaggctgaggccatgctgggacccagcctgagccccggccaggaccccgagggaggcgtcgactataagaacatccacctcgaraagaaatatgtccgcagggacagtggcttctccagccagggtgtggacacctatgtggagatgaggcctgtctccacttcttcaaatgactccttctctg

SEQ ID NO: 16357 - DNA, 201 bp, Homo sapiens
ggccctggaacgtgctagcacaggaggtggtcgtgttcgaggaccaggacgcactactgccctgtctgctcacagacccggtgctggaagcaggcgtctcrctggtgcgtgtgcgtggccggcccctcatgcgccacaccaactactccttctcgccctggcatggcttcaccatccacagggccaagttcattcagagcc

SEQ ID NO: 16358 - DNA, 201 bp, Homo sapiens
ctgcagagctggtgcggattcgaggggaggctgcccagatcgtgtgctcagccagcagcgttgatgttaactttgatgtcttcctccaacacaacaacacyaagctcgcaatccctcaacaatctgactttcataataaccgttaccaaaaagtcctgaccctcaacctcgatcaagtagatttccaacatgccggcaact

SEQ ID NO: 16359 - DNA, 201 bp, Homo sapiens
agatctccctctctgagaggagcagcagatgctcacagaccacactcagctcaggccccttggagcaggatggctcctctaagaatctcacaggacctctyagtctctgccctatacgccgccttcactccacagcctcacccctcccacccccatactggtactgctgtaatgagccaagtggcagctaaaagttggggg

SEQ ID NO: 16360 - DNA, 201 bp, Homo sapiens
acctgctgcgagcaaggggatatcgcccagcccttgctgcagcccaacaactatcagttctgctgaggagttgacgacagggagtaccactctcccctccyccaaacttcaactcctccatggatggggcgacacggggagaacatacaaactctgccttcggtcatttcactcaacagctcggcccagctctgaaacttg

SEQ ID NO: 16361 - DNA, 201 bp, Homo sapiens; identical to SEQ ID NO: 16344

SEQ ID NO: 16362 - DNA, 106 bp, Homo sapiens; identical to SEQ ID NO: 16345

SEQ ID NO: 16363 - DNA, 201 bp, Homo sapiens; identical to SEQ ID NO: 16346

SEQ ID NO: 16364 - DNA, 201 bp, Homo sapiens; identical to SEQ ID NO: 16347

SEQ ID NO: 16365 - DNA, 143 bp, Homo sapiens; identical to SEQ ID NO: 16348

SEQ ID NO: 16366 - DNA, 201 bp, Homo sapiens; identical to SEQ ID NO: 16349

SEQ ID NO: 16367 - DNA, 201 bp, Homo sapiens; identical to SEQ ID NO: 16350

SEQ ID NO: 16368 - DNA, 201 bp, Homo sapiens; identical to SEQ ID NO: 16351

SEQ ID NO: 16369 - DNA, 201 bp, Homo sapiens; identical to SEQ ID NO: 16352

SEQ ID NO: 16370 - DNA, 201 bp, Homo sapiens; identical to SEQ ID NO: 16353

SEQ ID NO: 16371 - DNA, 201 bp, Homo sapiens; identical to SEQ ID NO: 16354

SEQ ID NO: 16372 - DNA, 201 bp, Homo sapiens; identical to SEQ ID NO: 16355

SEQ ID NO: 16373 - DNA, 201 bp, Homo sapiens; identical to SEQ ID NO: 16356

SEQ ID NO: 16374 - DNA, 201 bp, Homo sapiens; identical to SEQ ID NO: 16357

SEQ ID NO: 16375 - DNA, 201 bp, Homo sapiens; identical to SEQ ID NO: 16358

SEQ ID NO: 16376 - DNA, 201 bp, Homo sapiens; identical to SEQ ID NO: 16359

SEQ ID NO: 16377 - DNA, 201 bp, Homo sapiens; identical to SEQ ID NO: 16360

SEQ ID NO: 16378 - DNA, 201 bp, Homo sapiens
tgtgagctcgtcacttcatgtgaaggagggaaggaaagaaagacgttccagggaatttgcaggtactcatgtggcacaaagaaccagaggctgactgcatyaatgctgttagtttaatgtggacagagacatcccacggcgtgactgttagttaggatgagtcagcttgggggagtttgtgcttcctgcttggtgtggcca

SEQ ID NO: 16379 - DNA, 201 bp, Homo sapiens
gaaagacgttccagggaatttgcaggtactcatgtggcacaaagaaccagaggctgactgcattaatgctgttagtttaatgtggacagagacatcccackgcgtgactgttagttaggatgagtcagcttgggggagtttgtgcttcctgcttggtgtggccagccacatgccaagaacagtaggggaggcggggggtga

SEQ ID NO: 16380 - DNA, 201 bp, Homo sapiens
acctcttctggccccgagagagcacttgggggacacggtatgtttaatggaggggaggctgagggaaaggctggtagctggtgggttccgtggggcctgckgtgtgggtcagggtggaggtcctgggtgggctaaggcgtgagccccagcactaggtgggaaggctgctgaggtctctcccacccctgaggagccctggtt

SEQ ID NO: 16381 - DNA, 201 bp, Homo sapiens
tccaggggtcaggagtggtaccaggaaacctcttctggccccgagagagcacttgggggacacggtatgtttaatggaggggaggctgagggaaaggctgrtagctggtgggttccgtggggcctgctgtgtgggtcagggtggaggtcctgggtgggctaaggcgtgagccccagcactaggtgggaaggctgctgaggt

SEQ ID NO: 16382 - DNA, 201 bp, Homo sapiens
cagtcactaagacgccagtcgtcaaaagtggtgtgcagcctgaggtcactctggggacaactgacaatgacagtcctggagcagacgtaccaacaccatcygaggggacaagtacctccagtccactccctgctcctaaaaaacctacaggagctgacctgcttacccctgggtccagagctccagagcttaaaggcagag

SEQ ID NO: 16383 - DNA, 201 bp, Homo sapiens
atggacttcctcaccagccgcgaaattgtcaatcgtcagatccatgacattgtacagagctgccagcctggtgaggtggtcattcgtgacaccctctaccrccttggggttgctcagatcaagacagagacagaggaggagggtgaggaagaggaggtggccgcagtggcagaataagccaggctgttgtacagggactac

SEQ ID NO: 16384 - DNA, 201 bp, Homo sapiens
ctccaggggtcaggagtggtaccaggaaacctcttctggccccgagagagcacttgggggacacggtatgtttaatggaggggaggctgagggaaaggctsgtagctggtgggttccgtggggcctgctgtgtgggtcagggtggaggtcctgggtgggctaaggcgtgagccccagcactaggtgggaaggctgctgagg

SEQ ID NO: 16385 - DNA, 201 bp, Homo sapiens
ggtggccgcagtggcagaataagccaggctgttgtacagggactacaccatctctcaagccatagtaaggcccttgcctgaggcagagctatccaggggamctgcagaagtggtctcctgtggggagggcctctgactgctgggactgaccaaagagcttccattccctgagcatggtgggacccagggtcctcagttctc

SEQ ID NO: 16386 - DNA, 201 bp, Homo sapiens
gtggcagaataagccaggctgttgtacagggactacaccatctctcaagccatagtaaggcccttgcctgaggcagagctatccaggggacctgcagaagkggtctcctgtggggagggcctctgactgctgggactgaccaaagagcttccattccctgagcatggtgggacccagggtcctcagttctcaaccctccag

SEQ ID NO: 16387 - DNA, 201 bp, Homo sapiens
gggacaactgacaatgacagtcctggagcagacgtaccaacaccatccgaggggacaagtacctccagtccactccctgctcctaaaaaacctacaggagytgacctgcttacccctgggtccagagctccagagcttaaaggcagagcacggggcaagccctcattactggctgcagcaagacccatgagagcaattttg

SEQ ID NO: 16388 - DNA, 201 bp, Homo sapiens
ggaaaaactcccttctatgaaggggaagcagactgggccataaggaaacagcaggactggctcaagtgcccaaggtttgtttagggcctgggaattggccrtgtgttaatttattgagtggagtaggtggctttttttccctccctcttcccccaacaagaataaagtttattaaattatctggttttggtgtagcaggag

SEQ ID NO: 16389 - DNA, 201 bp, Homo sapiens
gcccagagctcttggaccagcattatactgtggacatgacagaaactgagcactctatccagcacccagtcaccaagactgccacgcggcgcatcgtccaygcaggcctacagcccaatcctggtgaccccagtgctgggcaccactccttggccctgtgccctgaattggcaccttacgcaaccatcctggcctccatcg

SEQ ID NO: 16390 - DNA, 201 bp, Homo sapiens
aaaaacctacaggagctgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtgataagactccct

SEQ ID NO: 16391 - DNA, 201 bp, Homo sapiens
ttgtcaatcgtcagatccatgacattgtacagagctgccagcctggtgaggtggtcattcgtgacaccctctaccgccttggggttgctcagatcaagacrgagacagaggaggagggtgaggaagaggaggtggccgcagtggcagaataagccaggctgttgtacagggactacaccatctctcaagccatagtaaggc

SEQ ID NO: 16392 - DNA, 201 bp, Homo sapiens
acgctcctccggccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggtctgcttaccttctgtactattacgacatctacctgaaagtgcagcagg

SEQ ID NO: 16393 - DNA, 201 bp, Homo sapiens
agtgaggagacagtcaccatcgagcaaacctcttggtcgaattattatgagtctccgtccacgcagtgccttctctgtagcagcccattattcaaaggggracaaaactccctggctgggccccaggagtgctggctgctgacagccagccgtctgcagacagtgactgcccaggtgaagatgtgtctgaacccccattgt

SEQ ID NO: 16394 - DNA, 201 bp, Homo sapiens
ctcccacgctcagattatatcatcatccccaagagcagcctgcaggaggaccggagctgccctcagctagagctatgtgtggctcagaaccagatgtcccygaaaggacctcctcttgtgtccaacactgccccggagacagtgcccagccatgcaggcatggcagagcagtgcctggctgtggaggccctggctgaggag

SEQ ID NO: 16395 - DNA, 201 bp, Homo sapiens
gaattgtggtacagcagtcactaagacgccagtcgtcaaaagtggtgtgcagcctgaggtcactctggggacaactgacaatgacagtcctggagcagacktaccaacaccatccgaggggacaagtacctccagtccactccctgctcctaaaaaacctacaggagctgacctgcttacccctgggtccagagctccaga

SEQ ID NO: 16396 - DNA, 201 bp, Homo sapiens
gcttgacccccggggccctcggcaggcatcggtgaggagcctgcggagcgaacctgtgctcctattcttgcccttcaggaccccatatcgcgactccgagraggggaagcgagaggggctgtcgcgactccgcgccgtgtgtcgccgggcggggccgcggggccggggctccttcagcccccgggatgcgcgcgcgagccc

SEQ ID NO: 16397 - DNA, 201 bp, Homo sapiens
ttaccagacaagcctggtaattgaagagaccttggtgaatggctcaccagacctccccactggaagcctggctgtgccccacccccaggttggggagagtrtatcagtggtaacagtcatgagggattccagtgagagtagctcctctgcaccagccacacagttcatcatgttgcctctgcctgcctactcggttgtgga

SEQ ID NO: 16398 - DNA, 201 bp, Homo sapiens
ctctggagaattcggaagctgtaagccagctcctgaacgtagctcctcccagagaagtaggtgaggagagtgagtgggaggaagtgatcatctccgatgcycatgttttggttaaggaagctcccgggaattgtggtacagcagtcactaagacgccagtcgtcaaaagtggtgtgcagcctgaggtcactctggggacaa

SEQ ID NO: 16399 - DNA, 201 bp, Homo sapiens
gctattgggcctttgagtgcctcactgtccgagactacaatgacatgatctgtggcatctgtggtgtggcccccaaagtggaaatggctcagaggagtgargagaatgtgctagcactgaagagcgtggagttcacctggcctgaattcctgggctctaatgaggtaaatgtggaggacttttgggccacgatggagacag

SEQ ID NO: 16400 - DNA, 201 bp, Homo sapiens
cagcagcatgggactgcccagggccaggcaggccttttccctgagtgataagactccctctgtgaggacttgtggtctgaagccaagcacactgaagcagytgggccagcccattcaacagccatctggccctggtgaggtgaagctaccaagtggcccatccaacaggacttctcaggtgaaagttgtggaggtcaagcc

SEQ ID NO: 16401 - DNA, 201 bp, Homo sapiens
atgcaggcctacagcccaatcctggtgaccccagtgctgggcaccactccttggccctgtgccctgaattggcaccttacgcaaccatcctggcctccatmgtggacagcaaaccaaacggtgtccgccagcggcccattgccttcgacaatgccactcactattacctctacaaccgcctcatggacttcctcaccagcc

SEQ ID NO: 16402 - DNA, 201 bp, Homo sapiens
ggagtagaagccaaaaggatctttaaaaaggattgagcattattcttggcgcacagtccaaaatacaaattggacagaagatctatattgtaccagaactrtttatttcaccccatcaagtataaggttactgattgattggtccttttataaacattggtatatttccattcatgccaaagcaaaagaagtaaaagctaa

SEQ ID NO: 16403 - DNA, 201 bp, Homo sapiens
ctgtccgagaaattataggtgatgaactagtccagacttatgtgtatgaaggagtagaagccaaaaggatctttaaaaaggattgagcattattcttggcrcacagtccaaaatacaaattggacagaagatctatattgtaccagaactatttatttcaccccatcaagtataaggttactgattgattggtccttttat

SEQ ID NO: 16404 - DNA, 201 bp, Homo sapiens
tatatacatatgacatatatattaaaatgtaggaagaaaaatgtttgagtacctgatgaaaatgaatagagagtatgtaatctttgaaagctgaatactgygtgttctcacttataagtgggagctaaataatgtatacacatggacacaccagagtgtagaataatagacactggagacttggaagagttggagggttgg

SEQ ID NO: 16405 - DNA, 201 bp, Homo sapiens
gtacaatttttaagcatttgcagctgcaactctatagacttttgacaaattctttttcacactgatgtagataacagcttaacatttacatagttcttackacttgccacacactgttctaagtggtatatacatatgacatatatattaaaatgtaggaagaaaaatgtttgagtacctgatgaaaatgaatagagagta

SEQ ID NO: 16406 - DNA, 201 bp, Homo sapiens
agggaaataaacttattggaaaattcaaacggacagacaatggaaacgaactgaatactgtccgagaaattataggtgatgaactagtccagacttatgtrtatgaaggagtagaagccaaaaggatctttaaaaaggattgagcattattcttggcgcacagtccaaaatacaaattggacagaagatctatattgtacc

SEQ ID NO: 16407 - DNA, 201 bp, Homo sapiens
ttctaagtggtatatacatatgacatatatattaaaatgtaggaagaaaaatgtttgagtacctgatgaaaatgaatagagagtatgtaatctttgaaagstgaatactgcgtgttctcacttataagtgggagctaaataatgtatacacatggacacaccagagtgtagaataatagacactggagacttggaagagtt

SEQ ID NO: 16408 - DNA, 201 bp, Homo sapiens
tgacaattacacaagaaggaaataaattcacagtcaaagaatcaagcgcttttcgaaacattgaagttgtttttgaacttggtgtcacctttaattacaayctagcagacggaactgaactcagggggacctggagccttgagggaaataaacttattggaaaattcaaacggacagacaatggaaacgaactgaatactg

SEQ ID NO: 16409 - DNA, 201 bp, Homo sapiens
aatgggtgttaatatagtgaaaaggaagcttgcagctcatgacaatttgaagctgacaattacacaagaaggaaataaattcacagtcaaagaatcaagcrcttttcgaaacattgaagttgtttttgaacttggtgtcacctttaattacaatctagcagacggaactgaactcagggggacctggagccttgagggaaa

SEQ ID NO: 16410 - DNA, 201 bp, Homo sapiens
actcaggccaatttacacctatcgaccgcccttcaaccgccacatagtcacattgtcaaatagcgtattcaccttctcttataagaaggctcagcgagatytggcgtataagccactctacagctgggaggaagccaagcagaaaacggtggagtgggttggttcccttgtggaccggcacaaggagaacctgaagtccaa

SEQ ID NO: 16411 - DNA, 201 bp, Homo sapiens
gtcatcaaaacctgcgcagtcattggcccaacaagaaggtttctgtcctaatcatataccagaggaaagaccatgtggtttgctgttaccaaatctcagtrgctgattctgaacaatttagggactcttttaacttgagggtcgttttgactactagagctccatttctactcttaaatgagaaaggatttcctttctttt

SEQ ID NO: 16412 - DNA, 201 bp, Homo sapiens
gttctactatatctcagatgacacgcctcaccaaagctatgataaccttaattacaccctgagcaaagagttcggcctccgccttgattccagatggagcyttcctttatccctgatgtattggattggcttcctgctggaaatagtgagcttcctactcaggccaatttacacctatcgaccgcccttcaaccgccacat

SEQ ID NO: 16413 - DNA, 201 bp, Homo sapiens
ttgattccagatggagctttcctttatccctgatgtattggattggcttcctgctggaaatagtgagcttcctactcaggccaatttacacctatcgaccrcccttcaaccgccacatagtcacattgtcaaatagcgtattcaccttctcttataagaaggctcagcgagatttggcgtataagccactctacagctggg

SEQ ID NO: 16414 - DNA, 120 bp, Homo sapiens
acagaactccagaacaagaycaagctgacagtgctggaaggagacattctggatgagccattcctgaagagagcctgccaggacgtctcggtcatcatccacaccgcctgtatcattgat

SEQ ID NO: 16415 - DNA, 187 bp, Homo sapiens
acagaactccagaacaagaccaagctgacagtgctggaaggagacattctggatgagccattcctgaagagagcctgccaggacgtytcggtcatcatccacaccgcctgtatcattgatgtcttcggtgtcactcacagagagtctatcatgaatgtcaatgtgaaagtcttcatctacaccagta

SEQ ID NO: 16416 - DNA, 201 bp, Homo sapiens
tggagtgggttggttcccttgtggaccggcacaaggagaacctgaagtccaagactcagtgatttaaggatgacagagatgtgcatgtgggtattgttagkagatgtcatcaagctccaccctcctggcctcatacagaaagtgacaagggcacaagctcaggtcctgctgcctccctttcatacaatggccaacttattg

SEQ ID NO: 16417 - DNA, 194 bp, Homo sapiens
acagaactccagaacaagaccaagctgacagtgctggaaggagacattctggatgagccattcctgaagagagcctgccaggacgtctcggtcrtcatccacaccgcctgtatcattgatgtcttcggtgtcactcacagagagtctatcatgaatgtcaatgtgaaagtcttcatctacaccagtagcataga

SEQ ID NO: 16418 - DNA, 201 bp, Homo sapiens
ggatcctgtcaagtgttggaaagttctccactgttaacccagtctatgttggcaatgtggcctgggcccacattctggccttgagggccctgcaggacccyaagaaggccccaagcatccgaggacagttctactatatctcagatgacacgcctcaccaaagctatgataaccttaattacaccctgagcaaagagttcg

SEQ ID NO: 16419 - DNA, 201 bp, Homo sapiens
cagtgctggaaggagacattctggatgagccattcctgaagagagcctgccaggacgtctcggtcatcatccacaccgcctgtatcattgatgtcttcggwgtcactcacagagagtctatcatgaatgtcaatgtgaaagtcttcatctacaccagtagcatagaggtagccgggcccaactcctacaaggaaatcatcc

SEQ ID NO: 16420 - DNA, 125 bp, Homo sapiens
acagaactccagaacaagaccaagytgacagtgctggaaggagacattctggatgagccattcctgaagagagcctgccaggacgtctcggtcatcatccacaccgcctgtatcattgatgtctt

SEQ ID NO: 16421 - DNA, 201 bp, Homo sapiens
gctcagcgagatttggcgtataagccactctacagctgggaggaagccaagcagaaaacggtggagtgggttggttcccttgtggaccggcacaaggagamcctgaagtccaagactcagtgatttaaggatgacagagatgtgcatgtgggtattgttaggagatgtcatcaagctccaccctcctggcctcatacagaa

SEQ ID NO: 16422 - DNA, 176 bp, Homo sapiens
actcttctgtccagcttttaacaatctaactaatgctctttttagccctctccagggtcaccctagaatcagatcygctccccagcatcttctgtttcctggtgagtgattcctgctactttggatggccatgacgggctggagctgccttgtgacaggagcaggagggtttctgg

SEQ ID NO: 16423 - DNA, 201 bp, Homo sapiens; identical to SEQ ID NO: 16410

SEQ ID NO: 16424 - DNA, 201 bp, Homo sapiens; identical to SEQ ID NO: 16411

SEQ ID NO: 16425 - DNA, 201 bp, Homo sapiens; identical to SEQ ID NO: 16412

SEQ ID NO: 16426 - DNA, 201 bp, Homo sapiens; identical to SEQ ID NO: 16413

SEQ ID NO: 16427 - DNA, 201 bp, Homo sapiens
cgcctcttggtgaaggagaaggagctgaaggagatcagggtcttggacaaggccttcggaccagaattgagagaggaattttctaaactccagaacaagaycaagctgacagtgctggaaggagacattctggatgagccattcctgaagagagcctgccaggacgtctcggtcatcatccacaccgcctgtatcattgat

SEQ ID NO: 16428 - DNA, 201 bp, Homo sapiens
tgagagaggaattttctaaactccagaacaagaccaagctgacagtgctggaaggagacattctggatgagccattcctgaagagagcctgccaggacgtytcggtcatcatccacaccgcctgtatcattgatgtcttcggtgtcactcacagagagtctatcatgaatgtcaatgtgaaaggtacccagctcctgttag

SEQ ID NO: 16429 - DNA, 201 bp, Homo sapiens; identical to SEQ ID NO: 16416

SEQ ID NO: 16430 - DNA, 201 bp, Homo sapiens
ggaattttctaaactccagaacaagaccaagctgacagtgctggaaggagacattctggatgagccattcctgaagagagcctgccaggacgtctcggtcrtcatccacaccgcctgtatcattgatgtcttcggtgtcactcacagagagtctatcatgaatgtcaatgtgaaaggtacccagctcctgttagaggcctg

SEQ ID NO: 16431 - DNA, 201 bp, Homo sapiens
cttggtgaaggagaaggagctgaaggagatcagggtcttggacaaggccttcggaccagaattgagagaggaattttctaaactccagaacaagaccaagytgacagtgctggaaggagacattctggatgagccattcctgaagagagcctgccaggacgtctcggtcatcatccacaccgcctgtatcattgatgtctt

SEQ ID NO: 16432 - DNA, 201 bp, Homo sapiens; identical to SEQ ID NO: 16418

SEQ ID NO: 16433 - DNA, 201 bp, Homo sapiens
cagtgctggaaggagacattctggatgagccattcctgaagagagcctgccaggacgtctcggtcatcatccacaccgcctgtatcattgatgtcttcggwgtcactcacagagagtctatcatgaatgtcaatgtgaaaggtacccagctcctgttagaggcctgtgtccaagctagtgtgccagtcttcatctacacca

SEQ ID NO: 16434 - DNA, 201 bp, Homo sapiens; identical to SEQ ID NO: 16421

SEQ ID NO: 16435 - DNA, 201 bp, Homo sapiens
ttgattccagatggagctttcctttatccctgatgtattggattggcttcctgctggaaatagtgagcttcctactcaggccaatttacacctatcgaccrcccttcaaccgccacatagtcacattgtcaaatagcgtattcaccttctcttataagaaggctcagcgagatctggcgtataagccactctacagctggg

SEQ ID NO: 16436 - DNA, 201 bp, Homo sapiens
tctaaactccagaacaagaccaagctgacagtgctggaaggagacattctggatgagccattcctgaagagagcctgccaggacgtctcggtcatcatccrcaccgcctgtatcattgatgtcttcggtgtcactcacagagagtctatcatgaatgtcaatgtgaaaggtacccagctcctgttagaggcctgtgtccaa

SEQ ID NO: 16437 - DNA, 201 bp, Homo sapiens; identical to SEQ ID NO: 16433

SEQ ID NO: 16438 - DNA, 201 bp, Homo sapiens
tggagtgggttggttcccttgtggaccggcacaaggagaccctgaagtccaagactcagtgatttaaggatgacagagatgtgcatgtgggtattgttagkagatgtcatcaagctccaccctcctggcctcatacagaaagtgacaagggcacaagctcaggtcctgctgcctccctttcatacaatggccaacttattg

SEQ ID NO: 16439 - DNA, 201 bp, Homo sapiens
actcaggccaatttacacctatcgaccgcccttcaaccgccacatagtcacattgtcaaatagcgtattcaccttctcttataagaaggctcagcgagatytggcgtataagccactctacagctgggaggaagccaagcagaaaacggtggagtgggttggttcccttgtggaccggcacaaggagaccctgaagtccaa

SEQ ID NO: 16440 - DNA, 201 bp, Homo sapiens; identical to SEQ ID NO: 16412

SEQ ID NO: 16441 - DNA, 201 bp, Homo sapiens
tctaaactccagaacaagaccaagctgacagtgctggaaggagacattctggatgagccattcctgaagagagcctgccaggacgtctcggtcatcatccycaccgcctgtatcattgatgtcttcggtgtcactcacagagagtctatcatgaatgtcaatgtgaaaggtacccagctcctgttagaggcctgtgtccaa

SEQ ID NO: 16442 - DNA, 201 bp, Homo sapiens
gctcagcgagatctggcgtataagccactctacagctgggaggaagccaagcagaaaacggtggagtgggttggttcccttgtggaccggcacaaggagamcctgaagtccaagactcagtgatttaaggatgacagagatgtgcatgtgggtattgttaggagatgtcatcaagctccaccctcctggcctcatacagaa

SEQ ID NO: 16443 - DNA, 201 bp, Homo sapiens; identical to SEQ ID NO: 16418

SEQ ID NO: 16444 - DNA, 201 bp, Homo sapiens; identical to SEQ ID NO: 16411

SEQ ID NO: 16445 - DNA, 201 bp, Homo sapiens
ttccagccaaagaactgactaccaaaaatcaaatttcgaaacaactagaggaaagaattggtgtgcttatgtacataccaggttatctcccacagtgataytggacaaccaggtcacttatgtcccaggtgggaaaggaccttgtggctggaccggtggatcctgtcctcagagatctcagaagatatccaatcctgtcta

SEQ ID NO: 16446 - DNA, 201 bp, Homo sapiens
gcattcttggactatacctgaggatgggaactctcagaagactatgccttctgcttcagttcctccaaataaaatacaaagtttgcaaatactgccaaccrctcgggtcatgtcggcggagatagctacaactccagaggcaagaacttctgaagacagtcttcttaaatcaacactgcctccctcagaaacaagtgcacc

SEQ ID NO: 16447 - DNA, 201 bp, Homo sapiens
acgctagcatcaagttcaatcctggagcagaatcagtggtcctttccaattctacactgaaatttcttcagagctttgccagaaagtcaaatgaacaagcracttctctaaacacagttggaggcactggaggcattggaggcgttggaggcactggaggcgtgggaaatcgagccccacgggaaacatacctcagccggg

SEQ ID NO: 16448 - DNA, 201 bp, Homo sapiens
attcaagctgtagtcggcatccgtgccaaaatgggggcacgtgcataaatggaagaactagctttacctgtgcctgcagacatccttttactggtgacaamtgcactatcaagcttgtggaagaaaatgctttagctccagatttttccaaaggatcttacagatatgcacccatggtggcattttttgcatctcatacgt

SEQ ID NO: 16449 - DNA, 201 bp, Homo sapiens
ttctagtttatggagtgggggcattgggcttaacaacagtaagcattcttggactatacctgaggatgggaactctcagaagactatgccttctgcttcarttcctccaaataaaatacaaagtttgcaaatactgccaaccactcgggtcatgtcggcggagatagctacaactccagaggcaagaacttctgaagacag

SEQ ID NO: 16450 - DNA, 201 bp, Homo sapiens
aatttagtggcacagaaaacaaagtgaatttgttagcataattattcctattcttatttcttcattttaagtcattgcaatggaaagtaatattataaaayggtaattacaacatattatcagtcacagttttctttccaattaaacacttaacttttgttattccctgtatataaatatataacacacattttctagatt

SEQ ID NO: 16451 - DNA, 201 bp, Homo sapiens
ttaactaccaagatttccaaaaattttgagactcggttgcaagacattgagtctaaagttacccagacgctcataccttattatatttcagttaaaaaagrcagtgtagttacaaatgagagagatcaggctcttcaactgcaagtattaaattccagatttaaggcgttggaagcaaaatctatccatctttcaattaac

SEQ ID NO: 16452 - DNA, 201 bp, Homo sapiens
gaatgactatacctggtcctatcctgtttaataacttggatgtcaattatggagcttcatataccccaagaactggaaaatttagaattccgtatcttggrgtatatgttttcaagtacaccatcgagtcatttagtgctcatatttctggatttttagtggttgatggaatagacaagcttgcatttgagtctgaaaata

SEQ ID NO: 16453 - DNA, 201 bp, Homo sapiens
tgtcctcagagatctcagaagatatccaatcctgtctataggatgcaacataaaattgtcacctcattggattggaggtgctgtcctggatacagtgggcygaaatgtcaactaagagcccaggaacagcaaagtttgatacacaccaaccaggctgaaagtcatacagctgttggcagaggagtagctgagcagcagcag

SEQ ID NO: 16454 - DNA, 201 bp, Homo sapiens
aatttcttcagagctttgccagaaagtcaaatgaacaagcaacttctctaaacacagttggaggcactggaggcattggaggcgttggaggcactggaggygtgggaaatcgagccccacgggaaacatacctcagccggggtgacagcagttccagccaaagaactgactaccaaaaatcaaatttcgaaacaactagag

SEQ ID NO: 16455 - DNA, 201 bp, Homo sapiens
agttccagccaaagaactgactaccaaaaatcaaatttcgaaacaactagaggaaagaattggtgtgcttatgtacataccaggttatctcccacagtgayattggacaaccaggtcacttatgtcccaggtgggaaaggaccttgtggctggaccggtggatcctgtcctcagagatctcagaagatatccaatcctgtc

SEQ ID NO: 16456 - DNA, 201 bp, Homo sapiens
tgaacaaccaaaggaagcaatagtgataaggaaaaagatagaaaatctgactagtgctgtcaatagtctaaattttattatcaaagaacttacaaaaagayacaacttacttagaaatgaagtacagggtcgtgatgatgccttagaaagacgtatcaatgaatatgccttagaaatggaagatggcctcaataagacaat

SEQ ID NO: 16457 - DNA, 201 bp, Homo sapiens
tattttgacatttattcctcagttccaccgtctgaatgattctattcagactttggtcaatgacaatcagagatataactttgttttgcaagtcgccaagrcccttgcaggtattcccagagatgagaaactaaatcagtccaacttccaaaagatgtatcaaatgttcaatgaaaccacttcccaagtgagaaaatacca

SEQ ID NO: 16458 - DNA, 201 bp, Homo sapiens
tccctgccagatattcaacttcttcagaaaggtctaacagaatttgtggaaccaataattcaaataaaaactcaagctgccctatctaatttaacttgttrtatagatcgatcgttgcctggtagtctggcaaatgttgtcaagtctcagaagcaagtaaaatcattgccaaagaaaattaacgcacttaagaaaccaacg

SEQ ID NO: 16459 - DNA, 201 bp, Homo sapiens
tggaagaaaaactactcttaactaccaagatttccaaaaattttgagactcggttgcaagacattgagtctaaagttacccagacgctcataccttattayatttcagttaaaaaaggcagtgtagttacaaatgagagagatcaggctcttcaactgcaagtattaaattccagatttaaggcgttggaagcaaaatcta

SEQ ID NO: 16460 - DNA, 201 bp, Homo sapiens
ataaaacattccctgccagatattcaacttcttcagaaaggtctaacagaatttgtggaaccaataattcaaataaaaactcaagctgccctatctaattyaacttgttgtatagatcgatcgttgcctggtagtctggcaaatgttgtcaagtctcagaagcaagtaaaatcattgccaaagaaaattaacgcacttaag

SEQ ID NO: 16461 - DNA, 201 bp, Homo sapiens
ggagcaagagcaagaggctcttcctcgtaacgcgagcccagtcccccttcaaagtttatcattaccagttcaagatccagttcatcaaccaaactgagacrccaatacaaacaacttttaccatgtcactactcggaacaaaagagaaaatgcagaaaattcccatcactctgggcaaaggaattgctagtaataaaacgt

SEQ ID NO: 16462 - DNA, 201 bp, Homo sapiens
ttcctagagctctacagacatattgcccagcacggcttcaatgccatcacccagaccataaaatgctcccacgagcgatcggtgcaccttttcatcgactycttgctgcacgccggcacgcagagcatggcctacccgtgtggtgacatgaacagcttcagccagggcctgtgcctgagctgcaagaagggccgctgcaac

SEQ ID NO: 16463 - DNA, 201 bp, Homo sapiens
gatgtggatatcggcgagctgatcatgatcaagttcaagtgggaaaacagtgcagtgtgggccaatgtctgggacacggtccagaccatcatcccatggarcacagggccgcgccactcaggcctcgttctgaagacgatcagagtcaaagcaggagaaacccagcaaagaatgacattttgttcagaaaacacagatgac

SEQ ID NO: 16464 - DNA, 201 bp, Homo sapiens
tttaccatgtcactactcggaacaaaagagaaaatgcagaaaattcccatcactctgggcaaaggaattgctagtaataaaacgtattcctttcttatcaygctggatgtggatatcggcgagctgatcatgatcaagttcaagtgggaaaacagtgcagtgtgggccaatgtctgggacacggtccagaccatcatccca

SEQ ID NO: 16465 - DNA, 201 bp, Homo sapiens
ctgtcagattcgaatcaatcatccggacacgttacaggagtgcggcttcaactcctccctgcctctggtgatgataatccacgggtggtcggtggacggcrtgctagaaaactggatctggcagatggtggccgcgctgaagtctcagccggcccagccagtgaacgtggggctggtggactggatcaccctggcccacga

SEQ ID NO: 16466 - DNA, 201 bp, Homo sapiens
taattgggtacagcctgggtgcacacgtgtcaggatttgccggcagttccatcggtggaacgcacaagattgggagaatcacagggctggatgccgcgggrcctttgtttgagggaagtgcccccagcaatcgtctttctccagatgatgccagttttgtggatgccattcatacctttacccgggagcacatgggcctga

SEQ ID NO: 16467 - DNA, 141 bp, Homo sapiens
gaaataaagtctaaaacatcaaagcgaaagatcagatgagatttaatgaagacccagtgtaaagaataaatgaatcttactccttatctggaatggctgcyttatttagaagccaaaattacataaagaatctcacacaaa

SEQ ID NO: 16468 - DNA, 201 bp, Homo sapiens
ggtggaacgcacaagattgggagaatcacagggctggatgccgcgggacctttgtttgagggaagtgcccccagcaatcgtctttctccagatgatgccarttttgtggatgccattcatacctttacccgggagcacatgggcctgagcgtgggcatcaaacagcccataggacactatgacttctatcccaacgggggc

SEQ ID NO: 16469 - DNA, 201 bp, Homo sapiens
ggatcaccctggcccacgaccactacaccatcgccgtccgcaacacccgccttgtgggcaaggaggtcgcggctcttctccggtggctggaggaatctgtkcaactctctcgaagccatgttcacctaattgggtacagcctgggtgcacacgtgtcaggatttgccggcagttccatcggtggaacgcacaagattggga

SEQ ID NO: 16470 - DNA, 201 bp, Homo sapiens
atcttatattgcagagccatttggaagaagagctcaagctgttgaaacaaacaaaacgctgcatgagatgaagaccagattcctgctctttggagaaaccmatcagggctgtcagattcgaatcaatcatccggacacgttacaggagtgcggcttcaactcctccctgcctctggtgatgataatccacgggtggtcggt

SEQ ID NO: 16471 - DNA, 201 bp, Homo sapiens
caggcctcgttctgaagacgatcagagtcaaagcaggagaaacccagcaaagaatgacattttgttcagaaaacacagatgacctactacttcgcccaacmcaggaaaaaatcttcgtgaaatgtgaaataaagtctaaaacatcaaagcgaaagatcagatgagatttaatgaagacccagtgtaaagaataaatgaatc

SEQ ID NO: 16472 - DNA, 201 bp, Homo sapiens
aaatgctcccacgagcgatcggtgcaccttttcatcgactccttgctgcacgccggcacgcagagcatggcctacccgtgtggtgacatgaacagcttcakccagggcctgtgcctgagctgcaagaagggccgctgcaacacgctgggctaccacgtccgccaggagccgcggagcaagagcaagaggctcttcctcgta

SEQ ID NO: 16473 - DNA, 201 bp, Homo sapiens
cagggctggatgccgcgggacctttgtttgagggaagtgcccccagcaatcgtctttctccagatgatgccagttttgtggatgccattcatacctttacscgggagcacatgggcctgagcgtgggcatcaaacagcccataggacactatgacttctatcccaacgggggctccttccagcctggctgccacttcctag

SEQ ID NO: 16474 - DNA, 201 bp, Homo sapiens
cgctgggctaccacgtccgccaggagccgcggagcaagagcaagaggctcttcctcgtaacgcgagcccagtcccccttcaaagtttatcattaccagttmaagatccagttcatcaaccaaactgagacgccaatacaaacaacttttaccatgtcactactcggaacaaaagagaaaatgcagaaaattcccatcactc

SEQ ID NO: 16475 - DNA, 201 bp, Homo sapiens; identical to SEQ ID NO: 16461

SEQ ID NO: 16476 - DNA, 201 bp, Homo sapiens; identical to SEQ ID NO: 16462

SEQ ID NO: 16477 - DNA, 201 bp, Homo sapiens; identical to SEQ ID NO: 16463

SEQ ID NO: 16478 - DNA, 201 bp, Homo sapiens; identical to SEQ ID NO: 16464

SEQ ID NO: 16479 - DNA, 201 bp, Homo sapiens; identical to SEQ ID NO: 16465

SEQ ID NO: 16480 - DNA, 201 bp, Homo sapiens; identical to SEQ ID NO: 16466

SEQ ID NO: 16481 - DNA, 141 bp, Homo sapiens; identical to SEQ ID NO: 16467

SEQ ID NO: 16482 - DNA, 201 bp, Homo sapiens; identical to SEQ ID NO: 16468

SEQ ID NO: 16483 - DNA, 201 bp, Homo sapiens; identical to SEQ ID NO: 16469

SEQ ID NO: 16484 - DNA, 201 bp, Homo sapiens
aagcctgaaaccagagccatttggaagaagagctcaagctgttgaaacaaacaaaacgctgcatgagatgaagaccagattcctgctctttggagaaaccmatcagggctgtcagattcgaatcaatcatccggacacgttacaggagtgcggcttcaactcctccctgcctctggtgatgataatccacgggtggtcggt

SEQ ID NO: 16485 - DNA, 201 bp, Homo sapiens; identical to SEQ ID NO: 16471

SEQ ID NO: 16486 - DNA, 201 bp, Homo sapiens; identical to SEQ ID NO: 16472

SEQ ID NO: 16487 - DNA, 201 bp, Homo sapiens; identical to SEQ ID NO: 16473

SEQ ID NO: 16488 - DNA, 201 bp, Homo sapiens; identical to SEQ ID NO: 16474

SEQ ID NO: 16489 - DNA, 201 bp, Homo sapiens
gtggcagagagcggcagcccggcccagctgctggcccagaagggcctgttttacagactggcccaggagtcaggcctggtctgagccaggaccctcaaccrtaccccagttggaccagcccgcacagcctgcagtgctggagatggaagtgacccgtggtcatcgatagctccacacgatattgagtctagacctgtgttt

SEQ ID NO: 16490 - DNA, 201 bp, Homo sapiens
cccctggcctcagggcgggcagatcgagttccgggactttgggctaagataccgacctgagctcccgctggctgtgcagggcgtgtccttcaagatccacrcaggagagaaggtgggcatcgttggcaggaccggggcagggaagtcctccctggccagtgggctgctgcggctccaggaggcagctgagggtgggatctg

SEQ ID NO: 16491 - DNA, 201 bp, Homo sapiens
ctccccagccattgggctgtttgcctccatggctgcggtgctcctaggtggggcccgggcatccaggttgctcttccagaggctcctgtgggatgtggtgygatctcccatcagcttctttgagcggacacccattggtcacctgctaaaccgcttctccaaggagacagacacggttgacgtggacattccagacaaact

SEQ ID NO: 16492 - DNA, 201 bp, Homo sapiens
ccagcctgcccggccagctgcagtacaagtgtgctgaccgaggcgaggacctgagcgtgggccagaaacagctcctgtgtctggcacgtgcccttctccgraagacccagatcctcatcctggacgaggctactgctgccgtggaccctggcacggagctgcagatgcaggccatgctcgggagctggtttgcacagtgca

SEQ ID NO: 16493 - DNA, 201 bp, Homo sapiens
ggagcactcggacgaggctatctgggcagccctggagacggtgcagctcaaagccttggtggccagcctgcccggccagctgcagtacaagtgtgctgacygaggcgaggacctgagcgtgggccagaaacagctcctgtgtctggcacgtgcccttctccggaagacccagatcctcatcctggacgaggctactgctgc

SEQ ID NO: 16494 - DNA, 201 bp, Homo sapiens
gggtgggatctggatcgacggggtccccattgcccacgtggggctgcacacactgcgctccaggatcagcatcatcccccaggaccccatcctgttccctsgctctctgcggatgaacctcgacctgctgcaggagcactcggacgaggctatctgggcagccctggagacggtgcagctcaaagccttggtggccagcct

SEQ ID NO: 16495 - DNA, 201 bp, Homo sapiens
gatcgagttccgggactttgggctaagataccgacctgagctcccgctggctgtgcagggcgtgtccttcaagatccacgcaggagagaaggtgggcatckttggcaggaccggggcagggaagtcctccctggccagtgggctgctgcggctccaggaggcagctgagggtgggatctggatcgacggggtccccattgc

SEQ ID NO: 16496 - DNA, 201 bp, Homo sapiens
ctgcagtacaagtgtgctgaccgaggcgaggacctgagcgtgggccagaaacagctcctgtgtctggcacgtgcccttctccggaagacccagatcctcaycctggacgaggctactgctgccgtggaccctggcacggagctgcagatgcaggccatgctcgggagctggtttgcacagtgcactgtgctgctcattgcc

SEQ ID NO: 16497 - DNA, 201 bp, Homo sapiens
ccggtccctgctgatgtacgcctttggactcctggaggtcagcctggtggtggcagtggctaccccactggccactgtggccatcctgccactgtttctcmtctacgctgggtttcaggtggcttgcggccaatgtggagctcctggggaatggcctggtgtttgcagctgccacgtgtgctgtgctgagcaaagcccacc

SEQ ID NO: 16498 - DNA, 201 bp, Homo sapiens
cgggactttgggctaagataccgacctgagctcccgctggctgtgcagggcgtgtccttcaagatccacgcaggagagaaggtgggcatcgttggcaggaycggggcagggaagtcctccctggccagtgggctgctgcggctccaggaggcagctgagggtgggatctggatcgacggggtccccattgcccacgtgggg

SEQ ID NO: 16499 - DNA, 201 bp, Homo sapiens
ggactttgggctaagataccgacctgagctcccgctggctgtgcagggcgtgtccttcaagatccacgcaggagagaaggtgggcatcgttggcaggaccrgggcagggaagtcctccctggccagtgggctgctgcggctccaggaggcagctgagggtgggatctggatcgacggggtccccattgcccacgtggggct

SEQ ID NO: 16500 - DNA, 201 bp, Homo sapiens
gctgtgcagggcgtgtccttcaagatccacgcaggagagaaggtgggcatcgttggcaggaccggggcagggaagtcctccctggccagtgggctgctgcrgctccaggaggcagctgagggtgggatctggatcgacggggtccccattgcccacgtggggctgcacacactgcgctccaggatcagcatcatcccccag

SEQ ID NO: 16501 - DNA, 201 bp, Homo sapiens
caagatccacgcaggagagaaggtgggcatcgttggcaggaccggggcagggaagtcctccctggccagtgggctgctgcggctccaggaggcagctgagrgtgggatctggatcgacggggtccccattgcccacgtggggctgcacacactgcgctccaggatcagcatcatcccccaggaccccatcctgttccctgg

SEQ ID NO: 16502 - DNA, 201 bp, Homo sapiens
ggctccaggaggcagctgagggtgggatctggatcgacggggtccccattgcccacgtggggctgcacacactgcgctccaggatcagcatcatcccccasgaccccatcctgttccctggctctctgcggatgaacctcgacctgctgcaggagcactcggacgaggctatctgggcagccctggagacggtgcagctca

SEQ ID NO: 16503 - DNA, 201 bp, Homo sapiens
catctcgccctgtccaccctgcagccaatgtcaacagcgactctcagccccgctgtactctggactcacctgggggcctcaagcacatgcccaggctcccrgctagacccttaaatcagaatctctgaggctgggaactgccatgctgtgtgtactttttacaaattaacacttttattttgggataatcccagactcaca

SEQ ID NO: 16504 - DNA, 201 bp, Homo sapiens
ggtccccattgcccacgtggggctgcacacactgcgctccaggatcagcatcatcccccaggaccccatcctgttccctggctctctgcggatgaacctcracctgctgcaggagcactcggacgaggctatctgggcagccctggagacggtgcagctcaaagccttggtggccagcctgcccggccagctgcagtacaa

SEQ ID NO: 16505 - DNA, 201 bp, Homo sapiens
ggctgtgcagggcgtgtccttcaagatccacgcaggagagaaggtgggcatcgttggcaggaccggggcagggaagtcctccctggccagtgggctgctgyggctccaggaggcagctgagggtgggatctggatcgacggggtccccattgcccacgtggggctgcacacactgcgctccaggatcagcatcatccccca

SEQ ID NO: 16506 - DNA, 201 bp, Homo sapiens
  misc_feature (1)...(201): n = A,T,C or G, or insertion/deletion polymorphism (see Tables 1-2)
cggatgcaggactatgcctggacgcccaaggaggctccctggaggctgcccacatgtgcagctcagcccccctggcctcagggcgggcagatcgagttccnggactttgggctaagataccgacctgagctcccgctggctgtgcagggcgtgtccttcaagatccacgcaggagagaaggtgggcatcgttggcaggacc

SEQ ID NO: 16507 - DNA, 201 bp, Homo sapiens
accgtctggtcaccttcctctgcctggaagaagttgaccctggtgtcgtagactcaagttcctctggaagcgctgccgggaaggattgcatcacgatacamagtgccaccttcgcctggtcccaggaaagccctccctgcctccacagaataaacctcacggtgccccagggctgtctgctggctgttgtcggtccagtgg

SEQ ID NO: 16508 - DNA, 201 bp, Homo sapiens
cctttgaccgtctggtcaccttcctctgcctggaagaagttgaccctggtgtcgtagactcaagttcctctggaagcgctgccgggaaggattgcatcacsatacaaagtgccaccttcgcctggtcccaggaaagccctccctgcctccacagaataaacctcacggtgccccagggctgtctgctggctgttgtcggtc

SEQ ID NO: 16509 - DNA, 201 bp, Homo sapiens
caaagtgccaccttcgcctggtcccaggaaagccctccctgcctccacagaataaacctcacggtgccccagggctgtctgctggctgttgtcggtccagygggggcagggaagtcctccctgctgtccgccctccttggggagctgtcaaaggtggaggggttcgtgagcatcgagggtgctgtggcctacgtgccccag

SEQ ID NO: 16510 - DNA, 201 bp, Homo sapiens
ggcctggtgggctactccagggaacaacacggattctcgtgacgcacgcactccacatcctgccccaggctgattggatcatagtgctggcaaatggggcyatcgcagagatgggttcctaccaggagcttctgcagaggaagggggccctcgtgtgtcttctggatcaagccagacagccaggagatagaggagaaggag

SEQ ID NO: 16511 - DNA, 201 bp, Homo sapiens
caggctttcctgcccttctccatccactccctcgtccaggcccgggtgtcctttgaccgtctggtcaccttcctctgcctggaagaagttgaccctggtgycgtagactcaagttcctctggaagcgctgccgggaaggattgcatcacgatacaaagtgccaccttcgcctggtcccaggaaagccctccctgcctccac

SEQ ID NO: 16512 - DNA, 201 bp, Homo sapiens
ggactcacgggcacggctcaccagctctatcctcaggaactcgaagaccatcaagttccatggctgggagggagcctttctggacagagtcctgggcatcygaggccaggagctgggcgccttgcggacctccggcctcctcttctctgtgtcgctggtgtccttccaagtgtctacatttctggtcgcactggtggtgtt

SEQ ID NO: 16513 - DNA, 201 bp, Homo sapiens
aatgaggcagaaggactcacgggcacggctcaccagctctatcctcaggaactcgaagaccatcaagttccatggctgggagggagcctttctggacagartcctgggcatccgaggccaggagctgggcgccttgcggacctccggcctcctcttctctgtgtcgctggtgtccttccaagtgtctacatttctggtcgc

SEQ ID NO: 16514 - DNA, 201 bp, Homo sapiens; identical to SEQ ID NO: 16506
  misc_feature (1)...(201): n = A,T,C or G, or insertion/deletion polymorphism (see Tables 1-2)

SEQ ID NO: 16515 - DNA, 201 bp, Homo sapiens
tatacagaaaggcagctgtgtacctgctggatgaccccctggcggccctggatgcccacgttggccagcatgtcttcaaccaggtcattgggcctggtggrctactccagggaacaacacggattctcgtgacgcacgcactccacatcctgccccaggctgattggatcatagtgctggcaaatggggccatcgcagaga

SEQ ID NO: 16516 - DNA, 201 bp, Homo sapiens
agagaatgtgtgcttcgggcaggagctggacccaccctggctggagagagtactagaagcctgtgccctgcagccagatgtggacagcttccctgagggartccacacttcaattggggagcagggcatgaatctctccggaggccagaagcagcggctgagcctggcccgggctgtatacagaaaggcagctgtgtacct

SEQ ID NO: 16517 - DNA, 201 bp, Homo sapiens
tccctgagaaggaccgtaccacttcagaagcccagacagaggttcctctggatgaccctgacagggcaggatggccagcaggaaaggacagcatccaatayggcagggtgaaggccacagtgcacctggcctacctgcgtgccgtgggcacccccctctgcctctacgcactcttcctcttcctctgccagcaagtggcct

SEQ ID NO: 16518 - DNA, 201 bp, Homo sapiens
agaacctgggaccagcaccaaggaccccagaggcacctctgcaggcaggaggcccgagcttagacgcgagaggtccatcaagtcagtccctgagaaggacygtaccacttcagaagcccagacagaggttcctctggatgaccctgacagggcaggatggccagcaggaaaggacagcatccaatacggcagggtgaaggc

SEQ ID NO: 16519 - DNA, 201 bp, Homo sapiens; identical to SEQ ID NO: 16493

SEQ ID NO: 16520 - DNA, 201 bp, Homo sapiens; identical to SEQ ID NO: 16492

SEQ ID NO: 16521 - DNA, 163 bp, Homo sapiens
cgccaggtcctggctctgtccagcggctccagaaaggccagtgcggtgggtgatgtggtcaakctggtgtccgtagacgtgcagcggctgaccgagagcgtcctctacctcaacgggctgtggctgcctctcgtctggatcgtggtctgcttcgtctatctct

SEQ ID NO: 16522 - DNA, 201 bp, Homo sapiens; identical to SEQ ID NO: 16496

SEQ ID NO: 16523 - DNA, 201 bp, Homo sapiens
tatgtggttagctcatgccagctgagacgcttggagtcagccagctactcgtctgtctgctcccacatggctgagacgttccagggcagcacagtggtccvggcattccgaacccaggccccctttgtggctcagaacaatgctcgcgtagatgaaagccagaggatcagtttcccgcgactggtggctgacaggtggctt

SEQ ID NO: 16524 - DNA, 201 bp, Homo sapiens
gtatgtggttagctcatgccagctgagacgcttggagtcagccagctactcgtctgtctgctcccacatggctgagacgttccagggcagcacagtggtcygggcattccgaacccaggccccctttgtggctcagaacaatgctcgcgtagatgaaagccagaggatcagtttcccgcgactggtggctgacaggtggct

SEQ ID NO: 16525 - DNA, 201 bp, Homo sapiens
gactcacgggcacggctcaccagctctatcctcaggaactcgaagaccatcaagttccatggctgggagggagcctttctggacagagtcctgggcatccraggccaggagctgggcgccttgcggacctccggcctcctcttctctgtgtcgctggtgtccttccaagtgtctacatttctggtcgcactggtggtgttt

SEQ ID NO: 16526 - DNA, 201 bp, Homo sapiens
tcgctggtgtccttccaagtgtctacatttctggtcgcactggtggtgtttgctgtccacactctggtggccgagaatgctatgaatgcagagaaagcctytgtgactctcacagttctcaacatcctcaacaaggcccaggctttcctgcccttctccatccactccctcgtccaggcccgggtgtcctttgaccgtctg

SEQ ID NO: 16527 - DNA, 201 bp, Homo sapiens
caggaaagccctccctgcctccacagaataaacctcacggtgccccagggctgtctgctggctgttgtcggtccagtgggggcagggaagtcctccctgcygtccgccctccttggggagctgtcaaaggtggaggggttcgtgagcatcgagggtgctgtggcctacgtgccccaggaggcctgggtgcagaacacctct

SEQ ID NO: 16528 - DNA, 201 bp, Homo sapiens
cagccagatgtggacagcttccctgagggaatccacacttcaattggggagcagggcatgaatctctccggaggccagaagcagcggctgagcctggcccrggctgtatacagaaaggcagctgtgtacctgctggatgaccccctggcggccctggatgcccacgttggccagcatgtcttcaaccaggtcattgggcct

SEQ ID NO: 16529 - DNA, 201 bp, Homo sapiens
tagctcatgccagctgagacgcttggagtcagccagctactcgtctgtctgctcccacatggctgagacgttccagggcagcacagtggtccgggcattcygaacccaggccccctttgtggctcagaacaatgctcgcgtagatgaaagccagaggatcagtttcccgcgactggtggctgacaggtggcttgcggccaa

SEQ ID NO: 16530 - DNA, 201 bp, Homo sapiens; identical to SEQ ID NO: 16503

SEQ ID NO: 16531 - DNA, 201 bp, Homo sapiens; identical to SEQ ID NO: 16505

SEQ ID NO: 16532 - DNA, 201 bp, Homo sapiens
gttccagggcagcacagtggtccgggcattccgaacccaggccccctttgtggctcagaacaatgctcgcgtagatgaaagccagaggatcagtttcccgygactggtggctgacaggtggcttgcggccaatgtggagctcctggggaatggcctggtgtttgcagctgccacgtgtgctgtgctgagcaaagcccacct

SEQ ID NO: 16533 - DNA, 201 bp, Homo sapiens; identical to SEQ ID NO: 16494

SEQ ID NO: 16534 - DNA, 201 bp, Homo sapiens; identical to SEQ ID NO: 16489

SEQ ID NO: 16535 - DNA, 201 bp, Homo sapiens
agcggctgaccgagagcgtcctctacctcaacgggctgtggctgcctctcgtctggatcgtggtctgcttcgtctatctctggcagctcctggggccctcygccctcactgccatcgctgtcttcctgagcctcctccctctgaatttcttcatctccaagaaaaggaaccaccatcaggaggagcaaatgaggcagaagg

SEQ ID NO: 16536 - DNA, 201 bp, Homo sapiens; identical to SEQ ID NO: 16490

SEQ ID NO: 16537 - DNA, 201 bp, Homo sapiens
tagacgtgcagcggctgaccgagagcgtcctctacctcaacgggctgtggctgcctctcgtctggatcgtggtctgcttcgtctatctctggcagctcctrgggccctccgccctcactgccatcgctgtcttcctgagcctcctccctctgaatttcttcatctccaagaaaaggaaccaccatcaggaggagcaaatga

SEQ ID NO: 16538 - DNA, 201 bp, Homo sapiens
accctgacagggcaggatggccagcaggaaaggacagcatccaatacggcagggtgaaggccacagtgcacctggcctacctgcgtgccgtgggcaccccyctctgcctctacgcactcttcctcttcctctgccagcaagtggcctccttctgccggggctactggctgagcctgtgggcggacgaccctgcagtaggtg

SEQ ID NO: 16539 - DNA, 201 bp, Homo sapiens
ctctacgctgggtttcagagcctgtatgtggttagctcatgccagctgagacgcttggagtcagccagctactcgtctgtctgctcccacatggctgagaygttccagggcagcacagtggtccgggcattccgaacccaggccccctttgtggctcagaacaatgctcgcgtagatgaaagccagaggatcagtttcccg

SEQ ID NO: 16540 - DNA, 201 bp, Homo sapiens
tggacagcttccctgagggaatccacacttcaattggggagcagggcatgaatctctccggaggccagaagcagcggctgagcctggcccgggctgtatamagaaaggcagctgtgtacctgctggatgaccccctggcggccctggatgcccacgttggccagcatgtcttcaaccaggtcattgggcctggtgggctac

SEQ ID NO: 16541 - DNA, 201 bp, Homo sapiens
tctccaagccattgggctgtttgcctccatggctgcggtgctcctaggtggggcccgggcatccaggttgctcttccagaggctcctgtgggatgtggtgygatctcccatcagcttctttgagcggacacccattggtcacctgctaaaccgcttctccaaggagacagacacggttgacgtggacattccagacaaact

SEQ ID NO: 16542 - DNA, 201 bp, Homo sapiens
actgtggccatcctgccactgtttctcctctacgctgggtttcagagcctgtatgtggttagctcatgccagctgagacgcttggagtcagccagctactsgtctgtctgctcccacatggctgagacgttccagggcagcacagtggtccgggcattccgaacccaggccccctttgtggctcagaacaatgctcgcgta

SEQ ID NO: 16543 - DNA, 201 bp, Homo sapiens
ctgtggcctacgtgccccaggaggcctgggtgcagaacacctctgtggtagagaatgtgtgcttcgggcaggagctggacccaccctggctggagagagtwctagaagcctgtgccctgcagccagatgtggacagcttccctgagggaatccacacttcaattggggagcagggcatgaatctctccggaggccagaagc

SEQ ID NO: 16544 - DNA, 201 bp, Homo sapiens; identical to SEQ ID NO: 16495

SEQ ID NO: 16545 - DNA, 201 bp, Homo sapiens
ggtgctgtggcctacgtgccccaggaggcctgggtgcagaacacctctgtggtagagaatgtgtgcttcgggcaggagctggacccaccctggctggagaragtactagaagcctgtgccctgcagccagatgtggacagcttccctgagggaatccacacttcaattggggagcagggcatgaatctctccggaggccag

SEQ ID NO: 16546 - DNA, 201 bp, Homo sapiens
ccggtccctgctgatgtacgcctttggactcctggaggtcagcctggtggtggcagtggctaccccactggccactgtggccatcctgccactgtttctcmtctacgctgggtttcagagcctgtatgtggttagctcatgccagctgagacgcttggagtcagccagctactcgtctgtctgctcccacatggctgagac

SEQ ID NO: 16547 - DNA, 201 bp, Homo sapiens; identical to SEQ ID NO: 16498

SEQ ID NO: 16548 - DNA, 201 bp, Homo sapiens
ccacatcctgccccaggctgattggatcatagtgctggcaaatggggccatcgcagagatgggttcctaccaggagcttctgcagaggaagggggccctcrtgtgtcttctggatcaagccagacagccaggagatagaggagaaggagaaacagaacctgggaccagcaccaaggaccccagaggcacctctgcaggcag

SEQ ID NO: 16549 - DNA, 201 bp, Homo sapiens; identical to SEQ ID NO: 16499

SEQ ID NO: 16550 - DNA, 201 bp, Homo sapiens
gctgtctgctggctgttgtcggtccagtgggggcagggaagtcctccctgctgtccgccctccttggggagctgtcaaaggtggaggggttcgtgagcatygagggtgctgtggcctacgtgccccaggaggcctgggtgcagaacacctctgtggtagagaatgtgtgcttcgggcaggagctggacccaccctggctgg

SEQ ID NO: 16551 - DNA, 201 bp, Homo sapiens; identical to SEQ ID NO: 16500

SEQ ID NO: 16552 - DNA, 201 bp, Homo sapiens; identical to SEQ ID NO: 16501

SEQ ID NO: 16553 - DNA, 201 bp, Homo sapiens; identical to SEQ ID NO: 16502

SEQ ID NO: 16554 - DNA, 201 bp, Homo sapiens; identical to SEQ ID NO: 16504

SEQ ID NO: 16555 - DNA, 201 bp, Homo sapiens; identical to SEQ ID NO: 16507

SEQ ID NO: 16556 - DNA, 201 bp, Homo sapiens; identical to SEQ ID NO: 16508

SEQ ID NO: 16557 - DNA, 201 bp, Homo sapiens; identical to SEQ ID NO: 16509

SEQ ID NO: 16558 - DNA, 201 bp, Homo sapiens; identical to SEQ ID NO: 16510

SEQ ID NO: 16559 - DNA, 201 bp, Homo sapiens; identical to SEQ ID NO: 16511

SEQ ID NO: 16560 - DNA, 201 bp, Homo sapiens; identical to SEQ ID NO: 16512

SEQ ID NO: 16561 - DNA, 201 bp, Homo sapiens; identical to SEQ ID NO: 16513

SEQ ID NO: 16562 - DNA, 201 bp, Homo sapiens; identical to SEQ ID NO: 16535

SEQ ID NO: 16563 - DNA, 201 bp, Homo sapiens; identical to SEQ ID NO: 16537

SEQ ID NO: 16564 - DNA, 201 bp, Homo sapiens; identical to SEQ ID NO: 16515

SEQ ID NO: 16565 - DNA, 201 bp, Homo sapiens; identical to SEQ ID NO: 16516

SEQ ID NO: 16566 - DNA, 201 bp, Homo sapiens; identical to SEQ ID NO: 16540

SEQ ID NO: 16567 - DNA, 201 bp, Homo sapiens; identical to SEQ ID NO: 16543

SEQ ID NO: 16568 - DNA, 163 bp, Homo sapiens; identical to SEQ ID NO: 16521

SEQ ID NO: 16569 - DNA, 201 bp, Homo sapiens; identical to SEQ ID NO: 16545

SEQ ID NO: 16570 - DNA, 201 bp, Homo sapiens
ccacatcctgccccaggctgattggatcatagtgctggcaaatggggccatcgcagagatgggttcctaccaggagcttctgcagaggaagggggccctcrtgtgtcttctggatcaagccagacagccaggagatagaggagaaggaggtactaggtgggctttgctgattctccaggcctggctcctgccacccttggg

SEQ ID NO: 16571 - DNA, 201 bp, Homo sapiens; identical to SEQ ID NO: 16525

SEQ ID NO: 16572 - DNA, 201 bp, Homo sapiens; identical to SEQ ID NO: 16550

SEQ ID NO: 16573 - DNA, 201 bp, Homo sapiens; identical to SEQ ID NO: 16526

SEQ ID NO: 16574 - DNA, 201 bp, Homo sapiens; identical to SEQ ID NO: 16527

SEQ ID NO: 16575 - DNA, 201 bp, Homo sapiens; identical to SEQ ID NO: 16528

SEQ ID NO: 16576 - DNA, 201 bp, Homo sapiens; identical to SEQ ID NO: 16493

SEQ ID NO: 16577 - DNA, 201 bp, Homo sapiens; identical to SEQ ID NO: 16496

SEQ ID NO: 16578 - DNA, 201 bp, Homo sapiens; identical to SEQ ID NO: 16532

SEQ ID NO: 16579 - DNA, 201 bp, Homo sapiens; identical to SEQ ID NO: 16494

SEQ ID NO: 16580 - DNA, 201 bp, Homo sapiens
caggctttcctgcccttctccatccactccctcgtccaggcccgggtgtcctttgaccgtctggtcaccttcctctgcctggaagaagttgaccctggtgycgtagactcaagttcctctggaagcgctgccgggaaggattgcatcaccatacacagtgccaccttcgcctggtcccaggaaagccctccctgcctccac

SEQ ID NO: 16581 - DNA, 201 bp, Homo sapiens
accgtctggtcaccttcctctgcctggaagaagttgaccctggtgtcgtagactcaagttcctctggaagcgctgccgggaaggattgcatcaccatacamagtgccaccttcgcctggtcccaggaaagccctccctgcctccacagaataaacctcacggtgccccagggctgtctgctggctgttgtcggtccagtgg

SEQ ID NO: 16582 - DNA, 201 bp, Homo sapiens
cctttgaccgtctggtcaccttcctctgcctggaagaagttgaccctggtgtcgtagactcaagttcctctggaagcgctgccgggaaggattgcatcacsatacacagtgccaccttcgcctggtcccaggaaagccctccctgcctccacagaataaacctcacggtgccccagggctgtctgctggctgttgtcggtc

SEQ ID NO: 16583 - DNA, 201 bp, Homo sapiens; identical to SEQ ID NO: 16513

SEQ ID NO: 16584 - DNA, 201 bp, Homo sapiens; identical to SEQ ID NO: 16535

SEQ ID NO: 16585 - DNA, 201 bp, Homo sapiens
tggacgtgcagcggctgaccgagagcgtcctctacctcaacgggctgtggctgcctctcgtctggatcgtggtctgcttcgtctatctctggcagctcctrgggccctccgccctcactgccatcgctgtcttcctgagcctcctccctctgaatttcttcatctccaagaaaaggaaccaccatcaggaggagcaaatga

SEQ ID NO: 16586 - DNA, 201 bp, Homo sapiens; identical to SEQ ID NO: 16492

SEQ ID NO: 16587 - DNA, 201 bp, Homo sapiens; identical to SEQ ID NO: 16490

SEQ ID NO: 16588 - DNA, 201 bp, Homo sapiens; identical to SEQ ID NO: 16546

SEQ ID NO: 16589 - DNA, 201 bp, Homo sapiens; identical to SEQ ID NO: 16506
  misc_feature (1)...(201): n = A,T,C or G, or insertion/deletion polymorphism (see Tables 1-2)

SEQ ID NO: 16590 - DNA, 201 bp, Homo sapiens; identical to SEQ ID NO: 16538

SEQ ID NO: 16591 - DNA, 201 bp, Homo sapiens; identical to SEQ ID NO: 16539

SEQ ID NO: 16592 - DNA, 201 bp, Homo sapiens; identical to SEQ ID NO: 16510

SEQ ID NO: 16593 - DNA, 201 bp, Homo sapiens; identical to SEQ ID NO: 16512

SEQ ID NO: 16594 - DNA, 201 bp, Homo sapiens; identical to SEQ ID NO: 16517

SEQ ID NO: 16595 - DNA, 201 bp, Homo sapiens; identical to SEQ ID NO: 16518

SEQ ID NO: 16596 - DNA, 201 bp, Homo sapiens; identical to SEQ ID NO: 16548

SEQ ID NO: 16597 - DNA, 201 bp, Homo sapiens; identical to SEQ ID NO: 16515

SEQ ID NO: 16598 - DNA, 201 bp, Homo sapiens; identical to SEQ ID NO: 16516

SEQ ID NO: 16599 - DNA, 201 bp, Homo sapiens; identical to SEQ ID NO: 16529

SEQ ID NO: 16600 - DNA, 201 bp, Homo sapiens; identical to SEQ ID NO: 16505

SEQ ID NO: 16601 - DNA, 201 bp, Homo sapiens; identical to SEQ ID NO: 16543

SEQ ID NO: 16602 - DNA, 201 bp, Homo sapiens; identical to SEQ ID NO: 16545

SEQ ID NO: 16603 - DNA, 201 bp, Homo sapiens; identical to SEQ ID NO: 16550

SEQ ID NO: 16604 - DNA, 201 bp, Homo sapiens; identical to SEQ ID NO: 16523

SEQ ID NO: 16605 - DNA, 201 bp, Homo sapiens; identical to SEQ ID NO: 16524

SEQ ID NO: 16606 - DNA, 201 bp, Homo sapiens
cacagtgccaccttcgcctggtcccaggaaagccctccctgcctccacagaataaacctcacggtgccccagggctgtctgctggctgttgtcggtccagygggggcagggaagtcctccctgctgtccgccctccttggggagctgtcaaaggtggaggggttcgtgagcatcgagggtgctgtggcctacgtgccccag

SEQ ID NO: 16607 - DNA, 201 bp, Homo sapiens; identical to SEQ ID NO: 16525

SEQ ID NO: 16608 - DNA, 201 bp, Homo sapiens; identical to SEQ ID NO: 16526

SEQ ID NO: 16609 - DNA, 201 bp, Homo sapiens; identical to SEQ ID NO: 16527

SEQ ID NO: 16610 - DNA, 201 bp, Homo sapiens; identical to SEQ ID NO: 16528

SEQ ID NO: 16611 - DNA, 201 bp, Homo sapiens; identical to SEQ ID NO: 16540

SEQ ID NO: 16612 - DNA, 201 bp, Homo sapiens
ctccaagccattgggctgtttgcctccatggctgcggtgctcctaggtggggcccgggcatccaggttgctcttccagaggctcctgtgggatgtggtgcyatctcccatcagcttctttgagcggacacccattggtcacctgctaaaccgcttctccaaggagacagacacggttgacgtggacattccagacaaactc

SEQ ID NO: 16613 - DNA, 201 bp, Homo sapiens; identical to SEQ ID NO: 16542

SEQ ID NO: 16614 - DNA, 201 bp, Homo sapiens; identical to SEQ ID NO: 16495

SEQ ID NO: 16615 - DNA, 201 bp, Homo sapiens; identical to SEQ ID NO: 16498

SEQ ID NO: 16616 - DNA, 201 bp, Homo sapiens; identical to SEQ ID NO: 16499

SEQ ID NO: 16617 - DNA, 201 bp, Homo sapiens; identical to SEQ ID NO: 16500

SEQ ID NO: 16618 - DNA, 201 bp, Homo sapiens; identical to SEQ ID NO: 16501

SEQ ID NO: 16619 - DNA, 201 bp, Homo sapiens; identical to SEQ ID NO: 16502

SEQ ID NO: 16620 - DNA, 201 bp, Homo sapiens; identical to SEQ ID NO: 16504

SEQ ID NO: 16621 - DNA, 201 bp, Homo sapiens
gaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacac

SEQ ID NO: 16622 - DNA, 201 bp, Homo sapiens
gcggactcggaccaggaccgggatccccaccggctcaactcgcatctcaaggattttaatgccttttgtaaagacctgcctaatggttctgccttcagtgsagacaatatggaagagtgtgacagatgttatcattgctccattgtgtacgagcgtaggacgatgcttctcttctgtcagcctgcaactgagccaggattg

SEQ ID NO: 16623 - DNA, 201 bp, Homo sapiens
tataatgtgagtagttactaaaatttacacatcttaaaagtgtgtaaatgcttaaatttcagaattaccatcagaacctcaattgacattcctttgaatasgctaataagtgacaaataagattaataagatttttcaaaatcgccaggactggtgaatataaatgatgattgaactggaataatattggggaccaaatca

SEQ ID NO: 16624 - DNA, 201 bp, Homo sapiens; identical to SEQ ID NO: 16621

SEQ ID NO: 16625 - DNA, 201 bp, Homo sapiens
ggaacgcgcatcagttcccaagcagtaggaagaactggaaggccttgaaaggattttaatgccttttgtaaagacctgcctaatggttctgccttcagtgsagacaatatggaagagtgtgacagatgttatcattgctccattgtgtacgagcgtaggacgatgcttctcttctgtcagcctgcaactgagccaggattg

SEQ ID NO: 16626 - DNA, 201 bp, Homo sapiens
cctgacggtgttcctggccattcccctggccttcattgcgggaattctctttgccaccctcagctgtctgcacatctggtgagacggggcacaccgggtgkaccggctttctgaaacatgggcatattctccgccacctgccccctactctcctcttatcccaggccggcgtcaggaggaggaacgcgcatcagttcccaa

SEQ ID NO: 16627 - DNA, 201 bp, Homo sapiens
accgggtggaccggctttctgaaacatgggcatattctccgccacctgccccctactctcctcttatcccaggccggcgtcaggaggaggaacgcgcatcrgttcccaagcagtaggaagaactggaaggccttgaaaggattttaatgccttttgtaaagacctgcctaatggttctgccttcagtgcagacaatatgga

SEQ ID NO: 16628 - DNA, 201 bp, Homo sapiens; identical to SEQ ID NO: 16623

SEQ ID NO: 16629 - DNA, 201 bp, Homo sapiens; identical to SEQ ID NO: 16621

SEQ ID NO: 16630 - DNA, 201 bp, Homo sapiens
ggccttcattgcgggaattctctttgccaccctcagctgtctgcacatctggattttaatgccttttgtaaagacctgcctaatggttctgccttcagtgsagacaatatggaagagtgtgacagatgttatcattgctccattgtgtacgagcgtaggacgatgcttctcttctgtcagcctgcaactgagccaggattg

SEQ ID NO: 16631 - DNA, 201 bp, Homo sapiens; identical to SEQ ID NO: 16623

SEQ ID NO: 16632 - DNA, 201 bp, Homo sapiens; identical to SEQ ID NO: 16630

SEQ ID NO: 16633 - DNA, 201 bp, Homo sapiens
ggctggaacagagacaacgagcaccactctgagatatggactcctgctcctgctgaagtacccagaggtcacagctaaagtccaggaagagattgaatgtktagttggcagaaaccggagcccctgtatgcaggacaggagtcacatgccctacacagatgctgtggtgcacgagatccagagatacattgacctcctccc

SEQ ID NO: 16634 - DNA, 141 bp, Homo sapiens
cctaaatatatctgctattctccatactctgtatcacttgtattgaccaccacatatgctaatacctatctactgctgagttgtcagtatgttatcactakaaaacaaagaaaaatgattaataaatgacaattcagagcc

SEQ ID NO: 16635 - DNA, 201 bp, Homo sapiens
tgcttcattcctgtctgaagaagggcagatagtttggctgctcctgtgctgtcacctgcaattctcccttatcagggccattggcctctcccttctctctrtgagggatattttctctgacttgtcaatccacatcttcccattccctcaagatccaatgaacatccaacctccattaaagagagtttcttgggtcacttc

SEQ ID NO: 16636 - DNA, 201 bp, Homo sapiens
gtgcacgagatccagagatacattgacctcctccccaccaacctgccccatgcagtgacctgtgatgttaaattcaaaaactacctcatccccaagggcaygaccataataacatccctgacttctgtgctgcacaatgacaaagaattccccaacccagagatgtttgaccctggccactttctggataagagtggcaac

SEQ ID NO: 16637 - DNA, 201 bp, Homo sapiens
tgtttcctgatcaaaatggaacaggaaaagcacaatcaacagtctgaatttactgttgaaagcttgatagccactgtaactgatatgtttggggctggaayagagacaacgagcaccactctgagatatggactcctgctcctgctgaagtacccagaggtcacagctaaagtccaggaagagattgaatgtgtagttggc

SEQ ID NO: 16638 - DNA, 201 bp, Homo sapiens
catcacccccattgccaatgcatttggtcgtgtgccacccttgtaccagctctgcttcattcctgtctgaagaagggcagatagtttggctgctcctgtgytgtcacctgcaattctcccttatcagggccattggcctctcccttctctctgtgagggatattttctctgacttgtcaatccacatcttcccattccctc

SEQ ID NO: 16639 - DNA, 201 bp, Homo sapiens
cctggccactttctggataagagtggcaactttaagaaaagtgactacttcatgcctttctcagcaggaaaacggatgtgtatgggagagggcctggccckcatggagctgtttttattcctgaccaccattttgcagaactttaacctgaaatctcaggttgacccaaaggatattgacatcacccccattgccaatgca

SEQ ID NO: 16640 - DNA, 201 bp, Homo sapiens
cccacccctctgccaaagtactcttaggtgccagtctggtaactgaactccctctggaggcaggcttgagggaggattcctcagggttcccttgaaagctytatttatttattttgttcatttatttattggagaggcagcattgcacagtgaaagaattctggatatctcaggagccccgaaattctagctctgactttg

SEQ ID NO: 16641 - DNA, 201 bp, Homo sapiens
agattcagctacccaggcccaagatggcccccgcgaatgacacatatgaaagcatcttcagtcacttccgagagtatgagattgccattcgcaaggtgccrggaaacttcacgttcacacacaagaaagtaaaacatgaaaacttcagcctcctaacctctggagaagtgggagagttctgtgtccaggtgaaaccatctg

SEQ ID NO: 16642 - DNA, 201 bp, Homo sapiens
ccatctccaactgtagccagaccctgtcctatgaccttaccgcagtgaccttggacctgtaccacagcaatggctaccgggccagagtgcgggctgtggayggcagccggcactccaactggaccgtcaccaacacccgcttctctgtggatgaagtgactctgacagttggcagtgtgaacctagagatccacaatggct

SEQ ID NO: 16643 - DNA, 201 bp, Homo sapiens
acggcagcacagacagtggctttggcagcaccaagccatccctgcagactgaagagccccagttcctcctccctgaccctcacccccaggctgacagaacrctgggaaacggggagccccctgtgctgggggacagctgcagtagtggcagcagcaatagcacagacagcgggatctgcctgcaggagcccagcctgagcc

SEQ ID NO: 16644 - DNA, 201 bp, Homo sapiens
atgcctgctcctctgcctggaccaggaggagggcccctggggcagaagttaggcacgaggcagtctgggcacttttctgcaagtccactggggctggcccyagccaggccctgcagggctggtcagggtgtctggggcaggaggaggccaactcactgaactagtgcagggtatgtgggtggcactgacctgttctgttga

SEQ ID NO: 16645 - DNA, 201 bp, Homo sapiens
tggatgaagtgactctgacagttggcagtgtgaacctagagatccacaatggcttcatcctcgggaagattcagctacccaggcccaagatggcccccgcraatgacacatatgaaagcatcttcagtcacttccgagagtatgagattgccattcgcaaggtgccgggaaacttcacgttcacacacaagaaagtaaaac

SEQ ID NO: 16646 - DNA, 201 bp, Homo sapiens
gacagttggcagtgtgaacctagagatccacaatggcttcatcctcgggaagattcagctacccaggcccaagatggcccccgcgaatgacacatatgaargcatcttcagtcacttccgagagtatgagattgccattcgcaaggtgccgggaaacttcacgttcacacacaagaaagtaaaacatgaaaacttcagcct

SEQ ID NO: 16647 - DNA, 201 bp, Homo sapiens
tgtccaggtgaaaccatctgtcgcttcccgaagtaacaaggggatgtggtctaaagaggagtgcatctccctcaccaggcagtatttcaccgtgaccaacrtcatcatcttctttgcctttgtcctgctgctctccggagccctcgcctactgcctggccctccagctgtatgtgcggcgccgaaagaagctacccagtgt

SEQ ID NO: 16648 - DNA, 201 bp, Homo sapiens
ccagccctccgtctgtgtggtttgaagcagaatttttccaccacatcctccactggacacccatcccaaatcagtctgaaagtacctgctatgaagtggcrctcctgaggtatggaatagagtcctggaactccatctccaactgtagccagaccctgtcctatgaccttaccgcagtgaccttggacctgtaccacagca

SEQ ID NO: 16649 - DNA, 201 bp, Homo sapiens
agacagtggctttggcagcaccaagccatccctgcagactgaagagccccagttcctcctccctgaccctcacccccaggctgacagaacgctgggaaacrgggagccccctgtgctgggggacagctgcagtagtggcagcagcaatagcacagacagcgggatctgcctgcaggagcccagcctgagccccagcacagg

SEQ ID NO: 16650 - DNA, 201 bp, Homo sapiens
ctgtatgtgcggcgccgaaagaagctacccagtgtcctgctcttcaagaagcccagccccttcatcttcatcagccagcgtccctccccagagacccaagrcaccatccacccgcttgatgaggaggcctttttgaaggtgtccccagagctgaagaacttggacctgcacggcagcacagacagtggctttggcagcacc

SEQ ID NO: 16651 - DNA, 201 bp, Homo sapiens
cagccctccgtctgtgtggtttgaagcagaatttttccaccacatcctccactggacacccatcccaaatcagtctgaaagtacctgctatgaagtggcgstcctgaggtatggaatagagtcctggaactccatctccaactgtagccagaccctgtcctatgaccttaccgcagtgaccttggacctgtaccacagcaa

SEQ ID NO: 16652 - DNA, 201 bp, Homo sapiens
tgggagcaacaggtggggagcaacagcaggggccaggatgacagtggcattgacttagttcaaaactctgagggccgggctggggacacacagggtggctyggccttgggccaccacagtcccccggagcctgaggtgcctggggaagaagacccagctgctgtggcattccagggttacctgaggcagaccagatgtgct

SEQ ID NO: 16653 - DNA, 201 bp, Homo sapiens
cagcctcctaacctctggagaagtgggagagttctgtgtccaggtgaaaccatctgtcgcttcccgaagtaacaaggggatgtggtctaaagaggagtgcrtctccctcaccaggcagtatttcaccgtgaccaacgtcatcatcttctttgcctttgtcctgctgctctccggagccctcgcctactgcctggccctcca

SEQ ID NO: 16654 - DNA, 201 bp, Homo sapiens
acaccatccacccgcttgatgaggaggcctttttgaaggtgtccccagagctgaagaacttggacctgcacggcagcacagacagtggctttggcagcacyaagccatccctgcagactgaagagccccagttcctcctccctgaccctcacccccaggctgacagaacgctgggaaacggggagccccctgtgctggggg

SEQ ID NO: 16655 - DNA, 201 bp, Homo sapiens
tgactttgctgtttccagtggtatgaccttggagaagtcacttatcctcttggagcctcagtttcctcatctgcagaataatgactgacttgtctaattcrtagggatgtgaggttctgctgaggaaatgggtatgaatgtgccttgaacacaaagctctgtcaataagtgatacatgttttttattccaataaattgtca

SEQ ID NO: 16656 - DNA, 201 bp, Homo sapiens
ctgggcttgggcaccagctcatgccagccccagagggtcagggttggaggcctgtgcttgtgtttgctgctaatgtccagctacagacccagaggataagmcactgggcactgggctggggtccctgccttgttggtgttcagctgtgtgattttggactagccacttgtcagagggcctcaatctcccatctgtgaaata

SEQ ID NO: 16657 - DNA, 137 bp, Homo sapiens
acaaggtcctgaaggagaagagaaagctgtttatccrttccatgggtgaaggtacaataaatggcttactggatgaattattacagacaagggtgctgaacmaggaagagatggagaaagtaaaaygtgaaaatgct

SEQ ID NO: 16658 - DNA, 201 bp, Homo sapiens
caataaatggcttactggatgaattattacagacaagggtgctgaacaaggaagagatggagaaagtaaaacgtgaaaatgctacagttatggataagacycgagctttgattgactccgttattccgaaaggggcacaggcatgccaaatttgcatcacatacatttgtgaagaagacagttacctggcagggacgctgg

SEQ ID NO: 16659 - DNA, 201 bp, Homo sapiens
attcctagaagaactggagctgaggttgacatcacaggcatgacaatgctgctacaaaatctggggtacagcgtagatgtgaaaaaaaatctcactgcttyggacatgactacagagctggaggcatttgcacaccgcccagagcacaagacctctgacagcacgttcctggtgttcatgtctcatggtattcgggaaggc

SEQ ID NO: 16660 - DNA, 201 bp, Homo sapiens
ctacagttatggataagactcgagctttgattgactccgttattccgaaaggggcacaggcatgccaaatttgcatcacatacatttgtgaagaagacagktacctggcagggacgctgggactctcagcagatcaaacatctggaaattaccttaatatgcaagactctcaaggagtactttcttcctttccagctcctc

SEQ ID NO: 16661 - DNA, 201 bp, Homo sapiens
acatgttgaataccaagaactgcccaagtttgaaggacaaaccgaaggtgatcatcatccaggcctgccgtggtgacagccctggtgtggtgtggtttaargattcagtaggagtttctggaaacctatctttaccaactacagaagagtttgaggatgatgctattaagaaagcccacatagagaaggattttatcgctt

SEQ ID NO: 16662 - DNA, 201 bp, Homo sapiens
agagcacaagacctctgacagcacgttcctggtgttcatgtctcatggtattcgggaaggcatttgtgggaagaaacactctgagcaagtcccagatataytacaactcaatgcaatctttaacatgttgaataccaagaactgcccaagtttgaaggacaaaccgaaggtgatcatcatccaggcctgccgtggtgacag

SEQ ID NO: 16663 - DNA, 201 bp, Homo sapiens
gataagactcgagctttgattgactccgttattccgaaaggggcacaggcatgccaaatttgcatcacatacatttgtgaagaagacagttacctggcagrgacgctgggactctcagcagatcaaacatctggaaattaccttaatatgcaagactctcaaggagtactttcttcctttccagctcctcaggcagtgcag

SEQ ID NO: 16664 - DNA, 201 bp, Homo sapiens
tctcaaggagtactttcttcctttccagctcctcaggcagtgcaggacaacccagctatgcccacatcctcaggctcagaagggaatgtcaagctttgctycctagaagaagctcaaaggatatggaaacaaaagtcggcagagatttatccaataatggacaagtcaagccgcacacgtcttgctctcattatctgcaat

SEQ ID NO: 16665 - DNA, 201 bp, Homo sapiens
cgtggtgacagccctggtgtggtgtggtttaaagattcagtaggagtttctggaaacctatctttaccaactacagaagagtttgaggatgatgctattargaaagcccacatagagaaggattttatcgctttctgctcttccacaccagataatgtttcttggagacatcccacaatgggctctgtttttattggaaga

SEQ ID NO: 16666 - DNA, 201 bp, Homo sapiens
caaggtcctgaaggagaagagaaagctgtttatccgttccatgggtgaaggtacaataaatggcttactggatgaattattacagacaagggtgctgaacmaggaagagatggagaaagtaaaacgtgaaaatgctacagttatggataagactcgagctttgattgactccgttattccgaaaggggcacaggcatgcca

SEQ ID NO: 16667 - DNA, 201 bp, Homo sapiens
gctgtttatccgttccatgggtgaaggtacaataaatggcttactggatgaattattacagacaagggtgctgaacaaggaagagatggagaaagtaaaaygtgaaaatgctacagttatggataagactcgagctttgattgactccgttattccgaaaggggcacaggcatgccaaatttgcatcacatacatttgtga

SEQ ID NO: 16668 - DNA, 201 bp, Homo sapiens
ctttgattgactccgttattccgaaaggggcacaggcatgccaaatttgcatcacatacatttgtgaagaagacagttacctggcagggacgctgggactytcagcagatcaaacatctggaaattaccttaatatgcaagactctcaaggagtactttcttcctttccagctcctcaggcagtgcaggacaacccagcta

SEQ ID NO: 16669 - DNA, 201 bp, Homo sapiens
tggaaattaccttaatatgcaagactctcaaggagtactttcttcctttccagctcctcaggcagtgcaggacaacccagctatgcccacatcctcaggcycagaagggaatgtcaagctttgctccctagaagaagctcaaaggatatggaaacaaaagtcggcagagatttatccaataatggacaagtcaagccgcac

SEQ ID NO: 16670 - DNA, 201 bp, Homo sapiens
atctggaaattaccttaatatgcaagactctcaaggagtactttcttcctttccagctcctcaggcagtgcaggacaacccagctatgcccacatcctcargctcagaagggaatgtcaagctttgctccctagaagaagctcaaaggatatggaaacaaaagtcggcagagatttatccaataatggacaagtcaagccg

SEQ ID NO: 16671 - DNA, 201 bp, Homo sapiens
caaacatctggaaattaccttaatatgcaagactctcaaggagtactttcttcctttccagctcctcaggcagtgcaggacaacccagctatgcccacatsctcaggctcagaagggaatgtcaagctttgctccctagaagaagctcaaaggatatggaaacaaaagtcggcagagatttatccaataatggacaagtca

SEQ ID NO: 16672 - DNA, 143 bp, Homo sapiens
aaacagacaaggtcctgaaggagaagagaaagctgtttatccrttccatgggtgaagctcctcaggcagtgcaggacaacccagctatgcccacatsctcargcycagaagggaatgtcaagctttgctycctagaagaagct

SEQ ID NO: 16673 - DNA, 201 bp, Homo sapiens
agacaaggtcctgaaggagaagagaaagctgtttatccgttccatgggtgaagctcctcaggcagtgcaggacaacccagctatgcccacatcctcaggcycagaagggaatgtcaagctttgctccctagaagaagctcaaaggatatggaaacaaaagtcggcagagatttatccaataatggacaagtcaagccgcac

SEQ ID NO: 16674 - DNA, 201 bp, Homo sapiens; identical to SEQ ID NO: 16659

SEQ ID NO: 16675 - DNA, 201 bp, Homo sapiens
aacagacaaggtcctgaaggagaagagaaagctgtttatccgttccatgggtgaagctcctcaggcagtgcaggacaacccagctatgcccacatcctcargctcagaagggaatgtcaagctttgctccctagaagaagctcaaaggatatggaaacaaaagtcggcagagatttatccaataatggacaagtcaagccg

SEQ ID NO: 16676 - DNA, 201 bp, Homo sapiens
agagcacaagacctctgacagcacgttcctggtgttcatgtctcatggtattcgggaaggcatttgtgggaagaaacactctgagcaagtcccagatataytacaactcaatgcaatctttaacatgttgaataccaagaactgcccaagtttgaaggacaaaccgaaggtgatcatcatccaggcctgccgtggtgataa

SEQ ID NO: 16677 - DNA, 197 bp, Homo sapiens
aaacagacaaggtcctgaaggagaagagaaagctgtttatccgttccatgggtgaagctcctcaggcagtgcaggacaacccagctatgcccacatsctcaggctcagaagggaatgtcaagctttgctccctagaagaagctcaaaggatatggaaacaaaagtcggcagagatttatccaataatggacaagtca

SEQ ID NO: 16678 - DNA, 201 bp, Homo sapiens
aagctgtttatccgttccatgggtgaagctcctcaggcagtgcaggacaacccagctatgcccacatcctcaggctcagaagggaatgtcaagctttgctycctagaagaagctcaaaggatatggaaacaaaagtcggcagagatttatccaataatggacaagtcaagccgcacacgtcttgctctcattatctgcaat

SEQ ID NO: 16679 - DNA, 143 bp, Homo sapiens; identical to SEQ ID NO: 16672

SEQ ID NO: 16680 - DNA, 201 bp, Homo sapiens; identical to SEQ ID NO: 16673

SEQ ID NO: 16681 - DNA, 201 bp, Homo sapiens; identical to SEQ ID NO: 16659

SEQ ID NO: 16682 - DNA, 201 bp, Homo sapiens; identical to SEQ ID NO: 16675

SEQ ID NO: 16683 - DNA, 201 bp, Homo sapiens; identical to SEQ ID NO: 16676

SEQ ID NO: 16684 - DNA, 197 bp, Homo sapiens; identical to SEQ ID NO: 16677

SEQ ID NO: 16685 - DNA, 201 bp, Homo sapiens; identical to SEQ ID NO: 16678

SEQ ID NO: 16686 - DNA, 201 bp, Homo sapiens
ktgattacatgagaggaatatgaggctgttttcatgatgtgagaaatccttgtgctcyaaacagacaaggtcctgaaggagaagagaaagctgtttatccrttccatgggtgaaggtacaataaatggcttactggatgaattattacagacaagggtgctgaacmaggaagagatggagaaagtaaaaygtgaaaatgct

SEQ ID NO: 16687 - DNA, 201 bp, Homo sapiens; identical to SEQ ID NO: 16658

SEQ ID NO: 16688 - DNA, 201 bp, Homo sapiens
ctacagttatggataagactcgagctttgattgactccgttattccgaaaggggcacaggcatgccaaatttgcatcacatacatttgtgaagaagacagktacctggcagggacgctgggactctcagcagctcctcaggcagtgcaggacaacccagctatgcccacatcctcaggctcagaagggaatgtcaagcttt

SEQ ID NO: 16689 - DNA, 201 bp, Homo sapiens; identical to SEQ ID NO: 16661

SEQ ID NO: 16690 - DNA, 201 bp, Homo sapiens; identical to SEQ ID NO: 16662

SEQ ID NO: 16691 - DNA, 201 bp, Homo sapiens
gataagactcgagctttgattgactccgttattccgaaaggggcacaggcatgccaaatttgcatcacatacatttgtgaagaagacagttacctggcagrgacgctgggactctcagcagctcctcaggcagtgcaggacaacccagctatgcccacatcctcaggctcagaagggaatgtcaagctttgctccctagaa

SEQ ID NO: 16692 - DNA, 201 bp, Homo sapiens
ctggcagggacgctgggactctcagcagctcctcaggcagtgcaggacaacccagctatgcccacatcctcaggctcagaagggaatgtcaagctttgctycctagaagaagctcaaaggatatggaaacaaaagtcggcagagatttatccaataatggacaagtcaagccgcacacgtcttgctctcattatctgcaat

SEQ ID NO: 16693 - DNA, 201 bp, Homo sapiens
gagggaaacaagtaggacagcaatacagtaagaagagggattacccaactgtgaggagggggacatttcactgatgaaatctaaatgaggtcactttctgktgattacatgagaggaatatgaggctgttttcatgatgtgagaaatccttgtgctctaaacagacaaggtcctgaaggagaagagaaagctgtttatccg

SEQ ID NO: 16694 - DNA, 201 bp, Homo sapiens
atacatttgtgaagaagacagttacctggcagggacgctgggactctcagcagctcctcaggcagtgcaggacaacccagctatgcccacatcctcaggcycagaagggaatgtcaagctttgctccctagaagaagctcaaaggatatggaaacaaaagtcggcagagatttatccaataatggacaagtcaagccgcac

SEQ ID NO: 16695 - DNA, 201 bp, Homo sapiens
ctttgattgactccgttattccgaaaggggcacaggcatgccaaatttgcatcacatacatttgtgaagaagacagttacctggcagggacgctgggactytcagcagctcctcaggcagtgcaggacaacccagctatgcccacatcctcaggctcagaagggaatgtcaagctttgctccctagaagaagctcaaagga

SEQ ID NO: 16696 - DNA, 201 bp, Homo sapiens
cacatacatttgtgaagaagacagttacctggcagggacgctgggactctcagcagctcctcaggcagtgcaggacaacccagctatgcccacatcctcargctcagaagggaatgtcaagctttgctccctagaagaagctcaaaggatatggaaacaaaagtcggcagagatttatccaataatggacaagtcaagccg

SEQ ID NO: 16697 - DNA, 201 bp, Homo sapiens
tgcatcacatacatttgtgaagaagacagttacctggcagggacgctgggactctcagcagctcctcaggcagtgcaggacaacccagctatgcccacatsctcaggctcagaagggaatgtcaagctttgctccctagaagaagctcaaaggatatggaaacaaaagtcggcagagatttatccaataatggacaagtca

SEQ ID NO: 16698 - DNA, 201 bp, Homo sapiens
gggggacatttcactgatgaaatctaaatgaggtcactttctgttgattacatgagaggaatatgaggctgttttcatgatgtgagaaatccttgtgctcyaaacagacaaggtcctgaaggagaagagaaagctgtttatccgttccatgggtgaaggtacaataaatggcttactggatgaattattacagacaagggt

SEQ ID NO: 16699 - DNA, 201 bp, Homo sapiens
aatggtaaactcagtcttcaggtcactccatgcacatgtatggagactattgagggaaacaagtaggacagcaatacagtaagaagagggattacccaacygtgaggagggggacatttcactgatgaaatctaaatgaggtcactttctgttgattacatgagaggaatatgaggctgttttcatgatgtgagaaatcct

SEQ ID NO: 16700 - DNA, 201 bp, Homo sapiens
acctcagcagggtatatttaaacatagcatgtggtctttccttttaaaattgtgtatgttcccattggtggtataactttataacttgcatgtctttaacmaaattctttcctatgtttttttttttaattatttctttttctcataggaagtgaagagatccttctgtaaaggtttttggaattatgtctgctgaataat

SEQ ID NO: 16701 - DNA, 201 bp, Homo sapiens
aatgcctttcttctggtcagtgcagagcacgttgctcttctcccaaagtttttcatttagaccccttttgagattcatctgatattggcctagaagtggcygtaagactacaaaccctcacttttggatgtttctctccttcacctcagcagggtatatttaaacatagcatgtggtctttccttttaaaattgtgtatgt

SEQ ID NO: 16702 - DNA, 201 bp, Homo sapiens; identical to SEQ ID NO: 16659

SEQ ID NO: 16703 - DNA, 201 bp, Homo sapiens
attccaatatacaaaaatatctgaaatttgaaatacttctggtagcatgcattttggataagggataatcaagccatatacagaaaatactgaagtaatgyctttcttctggtcagtgcagagcacgttgctcttctcccaaagtttttcatttagaccccttttgagattcatctgatattggcctagaagtggctgtaa

SEQ ID NO: 16704 - DNA, 201 bp, Homo sapiens
gtatggtcgggagtgtgggaaggttgaggaaagggtactgaaagtccatttgagtcaagaactctaggtttacaggctgagaatccttaatccaaaaattygaattttgaaatgctctaaaatccaacactgtgtgagcgcccacatgatattcaaaggaaatgtttattgaaacatttcaaattataggtttttggatta

SEQ ID NO: 16705 - DNA, 201 bp, Homo sapiens
aggaaactgtatgaatgtctgtgggcaggtacatgtgtatggtcgggagtgtgggaaggttgaggaaagggtactgaaagtccatttgagtcaagaactcyaggtttacaggctgagaatccttaatccaaaaatttgaattttgaaatgctctaaaatccaacactgtgtgagcgcccacatgatattcaaaggaaatgt

SEQ ID NO: 16706 - DNA, 201 bp, Homo sapiens
ggacattaaaataaggaaactgtatgaatgtctgtgggcaggtacatgtgtatggtcgggagtgtgggaaggttgaggaaagggtactgaaagtccatttkagtcaagaactctaggtttacaggctgagaatccttaatccaaaaatttgaattttgaaatgctctaaaatccaacactgtgtgagcgcccacatgatat

SEQ ID NO: 16707 - DNA, 201 bp, Homo sapiens; identical to SEQ ID NO: 16665

SEQ ID NO: 16708 - DNA, 201 bp, Homo sapiens; identical to SEQ ID NO: 16667

SEQ ID NO: 16709 - DNA, 201 bp, Homo sapiens; identical to SEQ ID NO: 16666

SEQ ID NO: 16710 - DNA, 174 bp, Homo sapiens
agtcacacaagaagggaggagagaaaagccatggccgacaaggtcctgaaggagaagagaaagctgtttatccrttccatgggtgaaggtacaataaatggcttactggatgaattattacagacaagggtgctgaacmaggaagagatggagaaagtaaaaygtgaaaatgct

SEQ ID NO: 16711 - DNA, 201 bp, Homo sapiens; identical to SEQ ID NO: 16658

SEQ ID NO: 16712 - DNA, 201 bp, Homo sapiens; identical to SEQ ID NO: 16659

SEQ ID NO: 16713 - DNA, 201 bp, Homo sapiens; identical to SEQ ID NO: 16660

SEQ ID NO: 16714 - DNA, 201 bp, Homo sapiens; identical to SEQ ID NO: 16661

SEQ ID NO: 16715 - DNA, 201 bp, Homo sapiens; identical to SEQ ID NO: 16662

SEQ ID NO: 16716 - DNA, 201 bp, Homo sapiens; identical to SEQ ID NO: 16663

SEQ ID NO: 16717 - DNA, 201 bp, Homo sapiens; identical to SEQ ID NO: 16664

SEQ ID NO: 16718 - DNA, 201 bp, Homo sapiens; identical to SEQ ID NO: 16665

SEQ ID NO: 16719 - DNA, 201 bp, Homo sapiens; identical to SEQ ID NO: 16666

SEQ ID NO: 16720 - DNA, 201 bp, Homo sapiens; identical to SEQ ID NO: 16667

SEQ ID NO: 16721 - DNA, 201 bp, Homo sapiens; identical to SEQ ID NO: 16668

SEQ ID NO: 16722 - DNA, 201 bp, Homo sapiens; identical to SEQ ID NO: 16669

SEQ ID NO: 16723 - DNA, 201 bp, Homo sapiens; identical to SEQ ID NO: 16670

SEQ ID NO: 16724 - DNA, 201 bp, Homo sapiens; identical to SEQ ID NO: 16671

SEQ ID NO: 16725 - DNA, 201 bp, Homo sapiens; identical to SEQ ID NO: 16686

SEQ ID NO: 16726 - DNA, 201 bp, Homo sapiens; identical to SEQ ID NO: 16658

SEQ ID NO: 16727 - DNA, 201 bp, Homo sapiens; identical to SEQ ID NO: 16688

SEQ ID NO: 16728 - DNA, 201 bp, Homo sapiens; identical to SEQ ID NO: 16661

SEQ ID NO: 16729 - DNA, 201 bp, Homo sapiens; identical to SEQ ID NO: 16662

SEQ ID NO: 16730 - DNA, 201 bp, Homo sapiens; identical to SEQ ID NO: 16691

SEQ ID NO: 16731 - DNA, 201 bp, Homo sapiens; identical to SEQ ID NO: 16692

SEQ ID NO: 16732 - DNA, 201 bp, Homo sapiens; identical to SEQ ID NO: 16693

SEQ ID NO: 16733 - DNA, 201 bp, Homo sapiens; identical to SEQ ID NO: 16694

SEQ ID NO: 16734 - DNA, 201 bp, Homo sapiens; identical to SEQ ID NO: 16695

SEQ ID NO: 16735 - DNA, 201 bp, Homo sapiens; identical to SEQ ID NO: 16696

SEQ ID NO: 16736 - DNA, 201 bp, Homo sapiens; identical to SEQ ID NO: 16697

SEQ ID NO: 16737 - DNA, 201 bp, Homo sapiens; identical to SEQ ID NO: 16698

SEQ ID NO: 16738 - DNA, 201 bp, Homo sapiens; identical to SEQ ID NO: 16699

SEQ ID NO: 16739 - DNA, 201 bp, Homo sapiens; identical to SEQ ID NO: 16659

SEQ ID NO: 16740 - DNA, 201 bp, Homo sapiens; identical to SEQ ID NO: 16665

SEQ ID NO: 16741 - DNA, 201 bp, Homo sapiens; identical to SEQ ID NO: 16667

SEQ ID NO: 16742 - DNA, 201 bp, Homo sapiens; identical to SEQ ID NO: 16666

SEQ ID NO: 16743 - DNA, 143 bp, Homo sapiens; identical to SEQ ID NO: 16672

SEQ ID NO: 16744 - DNA, 201 bp, Homo sapiens; identical to SEQ ID NO: 16673

SEQ ID NO: 16745 - DNA, 201 bp, Homo sapiens; identical to SEQ ID NO: 16659

SEQ ID NO: 16746 - DNA, 201 bp, Homo sapiens; identical to SEQ ID NO: 16675

SEQ ID NO: 16747 - DNA, 201 bp, Homo sapiens; identical to SEQ ID NO: 16661

SEQ ID NO: 16748 - DNA, 197 bp, Homo sapiens; identical to SEQ ID NO: 16677

SEQ ID NO: 16749 - DNA, 201 bp, Homo sapiens; identical to SEQ ID NO: 16662

SEQ ID NO: 16750 - DNA, 201 bp, Homo sapiens; identical to SEQ ID NO: 16678

SEQ ID NO: 16751 - DNA, 201 bp, Homo sapiens; identical to SEQ ID NO: 16665

SEQ ID NO: 16752 - DNA, 201 bp, Homo sapiens
tggccacgtgaaaaccggtagagcctccagaagactgcagccaaggaggaattccttgtggcaaggaatgtctgatgttgaatgttagatggttttctgcrctgtgctgggatgatacaacttgactcaactcttcagttgattgttccctactaacagcaccctggggttagtgttgctttggttgaaaggaagcatgaa

SEQ ID NO: 16753 - DNA, 148 bp, Homo sapiens
ccaaccctggggaaggagccagtttgccggatacaaactggtattctgttctggaggaaagggaggagtggaggtgggctgggccctctcttctcaccttygttttttgttggagtgtttctaataaacttggattctctaaccttta

SEQ ID NO: 16754 - DNA, 201 bp, Homo sapiens
gctcaccttcactcgcgtgtacagccgggacgcagacatcgtcatccagtttggtgtcgcggagcacggagacgggtatcccttcgacgggaaggacgggytcctggcacacgcctttcctcctggccccggcattcagggagacgcccatttcgacgatgacgagttgtggtccctgggcaagggcgtcgtggttccaac

SEQ ID NO: 16755 - DNA, 201 bp, Homo sapiens
tgaaccaggtggaccaagtgggctacgtgacctatgacatcctgcagtgccctgaggactagggctcccgtcctgctttggcagtgccatgtaaatccccmctgggaccaaccctggggaaggagccagtttgccggatacaaactggtattctgttctggaggaaagggaggagtggaggtgggctgggccctctcttct

SEQ ID NO: 16756 - DNA, 201 bp, Homo sapiens
gatgacgagttgtggtccctgggcaagggcgtcgtggttccaactcggtttggaaacgcagatggcgcggcctgccacttccccttcatcttcgagggccrctcctactctgcctgcaccaccgacggtcgctccgacggcttgccctggtgcagtaccacggccaactacgacaccgacgaccggtttggcttctgcccc

SEQ ID NO: 16757 - DNA, 201 bp, Homo sapiens
cgctctccaagaagcttttcttcttctctgggcgccaggtgtgggtgtacacaggcgcgtcggtgctgggcccgaggcgtctggacaagctgggcctgggmgccgacgtggcccaggtgaccggggccctccggagtggcagggggaagatgctgctgttcagcgggcggcgcctctggaggttcgacgtgaaggcgcaga

SEQ ID NO: 16758 - DNA, 201 bp, Homo sapiens
accgacggtcgctccgacggcttgccctggtgcagtaccacggccaactacgacaccgacgaccggtttggcttctgccccagcgagagactctacacccrggacggcaatgctgatgggaaaccctgccagtttccattcatcttccaaggccaatcctactccgcctgcaccacggacggtcgctccgacggctaccgc

SEQ ID NO: 16759 - DNA, 201 bp, Homo sapiens
gtgggctacgtgacctatgacatcctgcagtgccctgaggactagggctcccgtcctgctttggcagtgccatgtaaatccccactgggaccaaccctggrgaaggagccagtttgccggatacaaactggtattctgttctggaggaaagggaggagtggaggtgggctgggccctctcttctcacctttgttttttgtt

SEQ ID NO: 16760 - DNA, 201 bp, Homo sapiens
cctgtaccgctatggttacactcgggtggcagagatgcgtggagagtcgaaatctctggggcctgcgctgctgcttctccagaagcaactgtccctgcccragaccggtgagctggatagcgccacgctgaaggccatgcgaaccccacggtgcggggtcccagacctgggcagattccaaacctttgagggcgacctcaa

SEQ ID NO: 16761 - DNA, 201 bp, Homo sapiens
cgcacgacgtcttccagtaccgagagaaagcctatttctgccaggaccgcttctactggcgcgtgagttcccggagtgagttgaaccaggtggaccaagtrggctacgtgacctatgacatcctgcagtgccctgaggactagggctcccgtcctgctttggcagtgccatgtaaatccccactgggaccaaccctgggga

SEQ ID NO: 16762 - DNA, 198 bp, Homo sapiens
actagggctcccgtcctgctttggcagtgccatgtaaatccccactgggaccaaccctggggaaggagccagtttgccggatacaaactggtattctgttytggaggaaagggaggagtggaggtgggctgggccctctcttctcacctttgttttttgttggagtgtttctaataaacttggattctctaaccttta

SEQ ID NO: 16763 - DNA, 201 bp, Homo sapiens
ttcgacgtgaaggcgcagatggtggatccccggagcgccagcgaggtggaccggatgttccccggggtgcctttggacacgcacgacgtcttccagtaccragagaaagcctatttctgccaggaccgcttctactggcgcgtgagttcccggagtgagttgaaccaggtggaccaagtgggctacgtgacctatgacatc

SEQ ID NO: 16764 - DNA, 201 bp, Homo sapiens
cgattctctgagggcagggggagccggccgcagggccccttccttatcgccgacaagtggcccgcgctgccccgcaagctggactcggtctttgaggagcsgctctccaagaagcttttcttcttctctgggcgccaggtgtgggtgtacacaggcgcgtcggtgctgggcccgaggcgtctggacaagctgggcctgggc

SEQ ID NO: 16765 - DNA, 178 bp, Homo sapiens
agacacctctgccctcaccatgagcctctggcagcccctggtcctggtgctcctggtgctgggctgctgctttgctgyccccagacagcgccagtccacccttgtgctcttccctggagacctgagaaccaatctcaccgacaggcagctggcagaggaatacctgtaccgctatggt

SEQ ID NO: 16766 - DNA, 201 bp, Homo sapiens
actactcggaagacttgccgcgggcggtgattgacgacgcctttgcccgcgccttcgcactgtggagcgcggtgacgccgctcaccttcactcgcgtgtasagccgggacgcagacatcgtcatccagtttggtgtcgcggagcacggagacgggtatcccttcgacgggaaggacgggctcctggcacacgcctttcctc

SEQ ID NO: 16767 - DNA, 201 bp, Homo sapiens
tggtggatccccggagcgccagcgaggtggaccggatgttccccggggtgcctttggacacgcacgacgtcttccagtaccgagagaaagcctatttctgycaggaccgcttctactggcgcgtgagttcccggagtgagttgaaccaggtggaccaagtgggctacgtgacctatgacatcctgcagtgccctgaggact

SEQ ID NO: 16768 - DNA, 164 bp, Homo sapiens
agacacctctgccctcaccatgagcctctggcagcccctggtcctggtgctcctggtgctgggytgctgctttgctgcccccagacagcgccagtccacccttgtgctcttccctggagacctgagaaccaatctcaccgacaggcagctggcagaggaatacc

SEQ ID NO: 16769 - DNA, 201 bp, Homo sapiens
accgcttctactggcgcgtgagttcccggagtgagttgaaccaggtggaccaagtgggctacgtgacctatgacatcctgcagtgccctgaggactagggytcccgtcctgctttggcagtgccatgtaaatccccactgggaccaaccctggggaaggagccagtttgccggatacaaactggtattctgttctggagga

SEQ ID NO: 16770 - DNA, 201 bp, Homo sapiens
gtccagagctctatgaaaacattgctgaatggattgtggctcattggtgggcagtattacttatgggaattgctctgatcatgctaatggctggatttatyaagatatgcagtgttcatactccaagtagtaatccaaagttgcctcctcctaaaccacttccaggcactttaaagaggaggagacctccacagcccattc

SEQ ID NO: 16771 - DNA, 201 bp, Homo sapiens
tgtatgctgtatgaagaaaatggacccatcaacttgtgccagtacagggtctgtgcagtggagtaggcacttcagtggtcgaaccatcaccctgcaacctkgatccccttgcaacgattttagaggttactgtgatgttttcatgcggtgcagattagtagatgctgatggtcctctagctaggcttaaaaaagcaatttt

SEQ ID NO: 16772 - DNA, 201 bp, Homo sapiens
aaatcctttccgtttcccaaatattggtgtggagaagtttctggaattgaattctgagcagaatcatgatgactactgtttggcctatgtcttcacagacmgagattttgatgatggcgtacttggtctggcttgggttggagcaccttcaggaagctctggaggaatatgtgaaaaaagtaaactctattcagatggtaa

SEQ ID NO: 16773 - DNA, 141 bp, Homo sapiens
caggaagcggcggcaggcctagcagcacgggaaccgtcccmcgcgcgcatgcgcgcgcccctgaagcgcctgggggacgggtaggggcgggaggtaggggcgcggctccgcgtgccagttgggtgcccgcgcgtcacgtgg

SEQ ID NO: 16774 - DNA, 201 bp, Homo sapiens
aacttcactccaaagagaaacctattaagtcatcatctccaaactaaaccctcacaagtaacagttgaagaaaaaatggcaagagttccaatttgggggtkggaggtggaaaaggaacccaattttcttatgaacagatatttttaacttaatggcacaaagtcttagaatattattatgtgccccgtgttccctgttctt

SEQ ID NO: 16775 - DNA, 201 bp, Homo sapiens; identical to SEQ ID NO: 16770

SEQ ID NO: 16776 - DNA, 201 bp, Homo sapiens; identical to SEQ ID NO: 16771

SEQ ID NO: 16777 - DNA, 201 bp, Homo sapiens; identical to SEQ ID NO: 16772

SEQ ID NO: 16778 - DNA, 141 bp, Homo sapiens; identical to SEQ ID NO: 16773

SEQ ID NO: 16779 - DNA, 201 bp, Homo sapiens
cctcacaagtaacagttgaagaaaaaatggcaagagatcatatcctcagaccaggtggaattacttaaattttaaagcctgaaaattccaatttgggggtkggaggtggaaaaggaacccaattttcttatgaacagatatttttaacttaatggcacaaagtcttagaatattattatgtgccccgtgttccctgttctt

SEQ ID NO: 16780 - DNA, 201 bp, Homo sapiens; identical to SEQ ID NO: 16770

SEQ ID NO: 16781 - DNA, 201 bp, Homo sapiens; identical to SEQ ID NO: 16771

SEQ ID NO: 16782 - DNA, 201 bp, Homo sapiens; identical to SEQ ID NO: 16772

SEQ ID NO: 16783 - DNA, 201 bp, Homo sapiens; identical to SEQ ID NO: 16774

SEQ ID NO: 16784 - DNA, 201 bp, Homo sapiens
ctcagaatcccatacagctcccaggcgatctccctggcacctcgtacgatgccaaccggcagtgccagtttacatttggggaggactccaaacactgcccygatgcagccagcacatgtagcaccttgtggtgtaccggcacctctggtggggtgctggtgtgtcaaaccaaacacttcccgtgggcggatggcaccagct

SEQ ID NO: 16785 - DNA, 201 bp, Homo sapiens
cgtcggcggcacgtgcggggtcgtggacgacgagccccggccgactgggaaagcggagaccgaagacgaggacgaagggactgagggcgaggacgaagggsctcagtggtcgccgcaggacccggcactgcaaggcgtaggacagcccacaggaactggaagcataagaaagaagcgatttgtgtccagtcaccgctatgt

SEQ ID NO: 16786 - DNA, 201 bp, Homo sapiens
gcctcgccaccgccgccccaggggagaagccgccggcaccactacagttccacctcctgcggcggaatcggcagggcgacgtcggcggcacgtgcggggtsgtggacgacgagccccggccgactgggaaagcggagaccgaagacgaggacgaagggactgagggcgaggacgaaggggctcagtggtcgccgcaggacc

SEQ ID NO: 16787 - DNA, 201 bp, Homo sapiens
tgcccgccgccagcgagcgcctcgccaccgccgccccaggggagaagccgccggcaccactacagttccacctcctgcggcggaatcggcagggcgacgtmggcggcacgtgcggggtcgtggacgacgagccccggccgactgggaaagcggagaccgaagacgaggacgaagggactgagggcgaggacgaaggggctc

SEQ ID NO: 16788 - DNA, 201 bp, Homo sapiens
ctccaatgcagcgagctgtgcccgaggggttcggaaggcgcaagctgggcagcgacatggggaacgcggagcgggctccggggtctcggagctttgggccmgtacccacgctgctgctgctcgccgcggcgctactggccgtgtcggacgcactcgggcgcccctccgaggaggacgaggagctagtggtgccggagctgg

SEQ ID NO: 16789 - DNA, 201 bp, Homo sapiens
  misc_feature (1)...(201): n = A,T,C or G, or insertion/deletion polymorphism (see Tables 1-2)
accaacatcgaagtgaaacagcggaaccagaggggatccaggaacaatggcagctttcttgccatcaaagctgctgatggcacatatattcttaatggtgnctacactttgtccaccttagagcaagacattatgtacaaaggtgttgtcttgaggtacagcggctcctctgcggcattggaaagaattcgcagctttagc

SEQ ID NO: 16790 - DNA, 201 bp, Homo sapiens
gtcccagcagagccactctgcctgcgcctgcctctcagtgtctccaactttgcgctggaagaaaaacttcccgcgcgccggcagaactgcagcgcctcctyttagtgactccgggagcttcggctgtagccggctctgcgcgcccttccaacgaataatagaaattgttaattttaacaatccagagcaggccaacgaggc

SEQ ID NO: 16791 - DNA, 201 bp, Homo sapiens
gaggtgtgtagaacagggtcccacaggtttggggacattgagatcacttgtcttgtggtggggaggctgctgaggggtagcaggtccatctccagcagctkgtccaacagtcgtatcctggtgaatgtctgttcagctcttctgtgagaatatgattttttccatatgtatatagtaaaatatgttactataaattacatg

SEQ ID NO: 16792 - DNA, 201 bp, Homo sapiens
cggcaagtgtgtgaacaaaaccgacagaaagcattttgatacgccttttcatggaagctggggaatgtgggggccttggggagactgttcgagaacgtgcrgtggaggagtccagtacacgatgagggaatgtgacaacccagtcccaaagaatggagggaagtactgtgaaggcaaacgagtgcgctacagatcctgtaa

SEQ ID NO: 16793 - DNA, 201 bp, Homo sapiens
ctcgccgcggcgctactggccgtgtcggacgcactcgggcgcccctccgaggaggacgaggagctagtggtgccggagctggagcgcgccccgggacacgrgaccacgcgcctccgcctgcacgcctttgaccagcagctggatctggagctgcggcccgacagcagctttttggcgcccggcttcacgctccagaacgtg

SEQ ID NO: 16794 - DNA, 201 bp, Homo sapiens
aagtgagattttactaagacctgttttactttacctcactaacaatggggggagaaaggagtacaaataggatctttgaccagcactgtttatggctgctrtggtttcagagaatgtttatacattatttctaccgagaattaaaacttcagattgttcaacatgagagaaaggctcagcaacgtgaaataacgcaaatgg

SEQ ID NO: 16795 - DNA, 201 bp, Homo sapiens
tagccggctctgcgcgcccttccaacgaataatagaaattgttaattttaacaatccagagcaggccaacgaggctttgctctcccgacccgaactaaagstccctcgctccgtgcgctgctacgagcggtgtctcctggggctccaatgcagcgagctgtgcccgaggggttcggaaggcgcaagctgggcagcgacatg

SEQ ID NO: 16796 - DNA, 201 bp, Homo sapiens
atgaaaatcagtacaatcacacaaggaggatgaaacgccggaacaaaaatgaggtgtgtagaacagggtcccacaggtttggggacattgagatcacttgycttgtggtggggaggctgctgaggggtagcaggtccatctccagcagctggtccaacagtcgtatcctggtgaatgtctgttcagctcttctgtgagaat

SEQ ID NO: 16797 - DNA, 201 bp, Homo sapiens
atgggggtagatagaaaaggagttgaatcatcagagtaaactgccagttgcaaatttgataggatagttagtgaggattattaacctctgagcagtgatayagcataataaagccccgggcattattattattatttcttttgttacatctattacaagtttagaaaaaacaaagcaattgtcaaaaaaagttagaactat

SEQ ID NO: 16798 - DNA, 201 bp, Homo sapiens; identical to SEQ ID NO: 16784

SEQ ID NO: 16799 - DNA, 201 bp, Homo sapiens; identical to SEQ ID NO: 16785

SEQ ID NO: 16800 - DNA, 201 bp, Homo sapiens; identical to SEQ ID NO: 16786

SEQ ID NO: 16801 - DNA, 201 bp, Homo sapiens; identical to SEQ ID NO: 16787

SEQ ID NO: 16802 - DNA, 201 bp, Homo sapiens; identical to SEQ ID NO: 16788

SEQ ID NO: 16803 - DNA, 201 bp, Homo sapiens; identical to SEQ ID NO: 16789
  misc_feature (1)...(201): n = A,T,C or G, or insertion/deletion polymorphism (see Tables 1-2)

SEQ ID NO: 16804 - DNA, 201 bp, Homo sapiens; identical to SEQ ID NO: 16790

SEQ ID NO: 16805 - DNA, 145 bp, Homo sapiens
gaggtgtgtagaacagggtcccacaggtttggggacattgagatcacttgtcttgtggtggggaggctgctgaggggtagcaggtccatctccagcagctkgtccaacagtcgtatcctggtgaatgtctgttcagctcttctgt

SEQ ID NO: 16806 - DNA, 201 bp, Homo sapiens; identical to SEQ ID NO: 16792

SEQ ID NO: 16807 - DNA, 201 bp, Homo sapiens; identical to SEQ ID NO: 16793

SEQ ID NO: 16808 - DNA, 201 bp, Homo sapiens; identical to SEQ ID NO: 16794

SEQ ID NO: 16809 - DNA, 201 bp, Homo sapiens; identical to SEQ ID NO: 16795

SEQ ID NO: 16810 - DNA, 195 bp, Homo sapiens
atgaaaatcagtacaatcacacaaggaggatgaaacgccggaacaaaaatgaggtgtgtagaacagggtcccacaggtttggggacattgagatcacttgycttgtggtggggaggctgctgaggggtagcaggtccatctccagcagctggtccaacagtcgtatcctggtgaatgtctgttcagctcttctgt

SEQ ID NO: 16811 - DNA, 201 bp, Homo sapiens; identical to SEQ ID NO: 16797

SEQ ID NO: 16812 - DNA, 201 bp, Homo sapiens; identical to SEQ ID NO: 16785

SEQ ID NO: 16813 - DNA, 201 bp, Homo sapiens; identical to SEQ ID NO: 16786

SEQ ID NO: 16814 - DNA, 201 bp, Homo sapiens; identical to SEQ ID NO: 16787

SEQ ID NO: 16815 - DNA, 201 bp, Homo sapiens; identical to SEQ ID NO: 16788

SEQ ID NO: 16816 - DNA, 201 bp, Homo sapiens; identical to SEQ ID NO: 16795

SEQ ID NO: 16817 - DNA, 201 bp, Homo sapiens; identical to SEQ ID NO: 16791

SEQ ID NO: 16818 - DNA, 201 bp, Homo sapiens
agtgagattttactaagacctgttttactttaccttcactaacaatggggggagaaaggagtacaaataggatctttgaccagcactgtttatggctgctrtggtttcagagaatgtttatacattatttctaccgagaattaaaacttcagattgttcaacatgagagaaaggctcagcaacgtgaaataacgcaaatgg

SEQ ID NO: 16819 - DNA, 201 bp, Homo sapiens; identical to SEQ ID NO: 16792

SEQ ID NO: 16820 - DNA, 201 bp, Homo sapiens; identical to SEQ ID NO: 16793

SEQ ID NO: 16821 - DNA, 201 bp, Homo sapiens; identical to SEQ ID NO: 16789
  misc_feature (1)...(201): n = A,T,C or G, or insertion/deletion polymorphism (see Tables 1-2)

SEQ ID NO: 16822 - DNA, 201 bp, Homo sapiens; identical to SEQ ID NO: 16784

SEQ ID NO: 16823 - DNA, 132 bp, Homo sapiens
acacttttggaaaaaaaaaaaaaaaaaaaaayttagtgactccgggagcttcggctgtagccggctctgcgcgcccttccaacgaataatagaaattgttaattttaacaatccagagcaggccaacgaggc

SEQ ID NO: 16824 - DNA, 201 bp, Homo sapiens; identical to SEQ ID NO: 16796

SEQ ID NO: 16825 - DNA, 201 bp, Homo sapiens; identical to SEQ ID NO: 16797

SEQ ID NO: 16826 - DNA, 201 bp, Homo sapiens
ccttccgccgcgccgtaggtttgttgcctcaccagtgcgcccgccggagggtgtttatcgcggctagagagatgtcgctgctgcggtcgctgcgcgtgttyctggtcgcgcggaccgggagctacccggctgggtctcttctgcgtcagtcgccccagccaaggcacacattttatgctgggccccgtctgtctgcctcgg

SEQ ID NO: 16827 - DNA, 107 bp, Homo sapiens
atgtgtygtctcaagaaatcaagtagaggcgaggactgtgttcctccggccagcaggtggcaccatactcgtttggtgcgttccgctggagaattctggcccttccg

SEQ ID NO: 16828 - DNA, 201 bp, Homo sapiens
attaaatagttgtataataaaaataattttttccttgtttgcgtaatactggatttagcttttctgtgcctttcaaaaacaacaggtgggccttattgacrtgatagtgtcgtggagaacaggcatcaacaatactgctgctcccttcaacatagatttattatggtatttctgaaatttctaacttatatgttctgtctt

SEQ ID NO: 16829 - DNA, 201 bp, Homo sapiens
gtgcgttccgctggagaattctggcccttccgccgcgccgtaggtttgttgcctcaccagtgcgcccgccggagggtgtttatcgcggctagagagatgtygctgctgcggtcgctgcgcgtgtttctggtcgcgcggaccgggagctacccggctgggtctcttctgcgtcagtcgccccagccaaggcacacattttat

SEQ ID NO: 16830 - DNA, 201 bp, Homo sapiens
gaagtatggggccctggtcatctgtgagacgtctgaacagaaaacaaaccttgaagacgttggccgccgccttgggcagcatgtggtgggcatggcccccmtctctgttggctccctggacgatgagcctgggggagaggcagagactaagatgctgtcccagccgtatttgctggatccctccattaccttggggcagta

SEQ ID NO: 16831 - DNA, 201 bp, Homo sapiens; identical to SEQ ID NO: 16826

SEQ ID NO: 16832 - DNA, 107 bp, Homo sapiens; identical to SEQ ID NO: 16827

SEQ ID NO: 16833 - DNA, 145 bp, Homo sapiens
tccaaattggagctgtctctgaacttcagcttcctgaatccaacttcttgcagaacacctcctcttgactgctctaagcaccttaaaaataacaccttcargatgtagctcttctttactaaacttgtatctgagtctccacttt

SEQ ID NO: 16834 - DNA, 201 bp, Homo sapiens; identical to SEQ ID NO: 16829

SEQ ID NO: 16835 - DNA, 201 bp, Homo sapiens; identical to SEQ ID NO: 16826

SEQ ID NO: 16836 - DNA, 107 bp, Homo sapiens; identical to SEQ ID NO: 16827

SEQ ID NO: 16837 - DNA, 201 bp, Homo sapiens; identical to SEQ ID NO: 16828

SEQ ID NO: 16838 - DNA, 201 bp, Homo sapiens; identical to SEQ ID NO: 16829

SEQ ID NO: 16839 - DNA, 201 bp, Homo sapiens; identical to SEQ ID NO: 16830

SEQ ID NO: 16840 - DNA, 201 bp, Homo sapiens
gactttgtgctgacagcagctcattgctggggaagcaatataaatgtcaccctgggcgcccacaatatccagagacgggaaaacacccagcaacacatcaytgcgcgcagagccatccgccaccctcaatataatcagcggaccatccagaatgacatcatgttattgcagctgagcagaagagtcagacggaatcgaaac

SEQ ID NO: 16841 - DNA, 182 bp, Homo sapiens
agcacagcagcaactgactgggcagcctttcaggaaagatgcagccactcctgcttctgctggcctttctcctacccactgsggctgaggcaggggagatcatcggaggccgggagagcaggccccactcccgcccctacatggcgtatcttcagatccagagtccagcaggtcagagcaga

SEQ ID NO: 16842 - DNA, 201 bp, Homo sapiens
ccggaggccccctgctgtgtaacaatgtggcccacggcatcgtctcctatggaaagtcgtcaggggttcctccagaagtcttcaccagggtctcaagtttyctgccctggataaggacaacaatgagaagcttcaaactgctggatcagatggagacccccctgtgactgactcttcttctcggggacacaggccagctcc

SEQ ID NO: 16843 - DNA, 201 bp, Homo sapiens
cgcagagccatccgccaccctcaatataatcagcggaccatccagaatgacatcatgttattgcagctgagcagaagagtcagacggaatcgaaacgtgarcccagtggctctgcctagagcccaggagggactgagacccgggacgctgtgcactgtggccggctggggcagggtcagcatgaggaggggaacagataca

SEQ ID NO: 16844 - DNA, 201 bp, Homo sapiens
tctacagcatcctgctctttgacctcatctaccgcgaggagacgctgttcaacgtcatcaagagtgtgacccgcaatggccgctccatcctgctgacagcyctgctggccctcatcctggtctacctcttctccatcgtcggcttcctcttcctcaaggatgacttcattctcgaggtcgaccggctgcccaacaaccact

SEQ ID NO: 16845 - DNA, 201 bp, Homo sapiens
tgggctacatcctgaccagtgtcctgggcctctttgctcatgagctgttctacagcatcctgctctttgacctcatctaccgcgaggagacgctgttcaaygtcatcaagagtgtgacccgcaatggccgctccatcctgctgacagccctgctggccctcatcctggtctacctcttctccatcgtcggcttcctcttcc

SEQ ID NO: 16846 - DNA, 201 bp, Homo sapiens
ccaaagatgagtctctcttcccagcccgagtggtctatgacctcctgttcttcttcatcgtcatcatcattgtgctgaacctcatctttggggtaatcatygacaccttcgctgacctgcgtagtgagaagcagaagaaggaggagattcttaagacgacatgcttcatctgtggtctggagagggacaagtttgataaca

SEQ ID NO: 16847 - DNA, 201 bp, Homo sapiens
ctgcatttgtggacacctgcagtggggacaagatggactgtgtctcagggctctcggtgcctgaggtcctggaagaggacagggagctggacagcacagarcgggcctgtgacactctgttgatgtgcatcgtcactgtcatgaaccatgggctacgcaacggtggtggcgtgggcgacattctccgcaagccctccaaag

SEQ ID NO: 16848 - DNA, 201 bp, Homo sapiens
tcgtgaaccactgctacgtggacacggaggtggagatgaaggagatctacaccagcaaccacatctggacgctctttgagaacttcaccctggacatggcycgggtctgcagcaagcgtgagaagcgcgtggctgaccccaccttggagaagtacgtgctgagcgttgtgctggacaccatcaacgccttcttcagctccc

SEQ ID NO: 16849 - DNA, 201 bp, Homo sapiens
cagaagaggaagtgtggctcacgtggactgacaagaataacgagcatcatgagaagagtgtgaggcagctggcccaggaggcgcgggccggcaacgcccaygacgagaatgtgctcagctactacaggtaccagctgaagctctttgcccgcatgtgcttggaccgccagtacttggccatcgacgagatctcccagcagc

SEQ ID NO: 16850 - DNA, 201 bp, Homo sapiens
tcagctcgatgctcagcagtggagccagctgtgcagctgccgcccagcggaacgcctccagctacaaggcaaccacgcgggccttcccccgcgtcaccccyaccgccaaccagtgggactacaagaacatcattgagaagctgcaggacatcatcacagccctggaggagcggctgaagcccctggtacaggctgagctgt

SEQ ID NO: 16851 - DNA, 201 bp, Homo sapiens
ttggagtggggaagacaagcagcatgctggaggtggatgacgagggcggccgcatgttcctgcgcgtgctcatccacctcaccatgcacgactatgcgccrctggtctcgggtgccctgcagctgctcttcaagcacttcagccagcgccaggaggccatgcacaccttcaagcaggttcagctgctgatctcagcgcagg

SEQ ID NO: 16852 - DNA, 201 bp, Homo sapiens
cctccctgctgccgctggaggacgtggtgtctgtggtgacgcatgaggactgcatcactgaggtgaaaatggcctatgtgaacttcgtgaaccactgctaygtggacacggaggtggagatgaaggagatctacaccagcaaccacatctggacgctctttgagaacttcaccctggacatggctcgggtctgcagcaagc

SEQ ID NO: 16853 - DNA, 201 bp, Homo sapiens
ctctctgacctgtgtgtgtccaaccacatcgccatccccgtcacccaagagctcatctgcaagtgtgtgctggaccccaagaacagtgacattctcatccrgaccgagcttcggcccgtgaaggagatggcccaatcccacgagtacctgagcatcgagtactcagaagaggaagtgtggctcacgtggactgacaagaat

SEQ ID NO: 16854 - DNA, 201 bp, Homo sapiens
ctgctgagccgctggacagaagcaagtttgaggagaatgaggacattgtggtgatggagaccaagctgaagatcctggaaatccttcagttcatcctcaaygtccgcctggattaccgcatatcctacctgctgtctgtcttcaagaaggagtttgtggaggtgtttcccatgcaggacagtggggctgatggcacagccc

SEQ ID NO: 16855 - DNA, 201 bp, Homo sapiens
ttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcac

SEQ ID NO: 16856 - DNA, 201 bp, Homo sapiens
ggagatctacaccagcaaccacatctggacgctctttgagaacttcaccctggacatggctcgggtctgcagcaagcgtgagaagcgcgtggctgaccccmccttggagaagtacgtgctgagcgttgtgctggacaccatcaacgccttcttcagctccccattctctgagaacagcacttccctgcagacacaccagac

SEQ ID NO: 16857 - DNA, 201 bp, Homo sapiens
ggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctg

SEQ ID NO: 16858 - DNA, 201 bp, Homo sapiens
tggcagtcaacatgaatgacctgggcagccagccacatgaggaccgcgagccagtcgaccccaccaccaaaggccgcgtggcctccttctcgatacctggytcctcatcccgctactcgctgggccccagcctgcgccgggggcacgaggtgagcgaacgtgtgcagagcagtgagatgggcacatccgtgctcatcatgc

SEQ ID NO: 16859 - DNA, 201 bp, Homo sapiens
gaggaccgcgagccagtcgaccccaccaccaaaggccgcgtggcctccttctcgatacctggctcctcatcccgctactcgctgggccccagcctgcgccrggggcacgaggtgagcgaacgtgtgcagagcagtgagatgggcacatccgtgctcatcatgcagcccatcctgcgctttctgcagctgctgtgtgagaac

SEQ ID NO: 16860 - DNA, 201 bp, Homo sapiens
agaatgtgctcagctactacaggtaccagctgaagctctttgcccgcatgtgcttggaccgccagtacttggccatcgacgagatctcccagcagctgggygtggacctgattttcctgtgcatggcagacgagatgctgccctttgacctgcgcgcctccttctgccacctgatgctgcacgtgcacgtggaccgtgacc

SEQ ID NO: 16861 - DNA, 201 bp, Homo sapiens
gcccaacaaccactccacagccagccccctggggatgccacatggagctgctgcatttgtggacacctgcagtggggacaagatggactgtgtctcagggstctcggtgcctgaggtcctggaagaggacagggagctggacagcacagagcgggcctgtgacactctgttgatgtgcatcgtcactgtcatgaaccatgg

SEQ ID NO: 16862 - DNA, 201 bp, Homo sapiens
ggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtg

SEQ ID NO: 16863 - DNA, 201 bp, Homo sapiens
agaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactc

SEQ ID NO: 16864 - DNA, 201 bp, Homo sapiens
ccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcc

SEQ ID NO: 16865 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaa

SEQ ID NO: 16866 - DNA, 201 bp, Homo sapiens
aggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccct

SEQ ID NO: 16867 - DNA, 201 bp, Homo sapiens
aggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 16868 - DNA, 201 bp, Homo sapiens
ccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctc

SEQ ID NO: 16869 - DNA, 201 bp, Homo sapiens
gcagcaggataaaccgcctcgtttccggaggctgaagcaggaacgggagaatgccgcaagggggtctgagggcaagccctccctaacccttccagcctccrctcctggacctgaggaggccctcacaacagtcacagtggccccagcacctcgccgggcagctgccaagtctcctgatctgtcaaaccagaactcagacca

SEQ ID NO: 16870 - DNA, 201 bp, Homo sapiens; identical to SEQ ID NO: 16866

SEQ ID NO: 16871 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaagtcgtcctccagaggagcgtcccccggg

SEQ ID NO: 16872 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagt

SEQ ID NO: 16873 - DNA, 201 bp, Homo sapiens
acaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggca

SEQ ID NO: 16874 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactc

SEQ ID NO: 16875 - DNA, 201 bp, Homo sapiens
gataaaccgcctcgtttccggaggctgaagcaggaacgggagaatgccgcaagggggtctgagggcaagccctccctaacccttccagcctccgctcctgsacctgaggaggccctcacaacagtcacagtggccccagcacctcgccgggcagctgccaagtctcctgatctgtcaaaccagaactcagaccaagccaat

SEQ ID NO: 16876 - DNA, 201 bp, Homo sapiens
aggctgcggatgaggatgacaaggggatgaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 16877 - DNA, 201 bp, Homo sapiens
ccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgcc

SEQ ID NO: 16878 - DNA, 201 bp, Homo sapiens; identical to SEQ ID NO: 16863

SEQ ID NO: 16879 - DNA, 201 bp, Homo sapiens
ggctgcggatgaggatgacaaggggatgaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 16880 - DNA, 201 bp, Homo sapiens; identical to SEQ ID NO: 16864

SEQ ID NO: 16881 - DNA, 201 bp, Homo sapiens
cggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctaccccccggcccagcccctccctcag

SEQ ID NO: 16882 - DNA, 201 bp, Homo sapiens
ggggagccatggactctcaattacatccaaacagtggaggcttccgccctgggacaccctcactgcacccttacagatcacagcccctatacctacccccsggcccagcccctccctcagcactgctctctggggtagctctcaagggccagtttctggatttctccacaatgcaagctacagagctggggaagttgccgg

SEQ ID NO: 16883 - DNA, 201 bp, Homo sapiens
  misc_feature (1)...(201): n = A,T,C or G, or insertion/deletion polymorphism (see Tables 1-2)
cctaggagaccaccacctgccccccacgatggggacagaaaggagctgccccgggagcagcctctgccccctggccccattggcacagaacgatcacagcntacagaccgaggcacagagcctggccccattcggccatcccatcgacctggtcccccagtccagtttggcactagtgacaaggactcagacttacgccta

SEQ ID NO: 16884 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggca

SEQ ID NO: 16885 - DNA, 201 bp, Homo sapiens
tacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 16886 - DNA, 201 bp, Homo sapiens
tctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcggcctcccagaaaaccagagctgctacaggaggaatctttgcca

SEQ ID NO: 16887 - DNA, 191 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 16888 - DNA, 201 bp, Homo sapiens
cacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccg

SEQ ID NO: 16889 - DNA, 201 bp, Homo sapiens
attggcacagaacgatcacagcgtacagaccgaggcacagagcctggccccattcggccatcccatcgacctggtcccccagtccagtttggcactagtgrcaaggactcagacttacgcctagtggtaggagacagcttgaaagcagagaaggagctaacagcatcagtcactgaggccattcctgtatcacgagactgg

SEQ ID NO: 16890 - DNA, 201 bp, Homo sapiens
ccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagt

SEQ ID NO: 16891 - DNA, 201 bp, Homo sapiens
tacagaccgaggcacagagcctggccccattcggccatcccatcgacctggtcccccagtccagtttggcactagtgacaaggactcagacttacgcctartggtaggagacagcttgaaagcagagaaggagctaacagcatcagtcactgaggccattcctgtatcacgagactgggagctgcttcccagtgctgctgc

SEQ ID NO: 16892 - DNA, 201 bp, Homo sapiens
ccccagtccagtttggcactagtgacaaggactcagacttacgcctagtggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagc

SEQ ID NO: 16893 - DNA, 201 bp, Homo sapiens
tggaggcttccgccctgggacaccctcactgcacccttacagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 16894 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaaggtccttctctggcctcaattcccgtctcaaggccacgccttccacctacagtggagtcttccgcacccagcgcgtcgacct

SEQ ID NO: 16895 - DNA, 201 bp, Homo sapiens
ctgcatccagtggaactaaagccgttccaggattatcaaaaactgagcagcaaccttgggggacctggatcatcacggactcccccaactggaaggtcctyctctggcctcaattcccgtctcaaggccacgccttccacctacagtggagtcttccgcacccagcgcgtcgacctttaccagcaggcctccccaccagat

SEQ ID NO: 16896 - DNA, 201 bp, Homo sapiens
cgttccaggattatcaaaaactgagcagcaaccttgggggacctggatcatcacggactcccccaactggaaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 16897 - DNA, 201 bp, Homo sapiens; identical to SEQ ID NO: 16867

SEQ ID NO: 16898 - DNA, 201 bp, Homo sapiens; identical to SEQ ID NO: 16868

SEQ ID NO: 16899 - DNA, 201 bp, Homo sapiens; identical to SEQ ID NO: 16865

SEQ ID NO: 16900 - DNA, 201 bp, Homo sapiens; identical to SEQ ID NO: 16866

SEQ ID NO: 16901 - DNA, 201 bp, Homo sapiens; identical to SEQ ID NO: 16869

SEQ ID NO: 16902 - DNA, 201 bp, Homo sapiens; identical to SEQ ID NO: 16871

SEQ ID NO: 16903 - DNA, 201 bp, Homo sapiens; identical to SEQ ID NO: 16872

SEQ ID NO: 16904 - DNA, 201 bp, Homo sapiens; identical to SEQ ID NO: 16873

SEQ ID NO: 16905 - DNA, 201 bp, Homo sapiens; identical to SEQ ID NO: 16874

SEQ ID NO: 16906 - DNA, 201 bp, Homo sapiens; identical to SEQ ID NO: 16875

SEQ ID NO: 16907 - DNA, 201 bp, Homo sapiens; identical to SEQ ID NO: 16863

SEQ ID NO: 16908 - DNA, 201 bp, Homo sapiens; identical to SEQ ID NO: 16876

SEQ ID NO: 16909 - DNA, 201 bp, Homo sapiens; identical to SEQ ID NO: 16877

SEQ ID NO: 16910 - DNA, 201 bp, Homo sapiens; identical to SEQ ID NO: 16864

SEQ ID NO: 16911 - DNA, 201 bp, Homo sapiens; identical to SEQ ID NO: 16879

SEQ ID NO: 16912 - DNA, 201 bp, Homo sapiens; identical to SEQ ID NO: 16881

SEQ ID NO: 16913 - DNA, 201 bp, Homo sapiens; identical to SEQ ID NO: 16882

SEQ ID NO: 16914 - DNA, 201 bp, Homo sapiens; identical to SEQ ID NO: 16883
  misc_feature (1)...(201): n = A,T,C or G, or insertion/deletion polymorphism (see Tables 1-2)

SEQ ID NO: 16915 - DNA, 201 bp, Homo sapiens; identical to SEQ ID NO: 16884

SEQ ID NO: 16916 - DNA, 201 bp, Homo sapiens; identical to SEQ ID NO: 16885

SEQ ID NO: 16917 - DNA, 201 bp, Homo sapiens; identical to SEQ ID NO: 16886

SEQ ID NO: 16918 - DNA, 190 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattt

SEQ ID NO: 16919 - DNA, 201 bp, Homo sapiens; identical to SEQ ID NO: 16888

SEQ ID NO: 16920 - DNA, 201 bp, Homo sapiens; identical to SEQ ID NO: 16889

SEQ ID NO: 16921 - DNA, 201 bp, Homo sapiens; identical to SEQ ID NO: 16890

SEQ ID NO: 16922 - DNA, 201 bp, Homo sapiens; identical to SEQ ID NO: 16891

SEQ ID NO: 16923 - DNA, 201 bp, Homo sapiens; identical to SEQ ID NO: 16892

SEQ ID NO: 16924 - DNA, 201 bp, Homo sapiens; identical to SEQ ID NO: 16893

SEQ ID NO: 16925 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaagacgcccttcttcccttaggtccttctctggcctcaattcccgtctcaaggccacgccttccacctacagtggagtcttccg

SEQ ID NO: 16926 - DNA, 201 bp, Homo sapiens
aagccgttccaggattatcaaaaactgagcagcaaccttgggggacctggatcatcacggactcccccaactggaagacgcccttcttcccttaggtcctyctctggcctcaattcccgtctcaaggccacgccttccacctacagtggagtcttccgcacccagcgcgtcgacctttaccagcaggcctccccaccagat

SEQ ID NO: 16927 - DNA, 201 bp, Homo sapiens
aactgagcagcaaccttgggggacctggatcatcacggactcccccaactggaagacgcccttcttcccttaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 16928 - DNA, 201 bp, Homo sapiens; identical to SEQ ID NO: 16867

SEQ ID NO: 16929 - DNA, 201 bp, Homo sapiens; identical to SEQ ID NO: 16868

SEQ ID NO: 16930 - DNA, 201 bp, Homo sapiens; identical to SEQ ID NO: 16865

SEQ ID NO: 16931 - DNA, 201 bp, Homo sapiens; identical to SEQ ID NO: 16866

SEQ ID NO: 16932 - DNA, 201 bp, Homo sapiens; identical to SEQ ID NO: 16869

SEQ ID NO: 16933 - DNA, 201 bp, Homo sapiens; identical to SEQ ID NO: 16871

SEQ ID NO: 16934 - DNA, 201 bp, Homo sapiens; identical to SEQ ID NO: 16872

SEQ ID NO: 16935 - DNA, 201 bp, Homo sapiens; identical to SEQ ID NO: 16873

SEQ ID NO: 16936 - DNA, 201 bp, Homo sapiens; identical to SEQ ID NO: 16874

SEQ ID NO: 16937 - DNA, 201 bp, Homo sapiens; identical to SEQ ID NO: 16875

SEQ ID NO: 16938 - DNA, 201 bp, Homo sapiens; identical to SEQ ID NO: 16863

SEQ ID NO: 16939 - DNA, 201 bp, Homo sapiens; identical to SEQ ID NO: 16876

SEQ ID NO: 16940 - DNA, 201 bp, Homo sapiens; identical to SEQ ID NO: 16877

SEQ ID NO: 16941 - DNA, 201 bp, Homo sapiens; identical to SEQ ID NO: 16864

SEQ ID NO: 16942 - DNA, 201 bp, Homo sapiens; identical to SEQ ID NO: 16879

SEQ ID NO: 16943 - DNA, 201 bp, Homo sapiens; identical to SEQ ID NO: 16881

SEQ ID NO: 16944 - DNA, 201 bp, Homo sapiens; identical to SEQ ID NO: 16882

SEQ ID NO: 16945 - DNA, 201 bp, Homo sapiens; identical to SEQ ID NO: 16883
  misc_feature (1)...(201): n = A,T,C or G, or insertion/deletion polymorphism (see Tables 1-2)

SEQ ID NO: 16946 - DNA, 201 bp, Homo sapiens; identical to SEQ ID NO: 16884

SEQ ID NO: 16947 - DNA, 201 bp, Homo sapiens; identical to SEQ ID NO: 16885

SEQ ID NO: 16948 - DNA, 201 bp, Homo sapiens; identical to SEQ ID NO: 16886

SEQ ID NO: 16949 - DNA, 191 bp, Homo sapiens; identical to SEQ ID NO: 16887

SEQ ID NO: 16950 - DNA, 201 bp, Homo sapiens; identical to SEQ ID NO: 16888

SEQ ID NO: 16951 - DNA, 201 bp, Homo sapiens; identical to SEQ ID NO: 16889

SEQ ID NO: 16952 - DNA, 201 bp, Homo sapiens; identical to SEQ ID NO: 16890

SEQ ID NO: 16953 - DNA, 201 bp, Homo sapiens; identical to SEQ ID NO: 16891

SEQ ID NO: 16954 - DNA, 201 bp, Homo sapiens; identical to SEQ ID NO: 16892

SEQ ID NO: 16955 - DNA, 201 bp, Homo sapiens; identical to SEQ ID NO: 16893

SEQ ID NO: 16956 - DNA, 201 bp, Homo sapiens; identical to SEQ ID NO: 16894

SEQ ID NO: 16957 - DNA, 201 bp, Homo sapiens; identical to SEQ ID NO: 16895

SEQ ID NO: 16958 - DNA, 201 bp, Homo sapiens; identical to SEQ ID NO: 16896

SEQ ID NO: 16959 - DNA, 201 bp, Homo sapiens; identical to SEQ ID NO: 16867

SEQ ID NO: 16960 - DNA, 201 bp, Homo sapiens; identical to SEQ ID NO: 16868

SEQ ID NO: 16961 - DNA, 201 bp, Homo sapiens; identical to SEQ ID NO: 16865

SEQ ID NO: 16962 - DNA, 201 bp, Homo sapiens; identical to SEQ ID NO: 16866

SEQ ID NO: 16963 - DNA, 201 bp, Homo sapiens; identical to SEQ ID NO: 16869

SEQ ID NO: 16964 - DNA, 201 bp, Homo sapiens; identical to SEQ ID NO: 16871

SEQ ID NO: 16965 - DNA, 201 bp, Homo sapiens; identical to SEQ ID NO: 16872

SEQ ID NO: 16966 - DNA, 201 bp, Homo sapiens; identical to SEQ ID NO: 16873

SEQ ID NO: 16967 - DNA, 201 bp, Homo sapiens; identical to SEQ ID NO: 16874

SEQ ID NO: 16968 - DNA, 201 bp, Homo sapiens; identical to SEQ ID NO: 16875

SEQ ID NO: 16969 - DNA, 201 bp, Homo sapiens; identical to SEQ ID NO: 16863

SEQ ID NO: 16970 - DNA, 201 bp, Homo sapiens; identical to SEQ ID NO: 16876

SEQ ID NO: 16971 - DNA, 201 bp, Homo sapiens; identical to SEQ ID NO: 16877

SEQ ID NO: 16972 - DNA, 201 bp, Homo sapiens; identical to SEQ ID NO: 16864

SEQ ID NO: 16973 - DNA, 201 bp, Homo sapiens; identical to SEQ ID NO: 16879

SEQ ID NO: 16974 - DNA, 201 bp, Homo sapiens; identical to SEQ ID NO: 16881

SEQ ID NO: 16975 - DNA, 201 bp, Homo sapiens; identical to SEQ ID NO: 16882

SEQ ID NO: 16976 - DNA, 201 bp, Homo sapiens; identical to SEQ ID NO: 16883
  misc_feature (1)...(201): n = A,T,C or G, or insertion/deletion polymorphism (see Tables 1-2)

SEQ ID NO: 16977 - DNA, 201 bp, Homo sapiens; identical to SEQ ID NO: 16884

SEQ ID NO: 16978 - DNA, 201 bp, Homo sapiens; identical to SEQ ID NO: 16885

SEQ ID NO: 16979 - DNA, 201 bp, Homo sapiens; identical to SEQ ID NO: 16886

SEQ ID NO: 16980 - DNA, 191 bp, Homo sapiens; identical to SEQ ID NO: 16887

SEQ ID NO: 16981 - DNA, 201 bp, Homo sapiens; identical to SEQ ID NO: 16888

SEQ ID NO: 16982 - DNA, 201 bp, Homo sapiens; identical to SEQ ID NO: 16889

SEQ ID NO: 16983 - DNA, 201 bp, Homo sapiens; identical to SEQ ID NO: 16890

SEQ ID NO: 16984 - DNA, 201 bp, Homo sapiens; identical to SEQ ID NO: 16891

SEQ ID NO: 16985 - DNA, 201 bp, Homo sapiens; identical to SEQ ID NO: 16892

SEQ ID NO: 16986 - DNA, 201 bp, Homo sapiens; identical to SEQ ID NO: 16893

SEQ ID NO: 16987 - DNA, 201 bp, Homo sapiens; identical to SEQ ID NO: 16894

SEQ ID NO: 16988 - DNA, 201 bp, Homo sapiens; identical to SEQ ID NO: 16895

SEQ ID NO: 16989 - DNA, 201 bp, Homo sapiens; identical to SEQ ID NO: 16896

SEQ ID NO: 16990 - DNA, 201 bp, Homo sapiens
gtgggactgcccggggctgccaggacagcactactgcggccacaaagaggacgcgggcgcggtgtgctcagagcaccagtcctggcgcctgacagggggcrctgaccgctgcgaggggcaggtggaggtacacttccgaggggtctggaacacagtgtgtgacagtgagtggtacccatcggaggccaaggtgctctgcca

SEQ ID NO: 16991 - DNA, 201 bp, Homo sapiens
cccacatcccaactgccaaccctggacactgcattacagacccgccatccctgggccctcagtatcacccgaggagcaacagtgagtcgagcacctcttcrggggaggattactgcaatagtcccaaaagcaagctgcctccatggaacccccaggtgttttcttcagagaggagttccttcctggagcagcccccaaact

SEQ ID NO: 16992 - DNA, 201 bp, Homo sapiens
ctgccccactccttgtccggcaggatgtactactcatgcaatggggaggagctcaccctctccaactgctcctggcggttcaacaactccaacctctgcarccagtcgctggcagccagggtcctctgctcagcttcccggagtttgcacaatctgtccactcccgaagtccctgcaagtgttcagacagtcactatagaa

SEQ ID NO: 16993 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcagcagggcccccggctgatgacagctccagcacctcatccggggagtggtaccagaacttccagccaccaccccagcccc

SEQ ID NO: 16994 - DNA, 201 bp, Homo sapiens
tcagtgtgcgatgacacttgggacctggaggacgcccacgtggtgtgcaggcaactgggctgcggctgggcagtccaggccctgcccggcttgcacttcaygcccggccgcgggcctatccaccgggaccaggtgaactgctcgggggccgaagcttacctgtgggactgcccggggctgccaggacagcactactgcggc

SEQ ID NO: 16995 - DNA, 201 bp, Homo sapiens
gggagcaatagctatcaaccggtccccatcaccatccccaaagaagttttcatgctgcccatccaggtccaggccccgccccctgaggactcagactctgrctcggactcagactatgagcactatgacttcagcgcccagcctcctgtggccctgaccaccttctacaattcccagcggcatcgggtcacagatgaggag

SEQ ID NO: 16996 - DNA, 201 bp, Homo sapiens
caccgggaccaggtgaactgctcgggggccgaagcttacctgtgggactgcccggggctgccaggacagcactactgcggccacaaagaggacgcgggcgyggtgtgctcagagcaccagtcctggcgcctgacagggggcgctgaccgctgcgaggggcaggtggaggtacacttccgaggggtctggaacacagtgtgt

SEQ ID NO: 16997 - DNA, 201 bp, Homo sapiens; identical to SEQ ID NO: 16990

SEQ ID NO: 16998 - DNA, 201 bp, Homo sapiens; identical to SEQ ID NO: 16991

SEQ ID NO: 16999 - DNA, 201 bp, Homo sapiens; identical to SEQ ID NO: 16992

SEQ ID NO: 17000 - DNA, 185 bp, Homo sapiens
actgcaatagtcccaaaagcaagctgcctccatggaacccccaggtgttttcttcagagaggagttccttcctggagcagcccccaaacttggagctggcyggcacccagccagccttttcagggtcccccagccctcagcctgactccaccgacaacgatgactacgatgacatcagcgcagcc

SEQ ID NO: 17001 - DNA, 201 bp, Homo sapiens; identical to SEQ ID NO: 16994

SEQ ID NO: 17002 - DNA, 201 bp, Homo sapiens
ctcatcttcatagccttcatcctcttgagaattaaaggaaaatatgttttcatgctgcccatccaggtccaggccccgccccctgaggactcagactctgrctcggactcagactatgagcactatgacttcagcgcccagcctcctgtggccctgaccaccttctacaattcccagcggcatcgggtcacagatgaggag

SEQ ID NO: 17003 - DNA, 201 bp, Homo sapiens; identical to SEQ ID NO: 16996

SEQ ID NO: 17004 - DNA, 201 bp, Homo sapiens; identical to SEQ ID NO: 16990

SEQ ID NO: 17005 - DNA, 201 bp, Homo sapiens; identical to SEQ ID NO: 16991

SEQ ID NO: 17006 - DNA, 201 bp, Homo sapiens; identical to SEQ ID NO: 16992

SEQ ID NO: 17007 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcagggcccccggctgatgacagctccagcacctcatccggggagtggtaccagaacttccagccaccaccccagccccctt

SEQ ID NO: 17008 - DNA, 201 bp, Homo sapiens; identical to SEQ ID NO: 16994

SEQ ID NO: 17009 - DNA, 201 bp, Homo sapiens; identical to SEQ ID NO: 17002

SEQ ID NO: 17010 - DNA, 201 bp, Homo sapiens; identical to SEQ ID NO: 16996

SEQ ID NO: 17011 - DNA, 201 bp, Homo sapiens; identical to SEQ ID NO: 16990

SEQ ID NO: 17012 - DNA, 201 bp, Homo sapiens; identical to SEQ ID NO: 16991

SEQ ID NO: 17013 - DNA, 201 bp, Homo sapiens; identical to SEQ ID NO: 16992

SEQ ID NO: 17014 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcagggtcccccagccctcagcctgactccaccgacaacgatgactacgatgacatcagcgcagcctaggccggggccagcc

SEQ ID NO: 17015 - DNA, 201 bp, Homo sapiens; identical to SEQ ID NO: 16994

SEQ ID NO: 17016 - DNA, 201 bp, Homo sapiens; identical to SEQ ID NO: 16996

SEQ ID NO: 17017 - DNA, 201 bp, Homo sapiens; identical to SEQ ID NO: 16990

SEQ ID NO: 17018 - DNA, 201 bp, Homo sapiens; identical to SEQ ID NO: 16991

SEQ ID NO: 17019 - DNA, 201 bp, Homo sapiens; identical to SEQ ID NO: 16992

SEQ ID NO: 17020 - DNA, 201 bp, Homo sapiens; identical to SEQ ID NO: 16993

SEQ ID NO: 17021 - DNA, 201 bp, Homo sapiens; identical to SEQ ID NO: 16994

SEQ ID NO: 17022 - DNA, 201 bp, Homo sapiens; identical to SEQ ID NO: 16996

SEQ ID NO: 17023 - DNA, 201 bp, Homo sapiens
cttcagggtacaaaaccactggagggaaggatgaagaagtggttcaatgtctctctgatggatggtcttctcaaccaacctgtaggaaagaacatgaaacrtgtttggctcctgaattatataatggaaattattccacaacacagaaaacattcaaagtgaaggacaaagtacaatacgaatgtgctactggctactaca

SEQ ID NO: 17024 - DNA, 201 bp, Homo sapiens
cagaaggctggtctccagagccaaggtgcttcaaaaaatgcactaagcctgacctgagtaatggttacatctctgatgtaaagttattgtataaaattcargagaacatgcattatggttgcgcttcagggtacaaaaccactggagggaaggatgaagaagtggttcaatgtctctctgatggatggtcttctcaaccaa

SEQ ID NO: 17025 - DNA, 201 bp, Homo sapiens
taaagtgctcttctttaagattaattgaaaatggttattttcatcctgtaaagcaaacctatgaagaaggagatgtcgttcagtttttctgtcatgaaaaytattatctaagtggatctgatttaattcaatgctataactttggttggtacccagaatctcctgtatgcgaaggaagaagaaacagatgtcctcctccac

SEQ ID NO: 17026 - DNA, 201 bp, Homo sapiens
aggagaactctatgcagaagagaaaccctgtggttttcctcatgtggaaaatggaagaattgcccaatattactatacttttaaaagcttttactttccartgagcatagacaaaaaattgtcatttttctgcttggctggttataccactgaaagtggaagacaagaagagcaaaccacgtgtacaacagaaggctggtc

SEQ ID NO: 17027 - DNA, 201 bp, Homo sapiens
gttattttcatcctgtaaagcaaacctatgaagaaggagatgtcgttcagtttttctgtcatgaaaattattatctaagtggatctgatttaattcaatgytataactttggttggtacccagaatctcctgtatgcgaaggaagaagaaacagatgtcctcctccacctctgcccataaactccaaaattcaaacacatt

SEQ ID NO: 17028 - DNA, 201 bp, Homo sapiens
tacaatggggataaagtgacatatgcatgtaaaagcggctaccttctccatggatcgaatgagataacttgtaatcgtggaaaatggacacttcctcctgwgtgtgttgaaaataatgagaattgtaagcatcctcctgttgtaatgaatggggctgttgcagacgggatattggcaagctatgcaacaggatcctcagtg

SEQ ID NO: 17029 - DNA, 201 bp, Homo sapiens
ggatattggcaagctatgcaacaggatcctcagtggaatatagatgcaatgaatattacttactgaggggatcaaaaatatctcgttgcgaacaaggaaartggtcatccccacctgtttgcttggaaccatgtactgttaatgtggattacatgaacagaaataacatagaaatgaagtggaaatatgaagggaaagtct

SEQ ID NO: 17030 - DNA, 201 bp, Homo sapiens
cattcaacaacttatcgtcatggagaaatagttcatatagaatgtgaacttaattttgagatccatgggtcagcagaaatacgttgtgaagatggaaaatsgacagaacctccaaaatgcattgaaggacaggagaaggtagcctgtgaggaaccacccttcattgaaaatggtgcagcaaatttacactctaagatttat

SEQ ID NO: 17031 - DNA, 201 bp, Homo sapiens
gtgaaatatcctttatgtactagaaaagaatctaaaggaatgtgcacatctcctcctcttattaaacatggagtcattattagttcaacagtagacacctmtgaaaatggctcttcagtagaatacagatgttttgatcaccatttcctagaaggatctagggaggcctattgtttagatggaatgtggactacaccacca

SEQ ID NO: 17032 - DNA, 145 bp, Homo sapiens
aaattccttataaaatataattttgaggaaataagttaaaaacttcggagtttttccttgcttaaatatttgaatctaaattatttgtgctgaacatttcrttatttataaatgaaaaccaataaatgtctaatttttagtttgt

SEQ ID NO: 17033 - DNA, 201 bp, Homo sapiens
tctccagagccaaggtgcttcaaaaaatgcactaagcctgacctgagtaatggttacatctctgatgtaaagttattgtataaaattcaagagaacatgcrttatggttgcgcttcagggtacaaaaccactggagggaaggatgaagaagtggttcaatgtctctctgatggatggtcttctcaaccaacctgtaggaaa

SEQ ID NO: 17034 - DNA, 201 bp, Homo sapiens
gaagatggaaaatggacagaacctccaaaatgcattgaaggacaggagaaggtagcctgtgaggaaccacccttcattgaaaatggtgcagcaaatttacrctctaagatttattacaatggggataaagtgacatatgcatgtaaaagcggctaccttctccatggatcgaatgagataacttgtaatcgtggaaaatgg

SEQ ID NO: 17035 - DNA, 201 bp, Homo sapiens
acaggatcctcagtggaatatagatgcaatgaatattacttactgaggggatcaaaaatatctcgttgcgaacaaggaaaatggtcatccccacctgtttkcttggaaccatgtactgttaatgtggattacatgaacagaaataacatagaaatgaagtggaaatatgaagggaaagtcttacatggagatttaatagat

SEQ ID NO: 17036 - DNA, 201 bp, Homo sapiens
atggaatgtggactacaccaccattgtgtttagagccatgcacattatcttttactgaaatggaaaagaataatttacttctgaaatgggattttgacaayagaccacacattttgcatggtgaatatattgagtttatttgtagaggagatacttatccagctgaattatatattactggatctatacttagaatgcaat

SEQ ID NO: 17037 - DNA, 201 bp, Homo sapiens
ttagttcaacagtagacacctatgaaaatggctcttcagtagaatacagatgttttgatcaccatttcctagaaggatctagggaggcctattgtttagakggaatgtggactacaccaccattgtgtttagagccatgcacattatcttttactgaaatggaaaagaataatttacttctgaaatgggattttgacaata

SEQ ID NO: 17038 - DNA, 201 bp, Homo sapiens
gcccagccaacgtgtacctgcacgatgggcactcatgtcaggatgtggacggctactgctacaatggcatctgccagactcacgagcagcagtgtgtcacrctctggggaccaggtgctaaacctgcccctgggatctgctttgagagagtcaattctgcaggtgatccttatggcaactgtggcaaagtctcgaagagtt

SEQ ID NO: 17039 - DNA, 201 bp, Homo sapiens
agctgggccacaatttcgggatgaatcatgacacactggacaggggctgtagctgtcaaatggcggttgagaaaggaggctgcatcatgaacgcttccacsgggtacccatttcccatggtgttcagcagttgcagcaggaaggacttggagaccagcctggagaaaggaatgggggtgtgcctgtttaacctgccggaag

SEQ ID NO: 17040 - DNA, 201 bp, Homo sapiens
tgagctgggccacaatttcgggatgaatcatgacacactggacaggggctgtagctgtcaaatggcggttgagaaaggaggctgcatcatgaacgcttccmccgggtacccatttcccatggtgttcagcagttgcagcaggaaggacttggagaccagcctggagaaaggaatgggggtgtgcctgtttaacctgccgga

SEQ ID NO: 17041 - DNA, 201 bp, Homo sapiens
gtttcagaggcaaggaaaagatctggaaaaagttaagcagcgattaatagagattgctaatcacgttgacaagttttacagaccactgaacattcggatcrtgttggtaggcgtggaagtgtggaatgacatggacaaatgctctgtaagtcaggacccattcaccagcctccatgaatttctggactggaggaagatgaa

SEQ ID NO: 17042 - DNA, 201 bp, Homo sapiens
cctgctcgccctggccggtgctctgctcgcgccctgcgaggcccgaggggtgagcttatggaaccaaggaagagctgatgaagttgtcagtgcctctgttsggagtggggacctctggatcccagtgaagagcttcgactccaagaatcatccagaagtgctgaatattcgactacaacgggaaagcaaagaactgatcat

SEQ ID NO: 17043 - DNA, 175 bp, Homo sapiens
tgtggacatgcgtgaccagcagtactcaggtttgagggtttgcagaaagccagggaacccacagagtcaccaacccttcatttaacaagtaagaatgttamaaagtgaaaacaatgtaagagcctaactccatcccccgtggccattactgcataaaatagagtgcatttgaaat

SEQ ID NO: 17044 - DNA, 201 bp, Homo sapiens
agcagggttttagtttttaatttatcagagaccctgccacccattccatctccatccaagcaaactgaatggcattgaaacaaactggagaagaaggtagsagaaagggcggtgaactctggctctttgctgtggacatgcgtgaccagcagtactcaggtttgagggtttgcagaaagccagggaacccacagagtcacc

SEQ ID NO: 17045 - DNA, 201 bp, Homo sapiens
aggagcatgcgtctactgcctcactgacactcatctgagccctcccatgacatggagaccgtgaccagtgctgctgcagaggaggtcacgcgtccccaagrcctcctgtgactggcagcattgactctgtggctttgccatcgtttccatgacaacagacacaacacagttctcggggctcaggaggggaagtccagccta

SEQ ID NO: 17046 - DNA, 201 bp, Homo sapiens
agcaaggaggaagaggactcaaaagtctggcctttcactgagcctccacagcagtgggggagaagcaagggttgggcccagtgtcccctttccccagtgayacctcagccttggcagccctgatgactggtctctggctgcaacttaatgctctgatatggcttttagcatttattatatgaaaatagcagggttttagtt

SEQ ID NO: 17047 - DNA, 201 bp, Homo sapiens
acagcggccccatccggcaagcagaagcaaggcaggaagctgcagagtccaacagggagcgcggccagggccaggagcccgtgggatcgcaggagcatgcrtctactgcctcactgacactcatctgagccctcccatgacatggagaccgtgaccagtgctgctgcagaggaggtcacgcgtccccaaggcctcctgtga

SEQ ID NO: 17048 - DNA, 201 bp, Homo sapiens
tcagtgctgctcctgagagagtagcaggttaccactctggcaggccccagccctgcagcaaggaggaagaggactcaaaagtctggcctttcactgagccyccacagcagtgggggagaagcaagggttgggcccagtgtcccctttccccagtgacacctcagccttggcagccctgatgactggtctctggctgcaact

SEQ ID NO: 17049 - DNA, 201 bp, Homo sapiens
gcttttagcatttattatatgaaaatagcagggttttagtttttaatttatcagagaccctgccacccattccatctccatccaagcaaactgaatggcawtgaaacaaactggagaagaaggtaggagaaagggcggtgaactctggctctttgctgtggacatgcgtgaccagcagtactcaggtttgagggtttgcag

SEQ ID NO: 17050 - DNA, 201 bp, Homo sapiens
agcttctacctcgcaaatcccatgacaatgcgcagcttgtcagtggggtttatttccaagggaccaccatcggcatggccccaatcatgagcatgtgcacrgcagaccagtctgggggaattgtcatggaccattcagacaatccccttggtgcagccgtgaccctggcacatgagctgggccacaatttcgggatgaatc

SEQ ID NO: 17051 - DNA, 201 bp, Homo sapiens
ctgatgtctccctcgctcgaaattacacggtaattctgggtcactgttactaccatggacatgtacggggatattctgattcagcagtcagtctcagcacrtgttctggtctcaggggacttattgtgtttgaaaatgaaagctatgtcttagaaccaatgaaaagtgcaaccaacagatacaaactcttcccagcgaaga

SEQ ID NO: 17052 - DNA, 201 bp, Homo sapiens
gcgagatgagagatgctaaatgtggaaaaatccagtgtcaaggaggtgccagccggccagtcattggtaccaatgccgtttccatagaaacaaacatcccyctgcagcaaggaggccggattctgtgccgggggacccacgtgtacttgggcgatgacatgccggacccagggcttgtgcttgcaggcacaaagtgtgcag

SEQ ID NO: 17053 - DNA, 201 bp, Homo sapiens
actgccagctgaagcctgcaggaacagcgtgcagggactccagcaactcctgtgacctcccagagttctgcacaggggccagccctcactgcccagccaaygtgtacctgcacgatgggcactcatgtcaggatgtggacggctactgctacaatggcatctgccagactcacgagcagcagtgtgtcacgctctggggac

SEQ ID NO: 17054 - DNA, 201 bp, Homo sapiens
catctcaggccagggccaaggggcttcaggtccaggctgtgtttggctttcagggaggccctgtgccccttgacaactggcaggcaggctcccagggacasctgggagaaatctggcttctggccaggaagctttggtgagaacctgggttgcagacaggaatcttaaggtgtagccacaccaggatagagactggaacac

SEQ ID NO: 17055 - DNA, 201 bp, Homo sapiens; identical to SEQ ID NO: 17039

SEQ ID NO: 17056 - DNA, 201 bp, Homo sapiens; identical to SEQ ID NO: 17040

SEQ ID NO: 17057 - DNA, 201 bp, Homo sapiens; identical to SEQ ID NO: 17042

SEQ ID NO: 17058 - DNA, 201 bp, Homo sapiens; identical to SEQ ID NO: 17050

SEQ ID NO: 17059 - DNA, 201 bp, Homo sapiens; identical to SEQ ID NO: 17051

SEQ ID NO: 17060 - DNA, 201 bp, Homo sapiens
aaggcggtgcttgatagaaatgccaagcacttctttttctcgctgtcctttctagagcactgccaccagtaggttatttagcttgggaaaggtggtgtttytgtaagaaacctactgcccaggcactgcaaaccgccacctccctatactgcttggagctgagcaaatcaccacaaactgtaatacaatgatcctgtattc

SEQ ID NO: 17061 - DNA, 201 bp, Homo sapiens; identical to SEQ ID NO: 17053

SEQ ID NO: 17062 - DNA, 201 bp, Homo sapiens; identical to SEQ ID NO: 17038

SEQ ID NO: 17063 - DNA, 201 bp, Homo sapiens
ttggctttggaggaagcacagacagcggccccatccggcaagcagataaccaaggtttaaccataggaattctggtgaccatcctgtgtcttcttgctgcyggatttgtggtttatctcaaaaggaagaccttgatacgactgctgtttacaaataagaagaccaccattgaaaaactaaggtgtgtgcgcccttcccggc

SEQ ID NO: 17064 - DNA, 201 bp, Homo sapiens; identical to SEQ ID NO: 17041

SEQ ID NO: 17065 - DNA, 201 bp, Homo sapiens
tgccatgatgcctctgtcttctggactggttttcacattagaagacaattgacaacagttacataattcactctgagtgttttatgagaaagccttctttkgggggtcaacagttttcctatgctttgaaacagaaaaatatgtaccaagaatcttggtttgccttccagaaaacaaaactgcatttcactttcccggtgt

SEQ ID NO: 17066 - DNA, 201 bp, Homo sapiens
acttttaggattttttttaatgtttaaaacatcattactataagaactttgagctactgccgtcagtgctgtgctgtgctatggtgctctgtctacttgcwcaggtacttgtaaattattaatttatgcagaatgttgattacagtgcagtgcgctgtagtaggcatttttaccatcactgagttttccatggcaggaagg

SEQ ID NO: 17067 - DNA, 201 bp, Homo sapiens
cagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccaga

SEQ ID NO: 17068 - DNA, 201 bp, Homo sapiens
cagcgtggatttttccagcttacacatgtgggatgacatcacagaaaccacaaaagcagcaaattaaactgtaggagagtcaatactcctgacgagtctcgggggggggcatttttatgccttcttaactttatgagaattctcaggctgaactataggccattgttcccaggcaaatcaatacatcaatgcatcctcaaa

SEQ ID NO: 17069 - DNA, 201 bp, Homo sapiens
tcccccaactacccccagctgtgcttatggtaccagatgcagctcaagagatcccaagtagaacctcagttgattttctggattccccatctcaggccagrgccaaggggcttcaggtccaggctgtgtttggctttcagggaggccctgtgccccttgacaactggcaggcaggctcccagggacagctgggagaaatct

SEQ ID NO: 17070 - DNA, 201 bp, Homo sapiens
tgctgcagtgtcagaatgttgacatcagcagacccctcaacggcctgaatgtccctcagccccagtcaactcagcgagtgcttcctcccctccaccgggcyccacgtgcacctagcgtccctgccagacccctgccagccaagcctgcacttaggcaggcccaggggacctgtaagccaaacccccctcagaagcctctgc

SEQ ID NO: 17071 - DNA, 201 bp, Homo sapiens
gtgtttgctttctgatcaaggccttattggaaagcagtcccccaactacccccagctgtgcttatggtaccagatgcagctcaagagatcccaagtagaayctcagttgattttctggattccccatctcaggccagggccaaggggcttcaggtccaggctgtgtttggctttcagggaggccctgtgccccttgacaac

SEQ ID NO: 17072 - DNA, 201 bp, Homo sapiens
ttttaagtttgttttcctgacacatgtaatcagatgtgtagcaaccgagggaaacgaagcctaacattctccattgtggaaatacacacaggaggttacayttcacagcgtggatttttccagcttacacatgtgggatgacatcacagaaaccacaaaagcagcaaattaaactgtaggagagtcaatactcctgacgag

SEQ ID NO: 17073 - DNA, 201 bp, Homo sapiens; identical to SEQ ID NO: 17052

SEQ ID NO: 17074 - DNA, 201 bp, Homo sapiens; identical to SEQ ID NO: 17054

SEQ ID NO: 17075 - DNA, 201 bp, Homo sapiens; identical to SEQ ID NO: 17039

SEQ ID NO: 17076 - DNA, 201 bp, Homo sapiens; identical to SEQ ID NO: 17040

SEQ ID NO: 17077 - DNA, 201 bp, Homo sapiens; identical to SEQ ID NO: 17042

SEQ ID NO: 17078 - DNA, 201 bp, Homo sapiens; identical to SEQ ID NO: 17050

SEQ ID NO: 17079 - DNA, 201 bp, Homo sapiens
aagacggtactgatgtctccctcgctcgaaattacacgggtcactgttactaccatggacatgtacggggatattctgattcagcagtcagtctcagcacrtgttctggtctcaggggacttattgtgtttgaaaatgaaagctatgtcttagaaccaatgaaaagtgcaaccaacagatacaaactcttcccagcgaaga

SEQ ID NO: 17080 - DNA, 201 bp, Homo sapiens; identical to SEQ ID NO: 17060

SEQ ID NO: 17081 - DNA, 201 bp, Homo sapiens; identical to SEQ ID NO: 17053

SEQ ID NO: 17082 - DNA, 201 bp, Homo sapiens; identical to SEQ ID NO: 17038

SEQ ID NO: 17083 - DNA, 201 bp, Homo sapiens; identical to SEQ ID NO: 17063

SEQ ID NO: 17084 - DNA, 201 bp, Homo sapiens; identical to SEQ ID NO: 17041

SEQ ID NO: 17085 - DNA, 201 bp, Homo sapiens; identical to SEQ ID NO: 17065

SEQ ID NO: 17086 - DNA, 201 bp, Homo sapiens; identical to SEQ ID NO: 17066

SEQ ID NO: 17087 - DNA, 201 bp, Homo sapiens; identical to SEQ ID NO: 17067

SEQ ID NO: 17088 - DNA, 201 bp, Homo sapiens; identical to SEQ ID NO: 17068

SEQ ID NO: 17089 - DNA, 201 bp, Homo sapiens; identical to SEQ ID NO: 17069

SEQ ID NO: 17090 - DNA, 201 bp, Homo sapiens; identical to SEQ ID NO: 17070

SEQ ID NO: 17091 - DNA, 201 bp, Homo sapiens; identical to SEQ ID NO: 17071

SEQ ID NO: 17092 - DNA, 201 bp, Homo sapiens; identical to SEQ ID NO: 17072

SEQ ID NO: 17093 - DNA, 201 bp, Homo sapiens; identical to SEQ ID NO: 17052

SEQ ID NO: 17094 - DNA, 201 bp, Homo sapiens
catcaaattttcaaatggacagaaagacccggttcatcatccatggcttcatagacaaaggagatgagagctgggtgacagacatgtgcaagaaactgttsgaggtggaggaggtgaactgcatctgcgtggactggaagaagggctcccaagccacctacacacaggctgccaacaacgtgcgagtggtgggcgcccagg

SEQ ID NO: 17095 - DNA, 201 bp, Homo sapiens
agagctgggtgacagacatgtgcaagaaactgttcgaggtggaggaggtgaactgcatctgcgtggactggaagaagggctcccaagccacctacacacargctgccaacaacgtgcgagtggtgggcgcccaggtggcccagatgctcgacatcctcttgacagagtatagctaccccccttccaaagttcacctcattg

SEQ ID NO: 17096 - DNA, 201 bp, Homo sapiens
atccctgcacttcctacaagtcctttgagtctgacaagtgcttcccgtgtccagatcaaggatgcccacagatgggtcactatgctgataaatttgctggyaggacaagtgaagagcagcagaaattcttcttgaacacaggagaggctagcaatttcgctcgctggagatatggggtttccatcacactgtctggaagaa

SEQ ID NO: 17097 - DNA, 201 bp, Homo sapiens
actccaggcctgagcaggattacagggttggatcctgtagaagcaagtttcgagagtactcctgaagaggtgcgacttgatccctctgatgctgactttgytgatgtgattcacacggatgcagctcccctgatcccattcttgggttttggaacgaaccaacagatgggtcatcttgacttcttccccaatggaggagag

SEQ ID NO: 17098 - DNA, 201 bp, Homo sapiens
cgggacagcaatcaggcccctgaaaattctcccctggagccctgagaagatcggcacccgcttcctgctgtacaccaatgaaaacccaaacaactttcaarttctcctcctctctgatccatcaacaattgaggcatcaaattttcaaatggacagaaagacccggttcatcatccatggcttcatagacaaaggagatga

SEQ ID NO: 17099 - DNA, 201 bp, Homo sapiens
cccaagccacctacacacaggctgccaacaacgtgcgagtggtgggcgcccaggtggcccagatgctcgacatcctcttgacagagtatagctaccccccytccaaagttcacctcattggccacagcctgggagcccacgtggctggagaggcaggaagcaagactccaggcctgagcaggattacagggttggatcctg

SEQ ID NO: 17100 - DNA, 201 bp, Homo sapiens
cacaggctgccaacaacgtgcgagtggtgggcgcccaggtggcccagatgctcgacatcctcttgacagagtatagctaccccccttccaaagttcacctsattggccacagcctgggagcccacgtggctggagaggcaggaagcaagactccaggcctgagcaggattacagggttggatcctgtagaagcaagtttcg

SEQ ID NO: 17101 - DNA, 186 bp, Homo sapiens
atgctgatcttctggacaatcacacttttcctgctgggagcagccaaaggaaaagaagtttgctatgaggacctcgggtgcttttytgacactgagccctggggcgggacagcaatcaggcccctgaaaattctcccctggagccctgagaagatcggcacccgcttcctgctgtacaccaatgaa

SEQ ID NO: 17102 - DNA, 201 bp, Homo sapiens
cagagtatagctaccccccttccaaagttcacctcattggccacagcctgggagcccacgtggctggagaggcaggaagcaagactccaggcctgagcagrattacagggttggatcctgtagaagcaagtttcgagagtactcctgaagaggtgcgacttgatccctctgatgctgactttgttgatgtgattcacacgg

SEQ ID NO: 17103 - DNA, 201 bp, Homo sapiens
gctggagatatggggtttccatcacactgtctggaagaacagccactggtcagatcaaagttgctttgtttggaaataagggaaacactcaccagtacagyatcttcagggggattctcaaaccaggctcaacccattcctatgagtttgatgcaaagctggatgttggaacaattgagaaagtcaagtttctttggaata

SEQ ID NO: 17104 - DNA, 201 bp, Homo sapiens
cagatgggtcatcttgacttcttccccaatggaggagagagcatgccgggatgcaagaagaatgccctgtctcagatcgtggatctagatggcatctgggygggaacccgggactttgtggcttgcaatcacctaagaagctacaagtattacttggaaagcatcctcaatcccgatgggtttgctgcatatccctgcact

SEQ ID NO: 17105 - DNA, 201 bp, Homo sapiens
ccggttcatcatccatggcttcatagacaaaggagatgagagctgggtgacagacatgtgcaagaaactgttcgaggtggaggaggtgaactgcatctgcrtggactggaagaagggctcccaagccacctacacacaggctgccaacaacgtgcgagtggtgggcgcccaggtggcccagatgctcgacatcctcttgac

SEQ ID NO: 17106 - DNA, 201 bp, Homo sapiens
agactccaggcctgagcaggattacagggttggatcctgtagaagcaagtttcgagagtactcctgaagaggtgcgacttgatccctctgatgctgacttygttgatgtgattcacacggatgcagctcccctgatcccattcttgggttttggaacgaaccaacagatgggtcatcttgacttcttccccaatggaggag

SEQ ID NO: 17107 - DNA, 201 bp, Homo sapiens
agggaaacactcaccagtacagtatcttcagggggattctcaaaccaggctcaacccattcctatgagtttgatgcaaagctggatgttggaacaattgasaaagtcaagtttctttggaataacaatgtgataaatccaaccctccccaaagtgggtgccaccaagatcactgtgcaaaagggagaagagaagacagtgt

SEQ ID NO: 17108 - DNA, 182 bp, Homo sapiens
  misc_feature (1)...(182): n = A,T,C or G, or insertion/deletion polymorphism (see Tables 1-2)
accctccccaaagtgggtgccaccaagatcactgtgcaaaagggagaagagaagacagtgtacaacttctgtagcgaagacacagtgcgggaagacacgcngctcaccctcacgccctgctaagctcccggggcgacgaggctgctgcgttcacactaataaaatccactggtgcatctgta

SEQ ID NO: 17109 - DNA, 160 bp, Homo sapiens
gcaagaccaggactcgggctggaggggcgctgggctcggacctgccaaggccacgggggwgcaagggacagaggcgggggtcctagctgacggcttttactgcctaggatgacgctgcggcttctggtggccgcgctctgcgccgggatcctggcagagg

SEQ ID NO: 17110 - DNA, 201 bp, Homo sapiens
cggactggatgggaaaccaggagccgctgggccctctgggccgaatggtgctgcaggcaaagctggggacccagggagagacgggcttccaggcctccgtrgagaacagggcctccctggcccctctggtccccctggattaccgggaaagccaggcgaggatggcaaacctggcctgaatggaaaaaacggagaacctgg

SEQ ID NO: 17111 - DNA, 201 bp, Homo sapiens
ctgcccggtgctcctggtgttgttgggttcccgggtcagacaggccctcgaggagagatgggtcagccaggccctagtggagagcggggtctggcaggccycccagggagagaaggaatcccaggacccctggggccacctggaccaccggggtcagtgggaccacctggggcctctggactcaaaggagacaagggagac

SEQ ID NO: 17112 - DNA, 201 bp, Homo sapiens
ggccccaagggggactcaggcgaacagggccccccaggcaaggagggccccatcggctttcctggagaacgcgggctgaagggcgaccgtggagaccctgrccctcaggggccacctggtctggcccttggggagaggggcccccccgggccttccggccttgccggggagcctggaaagcctggtattcccgggctccca

SEQ ID NO: 17113 - DNA, 201 bp, Homo sapiens
cccatcggctttcctggagaacgcgggctgaagggcgaccgtggagaccctggccctcaggggccacctggtctggcccttggggagaggggcccccccgsgccttccggccttgccggggagcctggaaagcctggtattcccgggctcccaggcagggctgggggtgtgggagaggcaggaaggccaggagagagggga

SEQ ID NO: 17114 - DNA, 201 bp, Homo sapiens
ctttcctggagaacgcgggctgaagggcgaccgtggagaccctggccctcaggggccacctggtctggcccttggggagaggggcccccccgggccttccrgccttgccggggagcctggaaagcctggtattcccgggctcccaggcagggctgggggtgtgggagaggcaggaaggccaggagagaggggagaacgggg

SEQ ID NO: 17115 - DNA, 201 bp, Homo sapiens
ccaaggaccttctggcctgaagggggagcctggagagacaggacctccaggacggggcctgactggacctactggagctgtgggacttcctggacccccckgcccttcaggccttgtgggtccacaggggtctccaggtttgcctggacaagtgggggagacagggaagccgggagccccaggtcgagatggtgccagtgg

SEQ ID NO: 17116 - DNA, 201 bp, Homo sapiens
tgccacagacatcacagggctgcagcctggaaccacctaccaggtggctgtgtcggtactgcgaggcagagaggagggccctgctgcagtcatcgtggctygaacggacccactgggcccagtgaggacggtccatgtgactcaggccagcagctcatctgtcaccattacctggaccagggttcctggcgccacaggata

SEQ ID NO: 17117 - DNA, 201 bp, Homo sapiens
tgacttcttcttcttcgtcaatgacttcagcatcttgaggacactactgcccctcgtttcccggagagtgtgcacgactgctggtggcgtgcctgtgaccygacctccggatgactcgacctctgctccacgagacctggtgctgtctgagccaagcagccaatccttgagagtacagtggacagcggccagtggccctgt

SEQ ID NO: 17118 - DNA, 201 bp, Homo sapiens
cttgagagtacagtggacagcggccagtggccctgtgactggctacaaggtccagtacactcctctgacggggctgggacagccactgccgagtgagcggyaggaggtgaacgtcccagctggtgagaccagtgtgcggctgcggggtctccggccactgaccgagtaccaagtgactgtgattgccctctacgccaacag

SEQ ID NO: 17119 - DNA, 201 bp, Homo sapiens
ccctggccgcgccgggaatcctgggacccctggagcccctggcctaaagggctctccagggttgcctggccctcgtggggacccgggagagcgaggacctygaggcccaaagggggagccgggggctcccggacaagtcatcggaggtgaaggacctgggcttcctgggcggaaaggggaccctggaccatcgggcccccc

SEQ ID NO: 17120 - DNA, 201 bp, Homo sapiens
cggaggctacgaggagggtcctggagcgtctggtgttggcacttgggcctcttgggccacaggcagttcaggttggcctgctgtcttacagtcatcggccytccccactgttcccactgaatggctcccatgaccttggcattatcttgcaaaggatccgtgacatgccctacatggacccaagtgggaacaacctgggca

SEQ ID NO: 17121 - DNA, 201 bp, Homo sapiens
aggaacagtcccgggtcctggggcccgagctcagcagctatcacctggacgggctggagccagcgacacagtaccgcgtgaggctgagtgtcctagggccrgctggagaagggccctctgcagaggtgactgcgcgcactgagtcacctcgtgttccaagcattgaactacgtgtggtggacacctcgatcgactcggtga

SEQ ID NO: 17122 - DNA, 201 bp, Homo sapiens
gggccacaggcagttcaggttggcctgctgtcttacagtcatcggccctccccactgttcccactgaatggctcccatgaccttggcattatcttgcaaargatccgtgacatgccctacatggacccaagtgggaacaacctgggcacagccgtggtcacagctcacagatacatgttggcaccagatgctcctgggcgc

SEQ ID NO: 17123 - DNA, 201 bp, Homo sapiens
cattggccttactggcagagcaggacccccaggtgactcagggcctcctggagagaagggagaccctgggcggcctggccccccaggacctgttggccccygaggacgagatggtgaagttggagagaaaggtgacgagggtcctccgggtgacccgggtttgcctggaaaagcaggcgagcgtggccttcggggggcacc

SEQ ID NO: 17124 - DNA, 201 bp, Homo sapiens
ccttactggcagagcaggacccccaggtgactcagggcctcctggagagaagggagaccctgggcggcctggccccccaggacctgttggcccccgaggaygagatggtgaagttggagagaaaggtgacgagggtcctccgggtgacccgggtttgcctggaaaagcaggcgagcgtggccttcggggggcacctggagt

SEQ ID NO: 17125 - DNA, 201 bp, Homo sapiens
cctcaggggccacctggtctggcccttggggagaggggcccccccgggccttccggccttgccggggagcctggaaagcctggtattcccgggctcccagkcagggctgggggtgtgggagaggcaggaaggccaggagagaggggagaacggggagagaaaggagaacgtggagaacagggcagagatggccctcctgga

SEQ ID NO: 17126 - DNA, 201 bp, Homo sapiens
acggcgtcgaggccccaagggggactcaggcgaacagggccccccaggcaaggagggccccatcggctttcctggagaacgcgggctgaagggcgaccgtrgagaccctggccctcaggggccacctggtctggcccttggggagaggggcccccccgggccttccggccttgccggggagcctggaaagcctggtattcc

SEQ ID NO: 17127 - DNA, 201 bp, Homo sapiens
ggtgaaaagggagaccagggagatcctggagaggatggacgaaatggcagccctggatcatctggacccaagggtgaccgtggggagccgggtcccccagracccccgggacggctggtagacacaggacctggagccagagagaagggagagcctggggaccgcggacaagagggtcctcgagggcccaagggtgatcct

SEQ ID NO: 17128 - DNA, 201 bp, Homo sapiens
cccaaggaccttctggcctgaagggggagcctggagagacaggacctccaggacggggcctgactggacctactggagctgtgggacttcctggacccccmggcccttcaggccttgtgggtccacaggggtctccaggtttgcctggacaagtgggggagacagggaagccgggagccccaggtcgagatggtgccagtg

SEQ ID NO: 17129 - DNA, 201 bp, Homo sapiens
agaccctggccctcaggggccacctggtctggcccttggggagaggggcccccccgggccttccggccttgccggggagcctggaaagcctggtattcccdggctcccaggcagggctgggggtgtgggagaggcaggaaggccaggagagaggggagaacggggagagaaaggagaacgtggagaacagggcagagatgg

SEQ ID NO: 17130 - DNA, 201 bp, Homo sapiens
ccctggagcccctggggaaaggggcattgaagggtttcggggacccccaggcccacagggggacccaggtgtccgaggcccagcaggagaaaagggtgacyggggtccccctgggctggatggccggagcggactggatgggaaaccaggagccgctgggccctctgggccgaatggtgctgcaggcaaagctggggaccc

SEQ ID NO: 17131 - DNA, 201 bp, Homo sapiens
gaccgtggagaccctggccctcaggggccacctggtctggcccttggggagaggggcccccccgggccttccggccttgccggggagcctggaaagcctgdtattcccgggctcccaggcagggctgggggtgtgggagaggcaggaaggccaggagagaggggagaacggggagagaaaggagaacgtggagaacagggc

SEQ ID NO: 17132 - DNA, 201 bp, Homo sapiens
tggggaaaggggcattgaagggtttcggggacccccaggcccacagggggacccaggtgtccgaggcccagcaggagaaaagggtgaccggggtccccctrggctggatggccggagcggactggatgggaaaccaggagccgctgggccctctgggccgaatggtgctgcaggcaaagctggggacccagggagagacgg

SEQ ID NO: 17133 - DNA, 201 bp, Homo sapiens
cgaggtggccacccctgcaaccgtggttcccactggaccagagctgcctgtgagccctgtaacagacctgcaagccaccgagctgcccgggcagcgggtgygagtgtcctggagcccagtccctggtgccacccagtaccgcatcattgtgcgcagcacccagggggttgagcggaccctggtgcttcctgggagtcagac

SEQ ID NO: 17134 - DNA, 201 bp, Homo sapiens
caagggacagaggcgggggtcctagctgacggcttttactgcctaggatgacgctgcggcttctggtggccgcgctctgcgccgggatcctggcagaggcsccccgagtgcgagcccagcacagggagagagtgacctgcacgcgcctttacgccgctgacattgtgttcttactggatggctcctcatccattggccgca

SEQ ID NO: 17135 - DNA, 201 bp, Homo sapiens
ggggacccaggtgtccgaggcccagcaggagaaaagggtgaccggggtccccctgggctggatggccggagcggactggatgggaaaccaggagccgctgrgccctctgggccgaatggtgctgcaggcaaagctggggacccagggagagacgggcttccaggcctccgtggagaacagggcctccctggcccctctggt

SEQ ID NO: 17136 - DNA, 201 bp, Homo sapiens
tggccggagcggactggatgggaaaccaggagccgctgggccctctgggccgaatggtgctgcaggcaaagctggggacccagggagagacgggcttccasgcctccgtggagaacagggcctccctggcccctctggtccccctggattaccgggaaagccaggcgaggatggcaaacctggcctgaatggaaaaaacgg

SEQ ID NO: 17137 - DNA, 201 bp, Homo sapiens
ggggactcaggcgaacagggccccccaggcaaggagggccccatcggctttcctggagaacgcgggctgaagggcgaccgtggagaccctggccctcaggrgccacctggtctggcccttggggagaggggcccccccgggccttccggccttgccggggagcctggaaagcctggtattcccgggctcccaggcagggct

SEQ ID NO: 17138 - DNA, 201 bp, Homo sapiens
aaggagggccccatcggctttcctggagaacgcgggctgaagggcgaccgtggagaccctggccctcaggggccacctggtctggcccttggggagagggscccccccgggccttccggccttgccggggagcctggaaagcctggtattcccgggctcccaggcagggctgggggtgtgggagaggcaggaaggccagga

SEQ ID NO: 17139 - DNA, 201 bp, Homo sapiens
ccccatcggctttcctggagaacgcgggctgaagggcgaccgtggagaccctggccctcaggggccacctggtctggcccttggggagaggggcccccccrggccttccggccttgccggggagcctggaaagcctggtattcccgggctcccaggcagggctgggggtgtgggagaggcaggaaggccaggagagagggg

SEQ ID NO: 17140 - DNA, 201 bp, Homo sapiens
ggtggacacagctgcccaaaggctgaaggggcagggggtcaagctatttgctgtggggatcaagaatgctgaccctgaggagctgaagcgagttgcctcayagcccaccagtgacttcttcttcttcgtcaatgacttcagcatcttgaggacactactgcccctcgtttcccggagagtgtgcacgactgctggtggcgt

SEQ ID NO: 17141 - DNA, 201 bp, Homo sapiens
atgggaaaccaggagccgctgggccctctgggccgaatggtgctgcaggcaaagctggggacccagggagagacgggcttccaggcctccgtggagaacarggcctccctggcccctctggtccccctggattaccgggaaagccaggcgaggatggcaaacctggcctgaatggaaaaaacggagaacctggggaccctg

SEQ ID NO: 17142 - DNA, 201 bp, Homo sapiens
gggacccagggagagacgggcttccaggcctccgtggagaacagggcctccctggcccctctggtccccctggattaccgggaaagccaggcgaggatggsaaacctggcctgaatggaaaaaacggagaacctggggaccctggagaagacgggaggaagggagagaaaggagattcaggcgcctctgggagagaaggtc

SEQ ID NO: 17143 - DNA, 201 bp, Homo sapiens
cgaacggcgtcgaggccccaagggggactcaggcgaacagggccccccaggcaaggagggccccatcggctttcctggagaacgcgggctgaagggcgacbgtggagaccctggccctcaggggccacctggtctggcccttggggagaggggcccccccgggccttccggccttgccggggagcctggaaagcctggtat

SEQ ID NO: 17144 - DNA, 201 bp, Homo sapiens
gactgctggtggcgtgcctgtgacccgacctccggatgactcgacctctgctccacgagacctggtgctgtctgagccaagcagccaatccttgagagtayagtggacagcggccagtggccctgtgactggctacaaggtccagtacactcctctgacggggctgggacagccactgccgagtgagcggcaggaggtgaa

SEQ ID NO: 17145 - DNA, 201 bp, Homo sapiens
ccccctgcctctgtggttgtgaggactgcccctgagcctgtgggtcgtgtgtcgaggctgcagatcctcaatgcttccagcgacgttctacggatcacctrggtaggggtcactggagccacagcttacagactggcctggggccggagtgaaggcggccccatgaggcaccagatactcccaggaaacacagactctgca

SEQ ID NO: 17146 - DNA, 201 bp, Homo sapiens
ctgaagggcgaccgtggagaccctggccctcaggggccacctggtctggcccttggggagaggggcccccccgggccttccggccttgccggggagcctgraaagcctggtattcccgggctcccaggcagggctgggggtgtgggagaggcaggaaggccaggagagaggggagaacggggagagaaaggagaacgtgga

SEQ ID NO: 17147 - DNA, 201 bp, Homo sapiens
agaacgcgggctgaagggcgaccgtggagaccctggccctcaggggccacctggtctggcccttggggagaggggcccccccgggccttccggccttgccdgggagcctggaaagcctggtattcccgggctcccaggcagggctgggggtgtgggagaggcaggaaggccaggagagaggggagaacggggagagaaagg

SEQ ID NO: 17148 - DNA, 201 bp, Homo sapiens
cgaccgtggagaccctggccctcaggggccacctggtctggcccttggggagaggggcccccccgggccttccggccttgccggggagcctggaaagcctrgtattcccgggctcccaggcagggctgggggtgtgggagaggcaggaaggccaggagagaggggagaacggggagagaaaggagaacgtggagaacaggg

SEQ ID NO: 17149 - DNA, 201 bp, Homo sapiens
ggggagaggggcccccccgggccttccggccttgccggggagcctggaaagcctggtattcccgggctcccaggcagggctgggggtgtgggagaggcagraaggccaggagagaggggagaacggggagagaaaggagaacgtggagaacagggcagagatggccctcctggactccctggaacccctgggccccccgga

SEQ ID NO: 17150 - DNA, 201 bp, Homo sapiens
ccaaaggtttcaagggtgacccaggagtcggggtcccgggctcccctgggcctcctggccctccaggtgtgaagggagatctgggcctccctggcctgccmggtgctcctggtgttgttgggttcccgggtcagacaggccctcgaggagagatgggtcagccaggccctagtggagagcggggtctggcaggccccccag

SEQ ID NO: 17151 - DNA, 201 bp, Homo sapiens
gtcactacgccgcctgaggctccgccagccctggggacgcttcacgtggtgcagcgcggggagcactcgctgaggctgcgctgggagccggtgcccagagmgcagggcttccttctgcactggcaacctgagggtggccaggaacagtcccgggtcctggggcccgagctcagcagctatcacctggacgggctggagcca

SEQ ID NO: 17152 - DNA, 201 bp, Homo sapiens
gggctcccaggcagggctgggggtgtgggagaggcaggaaggccaggagagaggggagaacggggagagaaaggagaacgtggagaacagggcagagatgrccctcctggactccctggaacccctgggccccccggaccccctggccccaaggtgtctgtggatgagccaggtcctggactctctggagaacagggaccc

SEQ ID NO: 17153 - DNA, 201 bp, Homo sapiens
ctggggcctctggactcaaaggagacaagggagaccctggagtagggctgcctgggccccgaggcgagcgtggggagccaggcatccgggtacgtatgtcwtactccacagccgaactcccttcatcccagctcttgcctctgatttccaacctctgagtcaatgaacctaatgtcaccatccagggtgaagatggccgcc

SEQ ID NO: 17154 - DNA, 201 bp, Homo sapiens
aggcagggctgggggtgtgggagaggcaggaaggccaggagagaggggagaacggggagagaaaggagaacgtggagaacagggcagagatggccctcctrgactccctggaacccctgggccccccggaccccctggccccaaggtgtctgtggatgagccaggtcctggactctctggagaacagggaccccctggact

SEQ ID NO: 17155 - DNA, 201 bp, Homo sapiens
ggcagggctgggggtgtgggagaggcaggaaggccaggagagaggggagaacggggagagaaaggagaacgtggagaacagggcagagatggccctcctgractccctggaacccctgggccccccggaccccctggccccaaggtgtctgtggatgagccaggtcctggactctctggagaacagggaccccctggactc

SEQ ID NO: 17156 - DNA, 201 bp, Homo sapiens
ccaggtcctggactctctggagaacagggaccccctggactcaagggtgctaagggggagccgggcagcaatggtgaccaaggtcccaaaggagacagggrtgtgccaggcatcaaaggagaccggggagagcctggaccgaggggtcaggacggcaacccgggtctaccaggagagcgtggtatggctgggcctgaaggg

SEQ ID NO: 17157 - DNA, 201 bp, Homo sapiens
ccaggacccaaaggtttcaagggtgacccaggagtcggggtcccgggctcccctgggcctcctggccctccaggtgtgaagggagatctgggcctccctgrcctgcccggtgctcctggtgttgttgggttcccgggtcagacaggccctcgaggagagatgggtcagccaggccctagtggagagcggggtctggcaggc

SEQ ID NO: 17158 - DNA, 201 bp, Homo sapiens
tgccggctcccagctccatgctgtgcctgtgctccgcgtctctcatgcagaggaggaagagcgggtaccccctgaggatgatgagtactctgaatactcckagtattctgtggaggagtaccaggaccctgaagctccttgggatagtgatgacccctgttccctgccactggatgagggctcctgcactgcctacaccct

SEQ ID NO: 17159 - DNA, 201 bp, Homo sapiens
gggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccagggtcaacctggtgcagcagggatccctggtgacccgggcgattctct

SEQ ID NO: 17160 - DNA, 201 bp, Homo sapiens
gacctcacatggaccctctccctgctagggatccccaggaaaggatggagtgcctggtatccgaggagaaaaaggagatgttggcttcatgggtccccggkgcctcaagggtgaacggggagtgaagggagcctgtggccttgatggagagaagggagacaaggggctcctggggtccctggagctcctggcgagagaggg

SEQ ID NO: 17161 - DNA, 201 bp, Homo sapiens
acgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaag

SEQ ID NO: 17162 - DNA, 201 bp, Homo sapiens
atgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactca

SEQ ID NO: 17163 - DNA, 201 bp, Homo sapiens
tgcaagccaccgagctgcccgggcagcgggtgcgagtgtcctggagcccagtccctggtgccacccagtaccgcatcattgtgcgcagcacccagggggtkgagcggaccctggtgcttcctgggagtcagacagcattcgacttggatgacgttcaggctgggcttagctacactgtgcgggtgtctgctcgagtgggtc

SEQ ID NO: 17164 - DNA, 201 bp, Homo sapiens
gtgagcggcaggaggtgaacgtcccagctggtgagaccagtgtgcggctgcggggtctccggccactgaccgagtaccaagtgactgtgattgccctctamgccaacagcatcggggaggctgtgagcgggacagctcggaccactgccctagaagggccggaactgaccatccagaataccacagcccacagcctcctgg

SEQ ID NO: 17165 - DNA, 201 bp, Homo sapiens
ccttgctggagacctggtgggtgagccgggagccaaaggtgaccgaggactgccagggccgcgaggcgagaagggtgaagctggccgtgcaggggagcccrgagaccctggggaagatggtcagaaaggggctccaggacccaaaggtttcaagggtgacccaggagtcggggtcccgggctcccctgggcctcctggccc

SEQ ID NO: 17166 - DNA, 201 bp, Homo sapiens
ccagagccctgcccagtgtattgtccaaagggccagaagggggaacctggagagatgggcctgagaggacaagttgggcctcctggcgaccctggcctccygggcaggaccggtgctcccggcccccaggggccccctggaagtgccactgccaagggcgagaggggcttccctggagcagatgggcgtccaggcagccct

SEQ ID NO: 17167 - DNA, 201 bp, Homo sapiens
gttgctggaaactgctggcatcaaggcatctgccctgcgggagatcgtggagacctgggatgagagctctggtagcttcctgcctgtgcccgaacggcgtygaggccccaagggggactcaggcgaacagggccccccaggcaaggagggccccatcggctttcctggagaacgcgggctgaagggcgaccgtggagaccc

SEQ ID NO: 17168 - DNA, 201 bp, Homo sapiens
tggccaggaacagtcccgggtcctggggcccgagctcagcagctatcacctggacgggctggagccagcgacacagtaccgcgtgaggctgagtgtcctarggccggctggagaagggccctctgcagaggtgactgcgcgcactgagtcacctcgtgttccaagcattgaactacgtgtggtggacacctcgatcgactc

SEQ ID NO: 17169 - DNA, 201 bp, Homo sapiens
ttggatgacgttcaggctgggcttagctacactgtgcgggtgtctgctcgagtgggtccccgtgagggcagtgccagtgtcctcactgtccgccgggagcyggaaactccacttgctgttccagggctgcgggttgtggtgtcagatgcaacgcgagtgagggtggcctggggacccgtccctggagccagtggatttcgg

SEQ ID NO: 17170 - DNA, 201 bp, Homo sapiens
tggtccggagtccagccagacactgcccccagactctactgccacagacatcacagggctgcagcctggaaccacctaccaggtggctgtgtcggtactgygaggcagagaggagggccctgctgcagtcatcgtggctcgaacggacccactgggcccagtgaggacggtccatgtgactcaggccagcagctcatctgt

SEQ ID NO: 17171 - DNA, 201 bp, Homo sapiens
ccgtgaggcccaggcttctgggcttaatgtggtgatgttgggaatggctggagcggacccagagcagctgcgtcgcttggcgccgggtatggactctgtcyagaccttcttcgccgtggatgatgggccaagcctggaccaggcagtcagtggtctggccacagccctgtgtcaggcatccttcactactcagccccggcc

SEQ ID NO: 17172 - DNA, 201 bp, Homo sapiens
ccagggggttgagcggaccctggtgcttcctgggagtcagacagcattcgacttggatgacgttcaggctgggcttagctacactgtgcgggtgtctgctygagtgggtccccgtgagggcagtgccagtgtcctcactgtccgccgggagctggaaactccacttgctgttccagggctgcgggttgtggtgtcagatgc

SEQ ID NO: 17173 - DNA, 201 bp, Homo sapiens
ggacgagatggtgaagttggagagaaaggtgacgagggtcctccgggtgacccgggtttgcctggaaaagcaggcgagcgtggccttcggggggcacctgsagttcgggggcctgtgggtgaaaagggagaccagggagatcctggagaggatggacgaaatggcagccctggatcatctggacccaagggtgaccgtggg

SEQ ID NO: 17174 - DNA, 201 bp, Homo sapiens
aggccccaagggggactcaggcgaacagggccccccaggcaaggagggccccatcggctttcctggagaacgcgggctgaagggcgaccgtggagaccctrgccctcaggggccacctggtctggcccttggggagaggggcccccccgggccttccggccttgccggggagcctggaaagcctggtattcccgggctccc

SEQ ID NO: 17175 - DNA, 201 bp, Homo sapiens
tctgacctcacatggaccctctccctgctagggatccccaggaaaggatggagtgcctggtatccgaggagaaaaaggagatgttggcttcatgggtcccyggggcctcaagggtgaacggggagtgaagggagcctgtggccttgatggagagaagggagacaaggggctcctggggtccctggagctcctggcgagaga

SEQ ID NO: 17176 - DNA, 201 bp, Homo sapiens
cccctgcctctgtggttgtgaggactgcccctgagcctgtgggtcgtgtgtcgaggctgcagatcctcaatgcttccagcgacgttctacggatcacctgrgtaggggtcactggagccacagcttacagactggcctggggccggagtgaaggcggccccatgaggcaccagatactcccaggaaacacagactctgcag

SEQ ID NO: 17177 - DNA, 201 bp, Homo sapiens; identical to SEQ ID NO: 17111

SEQ ID NO: 17178 - DNA, 201 bp, Homo sapiens; identical to SEQ ID NO: 17161

SEQ ID NO: 17179 - DNA, 201 bp, Homo sapiens
aaatgctgtttgctgggttttcttagggtcagaaaggggctccaggacccaaaggtttcaaggtatgtgtacccagaagggtccctgctggggtcctggtygtgagactccctgagcttgatccgatgcctcttttcctcaaagggtgacccaggagtcggggtcccgggctcccctgggcctcctggccctccaggtgtg

SEQ ID NO: 17180 - DNA, 201 bp, Homo sapiens; identical to SEQ ID NO: 17162

SEQ ID NO: 17181 - DNA, 201 bp, Homo sapiens
gggctggcaggacacaaaggagagatggtgaggggagcctggtgtgccgggccagtcgggggcccctggcaaggagggcctgatcggtcccaagggtgacygaggctttgacgggcagccaggccccaagggtgaccagggcgagaaaggggagcggggaaccccaggaattgggggcttcccaggccccagtggaaatga

SEQ ID NO: 17182 - DNA, 201 bp, Homo sapiens
tcttttcctcaaagggtgacccaggagtcggggtcccgggctcccctgggcctcctggccctccaggtgtgaagggagatctgggcctccctggcctgccmggtgctcctggtgttgttgggttcccgggtcagacaggccctcgaggagagatgggtcagccaggccctagtggagagcggggtctggcaggccccccag

SEQ ID NO: 17183 - DNA, 201 bp, Homo sapiens
ggaattgggggcttcccaggccccagtggaaatgatggctctgctggtcccccagggccacctggcagtgttggtcccagaggccccgaaggacttcaggsccagaagggtgagcgaggtccccccggagagagagtggtgggggctcctggggtccctggagctcctggcgagagaggggagcaggggcggccagggcct

SEQ ID NO: 17184 - DNA, 201 bp, Homo sapiens
tggaaatgatggctctgctggtcccccagggccacctggcagtgttggtcccagaggccccgaaggacttcagggccagaagggtgagcgaggtccccccrgagagagagtggtgggggctcctggggtccctggagctcctggcgagagaggggagcaggggcggccagggcctgccggtcctcgaggcgagaagggaga

SEQ ID NO: 17185 - DNA, 201 bp, Homo sapiens
aagggagacaagggagaagctggtcccccaggccgccccgggctggcaggacacaaaggagagatggtgaggggagcctggtgtgccgggccagtcggggrcccctggcaaggagggcctgatcggtcccaagggtgaccgaggctttgacgggcagccaggccccaagggtgaccagggcgagaaaggggagcggggaac

SEQ ID NO: 17186 - DNA, 201 bp, Homo sapiens
acctggtgcagcagggatccctggtgacccgggatccccaggaaaggatggagtgcctggtatccgaggagaaaaaggagatgttggcttcatgggtcccyggggcctcaagggtgaacggggagtgaagggagcctgtggccttgatggagagaagggagacaagggagaagctggtcccccaggccgccccgggctggc

SEQ ID NO: 17187 - DNA, 201 bp, Homo sapiens; identical to SEQ ID NO: 17158

SEQ ID NO: 17188 - DNA, 201 bp, Homo sapiens
cgatgcctcttttcctcaaagggtgacccaggagtcggggtcccgggctcccctgggcctcctggccctccaggtgtgaagggagatctgggcctccctgrcctgcccggtgctcctggtgttgttgggttcccgggtcagacaggccctcgaggagagatgggtcagccaggccctagtggagagcggggtctggcaggc

SEQ ID NO: 17189 - DNA, 201 bp, Homo sapiens
gggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccaggcaaggtcaacctggtgcagcagggatccctggtgacccgggatccc

SEQ ID NO: 17190 - DNA, 201 bp, Homo sapiens
tggtgcagcagggatccctggtgacccgggatccccaggaaaggatggagtgcctggtatccgaggagaaaaaggagatgttggcttcatgggtccccggkgcctcaagggtgaacggggagtgaagggagcctgtggccttgatggagagaagggagacaagggagaagctggtcccccaggccgccccgggctggcagg

SEQ ID NO: 17191 - DNA, 160 bp, Homo sapiens; identical to SEQ ID NO: 17109

SEQ ID NO: 17192 - DNA, 201 bp, Homo sapiens; identical to SEQ ID NO: 17110

SEQ ID NO: 17193 - DNA, 201 bp, Homo sapiens; identical to SEQ ID NO: 17111

SEQ ID NO: 17194 - DNA, 201 bp, Homo sapiens; identical to SEQ ID NO: 17112

SEQ ID NO: 17195 - DNA, 201 bp, Homo sapiens; identical to SEQ ID NO: 17113

SEQ ID NO: 17196 - DNA, 201 bp, Homo sapiens; identical to SEQ ID NO: 17114

SEQ ID NO: 17197 - DNA, 201 bp, Homo sapiens; identical to SEQ ID NO: 17115

SEQ ID NO: 17198 - DNA, 201 bp, Homo sapiens; identical to SEQ ID NO: 17116

SEQ ID NO: 17199 - DNA, 201 bp, Homo sapiens; identical to SEQ ID NO: 17117

SEQ ID NO: 17200 - DNA, 201 bp, Homo sapiens; identical to SEQ ID NO: 17118

SEQ ID NO: 17201 - DNA, 201 bp, Homo sapiens; identical to SEQ ID NO: 17119

SEQ ID NO: 17202 - DNA, 201 bp, Homo sapiens
agagaagggagacaagggagaagctggtcccccaggccgccccgggctggcaggacacaaaggagagatgggggagcctggtgtgccgggccagtcggggrcccctggcaaggagggcctgatcggtcccaagggtgaccgaggctttgacgggcagccaggccccaagggtgaccagggcgagaaaggggagcggggaac

SEQ ID NO: 17203 - DNA, 201 bp, Homo sapiens; identical to SEQ ID NO: 17120

SEQ ID NO: 17204 - DNA, 201 bp, Homo sapiens; identical to SEQ ID NO: 17121

SEQ ID NO: 17205 - DNA, 201 bp, Homo sapiens; identical to SEQ ID NO: 17122

SEQ ID NO: 17206 - DNA, 201 bp, Homo sapiens; identical to SEQ ID NO: 17123

SEQ ID NO: 17207 - DNA, 201 bp, Homo sapiens; identical to SEQ ID NO: 17124

SEQ ID NO: 17208 - DNA, 201 bp, Homo sapiens; identical to SEQ ID NO: 17125

SEQ ID NO: 17209 - DNA, 201 bp, Homo sapiens; identical to SEQ ID NO: 17126

SEQ ID NO: 17210 - DNA, 201 bp, Homo sapiens; identical to SEQ ID NO: 17127

SEQ ID NO: 17211 - DNA, 201 bp, Homo sapiens; identical to SEQ ID NO: 17128

SEQ ID NO: 17212 - DNA, 201 bp, Homo sapiens; identical to SEQ ID NO: 17129

SEQ ID NO: 17213 - DNA, 201 bp, Homo sapiens; identical to SEQ ID NO: 17130

SEQ ID NO: 17214 - DNA, 201 bp, Homo sapiens; identical to SEQ ID NO: 17131

SEQ ID NO: 17215 - DNA, 201 bp, Homo sapiens; identical to SEQ ID NO: 17132

SEQ ID NO: 17216 - DNA, 201 bp, Homo sapiens; identical to SEQ ID NO: 17133

SEQ ID NO: 17217 - DNA, 201 bp, Homo sapiens; identical to SEQ ID NO: 17134

SEQ ID NO: 17218 - DNA, 201 bp, Homo sapiens; identical to SEQ ID NO: 17135

SEQ ID NO: 17219 - DNA, 201 bp, Homo sapiens; identical to SEQ ID NO: 17136

SEQ ID NO: 17220 - DNA, 201 bp, Homo sapiens; identical to SEQ ID NO: 17137

SEQ ID NO: 17221 - DNA, 201 bp, Homo sapiens; identical to SEQ ID NO: 17138

SEQ ID NO: 17222 - DNA, 201 bp, Homo sapiens; identical to SEQ ID NO: 17139

SEQ ID NO: 17223 - DNA, 201 bp, Homo sapiens; identical to SEQ ID NO: 17140

SEQ ID NO: 17224 - DNA, 201 bp, Homo sapiens; identical to SEQ ID NO: 17141

SEQ ID NO: 17225 - DNA, 201 bp, Homo sapiens; identical to SEQ ID NO: 17142

SEQ ID NO: 17226 - DNA, 201 bp, Homo sapiens; identical to SEQ ID NO: 17143

SEQ ID NO: 17227 - DNA, 201 bp, Homo sapiens; identical to SEQ ID NO: 17144

SEQ ID NO: 17228 - DNA, 201 bp, Homo sapiens; identical to SEQ ID NO: 17145

SEQ ID NO: 17229 - DNA, 201 bp, Homo sapiens; identical to SEQ ID NO: 17146

SEQ ID NO: 17230 - DNA, 201 bp, Homo sapiens; identical to SEQ ID NO: 17147

SEQ ID NO: 17231 - DNA, 201 bp, Homo sapiens; identical to SEQ ID NO: 17148

SEQ ID NO: 17232 - DNA, 201 bp, Homo sapiens; identical to SEQ ID NO: 17149

SEQ ID NO: 17233 - DNA, 201 bp, Homo sapiens; identical to SEQ ID NO: 17150

SEQ ID NO: 17234 - DNA, 201 bp, Homo sapiens; identical to SEQ ID NO: 17151

SEQ ID NO: 17235 - DNA, 201 bp, Homo sapiens; identical to SEQ ID NO: 17152

SEQ ID NO: 17236 - DNA, 201 bp, Homo sapiens; identical to SEQ ID NO: 17154

SEQ ID NO: 17237 - DNA, 201 bp, Homo sapiens; identical to SEQ ID NO: 17155

SEQ ID NO: 17238 - DNA, 201 bp, Homo sapiens; identical to SEQ ID NO: 17156

SEQ ID NO: 17239 - DNA, 201 bp, Homo sapiens; identical to SEQ ID NO: 17157

SEQ ID NO: 17240 - DNA, 201 bp, Homo sapiens; identical to SEQ ID NO: 17158

SEQ ID NO: 17241 - DNA, 201 bp, Homo sapiens
gggggacatgggtgaacgagggcctcggggcttggatggtgacaaaggacctcggggagacaatggggaccctggtgacaagggcagcaagggagagcctsgtgacaagggctcagccgggttgccaggactgcgtggactcctgggaccccagggtcaacctggtgcagcagggatccctggtgacccgggatccccagg

SEQ ID NO: 17242 - DNA, 201 bp, Homo sapiens; identical to SEQ ID NO: 17190

SEQ ID NO: 17243 - DNA, 201 bp, Homo sapiens; identical to SEQ ID NO: 17161

SEQ ID NO: 17244 - DNA, 201 bp, Homo sapiens; identical to SEQ ID NO: 17162

SEQ ID NO: 17245 - DNA, 201 bp, Homo sapiens; identical to SEQ ID NO: 17163

SEQ ID NO: 17246 - DNA, 201 bp, Homo sapiens; identical to SEQ ID NO: 17164

SEQ ID NO: 17247 - DNA, 201 bp, Homo sapiens; identical to SEQ ID NO: 17165

SEQ ID NO: 17248 - DNA, 201 bp, Homo sapiens; identical to SEQ ID NO: 17166

SEQ ID NO: 17249 - DNA, 201 bp, Homo sapiens; identical to SEQ ID NO: 17167

SEQ ID NO: 17250 - DNA, 201 bp, Homo sapiens
ccccgggctggcaggacacaaaggagagatgggggagcctggtgtgccgggccagtcgggggcccctggcaaggagggcctgatcggtcccaagggtgacygaggctttgacgggcagccaggccccaagggtgaccagggcgagaaaggggagcggggaaccccaggaattgggggcttcccaggccccagtggaaatga

SEQ ID NO: 17251 - DNA, 201 bp, Homo sapiens; identical to SEQ ID NO: 17168

SEQ ID NO: 17252 - DNA, 201 bp, Homo sapiens; identical to SEQ ID NO: 17183

SEQ ID NO: 17253 - DNA, 201 bp, Homo sapiens; identical to SEQ ID NO: 17169

SEQ ID NO: 17254 - DNA, 201 bp, Homo sapiens; identical to SEQ ID NO: 17184

SEQ ID NO: 17255 - DNA, 201 bp, Homo sapiens; identical to SEQ ID NO: 17170

SEQ ID NO: 17256 - DNA, 201 bp, Homo sapiens; identical to SEQ ID NO: 17171

SEQ ID NO: 17257 - DNA, 201 bp, Homo sapiens; identical to SEQ ID NO: 17172

SEQ ID NO: 17258 - DNA, 201 bp, Homo sapiens; identical to SEQ ID NO: 17173

SEQ ID NO: 17259 - DNA, 201 bp, Homo sapiens; identical to SEQ ID NO: 17174

SEQ ID NO: 17260 - DNA, 201 bp, Homo sapiens; identical to SEQ ID NO: 17176

SEQ ID NO: 17261 - DNA, 201 bp, Homo sapiens; identical to SEQ ID NO: 17186

SEQ ID NO: 17262 - DNA, 201 bp, Homo sapiens; identical to SEQ ID NO: 17161

SEQ ID NO: 17263 - DNA, 201 bp, Homo sapiens; identical to SEQ ID NO: 17250

SEQ ID NO: 17264 - DNA, 201 bp, Homo sapiens; identical to SEQ ID NO: 17162

SEQ ID NO: 17265 - DNA, 201 bp, Homo sapiens; identical to SEQ ID NO: 17183

SEQ ID NO: 17266 - DNA, 201 bp, Homo sapiens
ctgatccccggtgtcctgttggtctccagggagaccctggagtagggctgcctgggccccgaggcgagcgtggggagccaggcatccgggtacgtatgtcwtactccacagccgaactcccttcatcccagctcttgcctctgatttccaacctctgagtcaatgaacctaatgtcaccatccagggtgaagatggccgcc

SEQ ID NO: 17267 - DNA, 201 bp, Homo sapiens; identical to SEQ ID NO: 17184

SEQ ID NO: 17268 - DNA, 201 bp, Homo sapiens; identical to SEQ ID NO: 17202

SEQ ID NO: 17269 - DNA, 201 bp, Homo sapiens; identical to SEQ ID NO: 17186

SEQ ID NO: 17270 - DNA, 201 bp, Homo sapiens; identical to SEQ ID NO: 17158

SEQ ID NO: 17271 - DNA, 201 bp, Homo sapiens; identical to SEQ ID NO: 17241

SEQ ID NO: 17272 - DNA, 201 bp, Homo sapiens; identical to SEQ ID NO: 17190

SEQ ID NO: 17273 - DNA, 201 bp, Homo sapiens
ggaggagctgcgccgcagcctggctccctatgctcaggacacgcaggagaagctcaaccaccagcttgagggcctgaccttccagatgaagaagaacgccraggagctcaaggccaggatctcggccagtgccgaggagctgcggcagaggctggcgcccttggccgaggacgtgcgtggcaacctgaggggcaacaccga

SEQ ID NO: 17274 - DNA, 201 bp, Homo sapiens
caggtcaacacgcaggccgagcagctgcggcgccagctgaccccctacgcacagcgcatggagagagtgctgcgggagaacgccgacagcctgcaggcctygctgaggccccacgccgacgagctcaaggccaagatcgaccagaacgtggaggagctcaagggacgccttacgccctacgctgacgaattcaaagtcaag

SEQ ID NO: 17275 - DNA, 201 bp, Homo sapiens
gggggacgtggaaggccacttgagcttcctggagaaggacctgagggacaaggtcaactccttcttcagcaccttcaaggagaaagagagccaggacaagwctctctccctccctgagctggagcaacagcaggaacagcagcaggagcagcagcaggagcaggtgcagatgctggcccctttggagagctgagctgcccc

SEQ ID NO: 17276 - DNA, 201 bp, Homo sapiens
cgtgcgtggcaacctgaggggcaacaccgaggggctgcagaagtcactggcagagctgggtgggcacctggaccagcaggtggaggagttccgacgccggstggagccctacggggaaaacttcaacaaagccctggtgcagcagatggaacagctcaggcagaaactgggcccccatgcgggggacgtggaaggccactt

SEQ ID NO: 17277 - DNA, 201 bp, Homo sapiens
gcaacaatgccaaggaggccgtggaacatctccagaaatctgaactcacccagcaactcaatgccctcttccaggacaaacttggagaagtgaacacttaygcaggtgacctgcagaagaagctggtgccctttgccaccgagctgcatgaacgcctggccaaggactcggagaaactgaaggaggagattgggaaggagc

SEQ ID NO: 17278 - DNA, 201 bp, Homo sapiens
gcaagcagctcaggatgttcctgaaggccgtggtcctgaccctggccctggtggctgtcgccggagccagggctgaggtcagtgctgaccaggtggccacrgtgatgtgggactacttcagccagctgagcaacaatgccaaggaggccgtggaacatctccagaaatctgaactcacccagcaactcaatgccctcttcc

SEQ ID NO: 17279 - DNA, 201 bp, Homo sapiens
caatgccaaggaggccgtggaacatctccagaaatctgaactcacccagcaactcaatgccctcttccaggacaaacttggagaagtgaacacttacgcargtgacctgcagaagaagctggtgccctttgccaccgagctgcatgaacgcctggccaaggactcggagaaactgaaggaggagattgggaaggagctgga

SEQ ID NO: 17280 - DNA, 201 bp, Homo sapiens
tccgacgccgggtggagccctacggggaaaacttcaacaaagccctggtgcagcagatggaacagctcaggcagaaactgggcccccatgcgggggacgtkgaaggccacttgagcttcctggagaaggacctgagggacaaggtcaactccttcttcagcaccttcaaggagaaagagagccaggacaagactctctccc

SEQ ID NO: 17281 - DNA, 201 bp, Homo sapiens
atgccaaggaggccgtggaacatctccagaaatctgaactcacccagcaactcaatgccctcttccaggacaaacttggagaagtgaacacttacgcaggygacctgcagaagaagctggtgccctttgccaccgagctgcatgaacgcctggccaaggactcggagaaactgaaggaggagattgggaaggagctggagg

SEQ ID NO: 17282 - DNA, 116 bp, Homo sapiens
agttcccactgcagcrcaggtgagctctcctgaggacctctctgtcagctcccctgattgtagggaggatccagtgtggcaagaaactcctccagcccagcaagcagctcaggatg

SEQ ID NO: 17283 - DNA, 201 bp, Homo sapiens
tgagggacaaggtcaactccttcttcagcaccttcaaggagaaagagagccaggacaagactctctccctccctgagctggagcaacagcaggaacagcakcaggagcagcagcaggagcaggtgcagatgctggcccctttggagagctgagctgcccctggtgcactggccccaccctcgtggacacctgccctgccct

SEQ ID NO: 17284 - DNA, 201 bp, Homo sapiens
ctgccccatgccaatgaggtgagccagaagatcggggacaacctgcgagagcttcagcagcgcctggagccctacgcggaccagctgcgcacccaggtcarcacgcaggccgagcagctgcggcgccagctgaccccctacgcacagcgcatggagagagtgctgcgggagaacgccgacagcctgcaggcctcgctgagg

SEQ ID NO: 17285 - DNA, 201 bp, Homo sapiens
ctcaggacacgcaggagaagctcaaccaccagcttgagggcctgaccttccagatgaagaagaacgccgaggagctcaaggccaggatctcggccagtgcygaggagctgcggcagaggctggcgcccttggccgaggacgtgcgtggcaacctgaggggcaacaccgaggggctgcagaagtcactggcagagctgggtg

SEQ ID NO: 17286 - DNA, 201 bp, Homo sapiens
caggagaagctcaaccaccagcttgagggcctgaccttccagatgaagaagaacgccgaggagctcaaggccaggatctcggccagtgccgaggagctgcrgcagaggctggcgcccttggccgaggacgtgcgtggcaacctgaggggcaacaccgaggggctgcagaagtcactggcagagctgggtgggcacctggac

SEQ ID NO: 17287 - DNA, 201 bp, Homo sapiens
ccgaggagctcaaggccaggatctcggccagtgccgaggagctgcggcagaggctggcgcccttggccgaggacgtgcgtggcaacctgaggggcaacacygaggggctgcagaagtcactggcagagctgggtgggcacctggaccagcaggtggaggagttccgacgccgggtggagccctacggggaaaacttcaaca

SEQ ID NO: 17288 - DNA, 201 bp, Homo sapiens
tgcggcagaggctggcgcccttggccgaggacgtgcgtggcaacctgaggggcaacaccgaggggctgcagaagtcactggcagagctgggtgggcacctrgaccagcaggtggaggagttccgacgccgggtggagccctacggggaaaacttcaacaaagccctggtgcagcagatggaacagctcaggcagaaactgg

SEQ ID NO: 17289 - DNA, 201 bp, Homo sapiens
ccaatgaggtgagccagaagatcggggacaacctgcgagagcttcagcagcgcctggagccctacgcggaccagctgcgcacccaggtcaacacgcaggcygagcagctgcggcgccagctgaccccctacgcacagcgcatggagagagtgctgcgggagaacgccgacagcctgcaggcctcgctgaggccccacgccg

SEQ ID NO: 17290 - DNA, 201 bp, Homo sapiens
cctgcgagagcttcagcagcgcctggagccctacgcggaccagctgcgcacccaggtcaacacgcaggccgagcagctgcggcgccagctgaccccctackcacagcgcatggagagagtgctgcgggagaacgccgacagcctgcaggcctcgctgaggccccacgccgacgagctcaaggccaagatcgaccagaacgt

SEQ ID NO: 17291 - DNA, 201 bp, Homo sapiens
aagaagaacgccgaggagctcaaggccaggatctcggccagtgccgaggagctgcggcagaggctggcgcccttggccgaggacgtgcgtggcaacctgargggcaacaccgaggggctgcagaagtcactggcagagctgggtgggcacctggaccagcaggtggaggagttccgacgccgggtggagccctacggggaa

SEQ ID NO: 17292 - DNA, 201 bp, Homo sapiens; identical to SEQ ID NO: 17286

SEQ ID NO: 17293 - DNA, 201 bp, Homo sapiens; identical to SEQ ID NO: 17278

SEQ ID NO: 17294 - DNA, 201 bp, Homo sapiens; identical to SEQ ID NO: 17290

SEQ ID NO: 17295 - DNA, 201 bp, Homo sapiens; identical to SEQ ID NO: 17274

SEQ ID NO: 17296 - DNA, 201 bp, Homo sapiens; identical to SEQ ID NO: 17291

SEQ ID NO: 17297 - DNA, 201 bp, Homo sapiens; identical to SEQ ID NO: 17277

SEQ ID NO: 17298 - DNA, 201 bp, Homo sapiens; identical to SEQ ID NO: 17279

SEQ ID NO: 17299 - DNA, 201 bp, Homo sapiens; identical to SEQ ID NO: 17281

SEQ ID NO: 17300 - DNA, 201 bp, Homo sapiens; identical to SEQ ID NO: 17284

SEQ ID NO: 17301 - DNA, 201 bp, Homo sapiens; identical to SEQ ID NO: 17285

SEQ ID NO: 17302 - DNA, 201 bp, Homo sapiens; identical to SEQ ID NO: 17287

SEQ ID NO: 17303 - DNA, 201 bp, Homo sapiens
tgcggcagaggctggcgcccttggccgaggacgtgcgtggcaacctgaggggcaacaccgaggggctgcagaagtcactggcagagctgggtgggcacctrgaccagcaggtggaggagttccgacgccgggtggagccctacggggaaaacttcaacaaagccctggtgcagcagatggaacagctcaggacgaaactgg

SEQ ID NO: 17304 - DNA, 201 bp, Homo sapiens
cgtgcgtggcaacctgaggggcaacaccgaggggctgcagaagtcactggcagagctgggtgggcacctggaccagcaggtggaggagttccgacgccggstggagccctacggggaaaacttcaacaaagccctggtgcagcagatggaacagctcaggacgaaactgggcccccatgcgggggacgtggaaggccactt

SEQ ID NO: 17305 - DNA, 201 bp, Homo sapiens
tccgacgccgggtggagccctacggggaaaacttcaacaaagccctggtgcagcagatggaacagctcaggacgaaactgggcccccatgcgggggacgtkgaaggccacttgagcttcctggagaaggacctgagggacaaggtcaactccttcttcagcaccttcaaggagaaagagagccaggacaagactctctccc

SEQ ID NO: 17306 - DNA, 201 bp, Homo sapiens; identical to SEQ ID NO: 17283

SEQ ID NO: 17307 - DNA, 201 bp, Homo sapiens; identical to SEQ ID NO: 17289

SEQ ID NO: 17308 - DNA, 201 bp, Homo sapiens; identical to SEQ ID NO: 17273

SEQ ID NO: 17309 - DNA, 201 bp, Homo sapiens
gggggacgtggaaggccacttgagcttcctggagaaggacctgagggacaaggtcaactccttcttcagcaccttcaaggagaaagagagccaggacaagwctctctccctccctgagctggagcaacagcaggaacagcatcaggagcagcagcaggagcaggtgcagatgctggcccctttggagagctgagctgcccc

SEQ ID NO: 17310 - DNA, 201 bp, Homo sapiens
gacaggcaaggggatggagagggcttgccttccctcccgcctgaccttcctcagtcatttctgcaaagccaaggggcagcctcctgtcaaggtagctagargcctgggaaaggagatagccttgctccggcccccttgaccttcagcaaatcacttctctccctgcgctcacacagacacacacacacacacgtacatgca

SEQ ID NO: 17311 - DNA, 201 bp, Homo sapiens
ccaggtcaccaaggaacaatcctgtcccccctgaggccaaaagccctgtcctgaacccaggggaacgcccggcagatgtgtccccaacatccccacagccmgagggcctccttgtcctgcagcaagtgggcgactattgcttcctccccggcctggggcccggccctctctcgctccggagtaaaccttcttccccgggac

SEQ ID NO: 17312 - DNA, 201 bp, Homo sapiens
ggtattttttaactgggccaagcccattaaggtctttcttctgttgggtgctatcattttctgattaagtctttttgactattgacatacagtctttcacrgatggtggagtgtttttcccccaaatctgttgtttgtcttataatgttgtatatgaggttttatggtgtatgaatatgaatgcttctgtaatgtcaaaca

SEQ ID NO: 17313 - DNA, 201 bp, Homo sapiens
gaagtccccacctccagggtccctggagtacctgtgtctgcctgctggggggcaggtgcaactggtccctctggcccaggcgatgggaccgggacaggccrtggaagtggagagaaggccgagccagggggctgcagggagtccctccctggagtccgggggaggccctgcccctcctgctcttgggccaagggtgggagg

SEQ ID NO: 17314 - DNA, 201 bp, Homo sapiens
cctggccccaggttctcggctctcaggacgtcccagcaagtggagcccagaggtttgctgggactcccagccaggggatgaggcccagccccagaacctgsagtgcttctttgacggggccgccgtgctcagctgctcctgggaggtgaggaaggaggtggccagctcggtctcctttggcctattctacaagcccagccc

SEQ ID NO: 17315 - DNA, 201 bp, Homo sapiens
cagacacacacacacacacgtacatgcacacatttttcctgtcaggttaacttatttgtaggttctgcattattagaactttctagatatactcattccawctccccctcatttttttaatcaggtttccttgcttttgccatttttcttccttcttttttcactgatttattatgagagtggggctgaggtctgagctga

SEQ ID NO: 17316 - DNA, 201 bp, Homo sapiens
tggagctccctccaattgagggccggtcccccaggtcaccaaggaacaatcctgtcccccctgaggccaaaagccctgtcctgaacccaggggaacgcccrgcagatgtgtccccaacatccccacagcccgagggcctccttgtcctgcagcaagtgggcgactattgcttcctccccggcctggggcccggccctctct

SEQ ID NO: 17317 - DNA, 201 bp, Homo sapiens
acctcatgcccagcagcacctacgtggcccgagtacggacccgcctggccccaggttctcggctctcaggacgtcccagcaagtggagcccagaggtttgytgggactcccagccaggggatgaggcccagccccagaacctggagtgcttctttgacggggccgccgtgctcagctgctcctgggaggtgaggaaggagg

SEQ ID NO: 17318 - DNA, 201 bp, Homo sapiens
gtgggagccagaagtccccacctccagggtccctggagtacctgtgtctgcctgctggggggcaggtgcaactggtccctctggcccaggcgatgggaccrggacaggccgtggaagtggagagaaggccgagccagggggctgcagggagtccctccctggagtccgggggaggccctgcccctcctgctcttgggccaa

SEQ ID NO: 17319 - DNA, 201 bp, Homo sapiens
gagggtgggagccagaagtccccacctccagggtccctggagtacctgtgtctgcctgctggggggcaggtgcaactggtccctctggcccaggcgatggkaccgggacaggccgtggaagtggagagaaggccgagccagggggctgcagggagtccctccctggagtccgggggaggccctgcccctcctgctcttggg

SEQ ID NO: 17320 - DNA, 201 bp, Homo sapiens
gagccctgctagttgtctcagtgatgtctgtgggacctccagtcccttgagaccccacgtcatgtagagaagttaacggcccaagtggtgggcaggctggygggacctggggaacatcaggagaggagtccagagcccacgtctactgcggaaaagtcaggggaaactgccaaacaaaggaaaatgccccaaaggcatata

SEQ ID NO: 17321 - DNA, 201 bp, Homo sapiens
ccagccaggcccgcctgccgcctcccacacacctgagaaacaggcttccagctttgacttcaatgggccctacctggggccgccccacagccgctccctamctgacatcctgggccagccggagcccccacaggagggtgggagccagaagtccccacctccagggtccctggagtacctgtgtctgcctgctggggggca

SEQ ID NO: 17322 - DNA, 201 bp, Homo sapiens
atcaggtttccttgcttttgccatttttcttccttcttttttcactgatttattatgagagtggggctgaggtctgagctgagccttatcagactgagatkcagctggttgtgttgaggacttgtgtgggctgcctgtccccggcagtcgctgatgcacatgacatgattctcatctgggtgcagaggtgggaggcaccag

SEQ ID NO: 17323 - DNA, 201 bp, Homo sapiens
tgcagggagtccctccctggagtccgggggaggccctgcccctcctgctcttgggccaagggtgggaggacaggaccaaaaggacagccctgtggctatayccatgagctctggggacactgaggaccctggagtggcctctggttatgtctcctctgcagacctggtattcaccccaaactcaggggcctcgtctgtctc

SEQ ID NO: 17324 - DNA, 201 bp, Homo sapiens
acgcccacagcatggccctgccagccctggagccctccaccaggtactgggccagggtgagggtcaggacctcccgcaccggctacaacgggatctggagygagtggagtgaggcgcgctcctgggacaccgagtcggtgctgcctatgtgggtgctggccctcatcgtgatcttcctcaccatcgctgtgctcctggccc

SEQ ID NO: 17325 - DNA, 198 bp, Homo sapiens
gcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctc

SEQ ID NO: 17326 - DNA, 201 bp, Homo sapiens
acgtgaccctcattcgccgggtgaatgaggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccg

SEQ ID NO: 17327 - DNA, 201 bp, Homo sapiens
ctggagtgtggcccttgggagtccccagagccactggttgtccccaggggatctggagtttgaggtggtctacaagcggcttcaggactcttgggaggacrcagccatcctcctctccaacacctcccaggccaccctggggccagagcacctcatgcccagcagcacctacgtggcccgagtacggacccgcctggcccc

SEQ ID NO: 17328 - DNA, 201 bp, Homo sapiens; identical to SEQ ID NO: 17310

SEQ ID NO: 17329 - DNA, 201 bp, Homo sapiens; identical to SEQ ID NO: 17311

SEQ ID NO: 17330 - DNA, 201 bp, Homo sapiens; identical to SEQ ID NO: 17312

SEQ ID NO: 17331 - DNA, 201 bp, Homo sapiens; identical to SEQ ID NO: 17313

SEQ ID NO: 17332 - DNA, 201 bp, Homo sapiens; identical to SEQ ID NO: 17314

SEQ ID NO: 17333 - DNA, 201 bp, Homo sapiens; identical to SEQ ID NO: 17315

SEQ ID NO: 17334 - DNA, 201 bp, Homo sapiens; identical to SEQ ID NO: 17316

SEQ ID NO: 17335 - DNA, 201 bp, Homo sapiens; identical to SEQ ID NO: 17317

SEQ ID NO: 17336 - DNA, 201 bp, Homo sapiens; identical to SEQ ID NO: 17318

SEQ ID NO: 17337 - DNA, 201 bp, Homo sapiens; identical to SEQ ID NO: 17319

SEQ ID NO: 17338 - DNA, 201 bp, Homo sapiens; identical to SEQ ID NO: 17320

SEQ ID NO: 17339 - DNA, 201 bp, Homo sapiens; identical to SEQ ID NO: 17321

SEQ ID NO: 17340 - DNA, 201 bp, Homo sapiens; identical to SEQ ID NO: 17322

SEQ ID NO: 17341 - DNA, 201 bp, Homo sapiens; identical to SEQ ID NO: 17323

SEQ ID NO: 17342 - DNA, 201 bp, Homo sapiens; identical to SEQ ID NO: 17324

SEQ ID NO: 17343 - DNA, 201 bp, Homo sapiens
gaggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctc

SEQ ID NO: 17344 - DNA, 201 bp, Homo sapiens; identical to SEQ ID NO: 17326

SEQ ID NO: 17345 - DNA, 201 bp, Homo sapiens; identical to SEQ ID NO: 17327

SEQ ID NO: 17346 - DNA, 201 bp, Homo sapiens; identical to SEQ ID NO: 17310

SEQ ID NO: 17347 - DNA, 201 bp, Homo sapiens; identical to SEQ ID NO: 17311

SEQ ID NO: 17348 - DNA, 201 bp, Homo sapiens; identical to SEQ ID NO: 17312

SEQ ID NO: 17349 - DNA, 201 bp, Homo sapiens; identical to SEQ ID NO: 17313

SEQ ID NO: 17350 - DNA, 201 bp, Homo sapiens; identical to SEQ ID NO: 17314

SEQ ID NO: 17351 - DNA, 201 bp, Homo sapiens; identical to SEQ ID NO: 17315

SEQ ID NO: 17352 - DNA, 201 bp, Homo sapiens; identical to SEQ ID NO: 17316

SEQ ID NO: 17353 - DNA, 201 bp, Homo sapiens; identical to SEQ ID NO: 17317

SEQ ID NO: 17354 - DNA, 201 bp, Homo sapiens; identical to SEQ ID NO: 17318

SEQ ID NO: 17355 - DNA, 201 bp, Homo sapiens; identical to SEQ ID NO: 17319

SEQ ID NO: 17356 - DNA, 201 bp, Homo sapiens; identical to SEQ ID NO: 17320

SEQ ID NO: 17357 - DNA, 201 bp, Homo sapiens; identical to SEQ ID NO: 17321

SEQ ID NO: 17358 - DNA, 201 bp, Homo sapiens; identical to SEQ ID NO: 17322

SEQ ID NO: 17359 - DNA, 201 bp, Homo sapiens; identical to SEQ ID NO: 17323

SEQ ID NO: 17360 - DNA, 201 bp, Homo sapiens; identical to SEQ ID NO: 17324

SEQ ID NO: 17361 - DNA, 201 bp, Homo sapiens; identical to SEQ ID NO: 17343

SEQ ID NO: 17362 - DNA, 201 bp, Homo sapiens; identical to SEQ ID NO: 17326

SEQ ID NO: 17363 - DNA, 201 bp, Homo sapiens; identical to SEQ ID NO: 17327

SEQ ID NO: 17364 - DNA, 201 bp, Homo sapiens
aaactggcaaggtcaaacctggttccacttgcgtcgtctttggcctgggaggagttggcctgtcagtcatcatgggctgtaagtcagctggtgcatctagratcattgggattgacctcaacaaagacaaatttgagaaggccatggctgtaggtgccactgagtgtatcagtcccaaggactctaccaaacccatcagtg

SEQ ID NO: 17365 - DNA, 201 bp, Homo sapiens
ttccacttgcgtcgtctttggcctgggaggagttggcctgtcagtcatcatgggctgtaagtcagctggtgcatctaggatcattgggattgacctcaacraagacaaatttgagaaggccatggctgtaggtgccactgagtgtatcagtcccaaggactctaccaaacccatcagtgaggtgctgtcagaaatgacagg

SEQ ID NO: 17366 - DNA, 201 bp, Homo sapiens
ttctatgttgaaatggagatttttaagagttttaaccagctgctgcagatatataactcaaaacagatatagcgtataaagatatagtaaatgcatctccyagagtaatattcacttaacacattgaaactattattttttagatttgaatataaatgtattttttaaacacttgttatgagttaacttggattacatttt

SEQ ID NO: 17367 - DNA, 201 bp, Homo sapiens
gtcgcaacccagatggcaacctttgcattaggagcgatattactggtcgtggagtactggctgatggcaccaccagatttacatgcaagggcaaaccagtmcaccacttcatgaacaccagtacatttaccgagtacacagtggtggatgaatcttctgttgctaagattgatgatgcagctcctcctgagaaagtctgtt

SEQ ID NO: 17368 - DNA, 201 bp, Homo sapiens
gggatgtgtctttggaggtttgaaaagcagagatgatgtcccaaaactagtgactgagttcctggcaaagaaatttgacctggaccagttgataactcatrttttaccatttaaaaaaatcagtgaaggatttgagctgctcaattcaggacaaagcattcgaacggtcctgacgttttgagatccaaagtggcaggaggt

SEQ ID NO: 17369 - DNA, 201 bp, Homo sapiens
tgtcgcacagatgaccatgtgataaaaggaacaatggtgtccaagtttccagtgattgtgggacatgaggcaactgggattgtagagagcattggagaagsagtgactacagtgaaaccaggtgacaaagtcatccctctctttctgccacaatgtagagaatgcaatgcttgtcgcaacccagatggcaacctttgcatt

SEQ ID NO: 17370 - DNA, 201 bp, Homo sapiens
gaaaatattccttttgtaatactgaatataaacatagagctagaatcatattatcatacttatcataatgttcaatttgatacagtagaattgcaagtccytaagtccctattcactgtgcttagtagtgactccatttaataaaaagtgtttttagtttttaacaactacactgatgtatctatatatatctataacatg

SEQ ID NO: 17371 - DNA, 201 bp, Homo sapiens
ttgtaaggctataattgtatcttttaagaaaacatacacttggatttctatgttgaaatggagatttttaagagttttaaccagctgctgcagatatatawctcaaaacagatatagcgtataaagatatagtaaatgcatctcctagagtaatattcacttaacacattgaaactattattttttagatttgaatataaa

SEQ ID NO: 17372 - DNA, 201 bp, Homo sapiens
gtaaatgcatctcctagagtaatattcacttaacacattgaaactattattttttagatttgaatataaatgtattttttaaacacttgttatgagttaasttggattacattttgaaatcagttcattccatgatgcatattactggattagattaagaaagacagaaaagattaagggacgggcacatttttcaacgat

SEQ ID NO: 17373 - DNA, 201 bp, Homo sapiens
ggtgacaaagtcatccctctctttctgccacaatgtagagaatgcaatgcttgtcgcaacccagatggcaacctttgcattaggagcgatattactggtcrtggagtactggctgatggcaccaccagatttacatgcaagggcaaaccagtccaccacttcatgaacaccagtacatttaccgagtacacagtggtggat

SEQ ID NO: 17374 - DNA, 201 bp, Homo sapiens
aaaaagtatatcatatgggtacacaaggctatttgccagcatatattaatattttagaaaatattccttttgtaatactgaatataaacatagagctagartcatattatcatacttatcataatgttcaatttgatacagtagaattgcaagtccctaagtccctattcactgtgcttagtagtgactccatttaataaa

SEQ ID NO: 17375 - DNA, 201 bp, Homo sapiens
aaagaattattaacctttataaacatttaaagtcttgtgagcacctgggaattagtataataacaatgttaatatttttgatttacattttgtaaggctayaattgtatcttttaagaaaacatacacttggatttctatgttgaaatggagatttttaagagttttaaccagctgctgcagatatataactcaaaacaga

SEQ ID NO: 17376 - DNA, 125 bp, Homo sapiens
atgtgaaggcacaagctgctgttayatacaacagagtgaactgagcatcagtcagaaaaagtctatgtttgcagaaatacagatccaagacaaagacaggatgggcactgctggaaaagttatta

SEQ ID NO: 17377 - DNA, 201 bp, Homo sapiens
ctcatgttttaccatttaaaaaaatcagtgaaggatttgagctgctcaattcaggacaaagcattcgaacggtcctgacgttttgagatccaaagtggcargaggtctgtgttgtcatggtgaactggagtttctcttgtgagagttccctcatctgaaatcatgtatctgtctcacaaatacaagcataagtagaagatt

SEQ ID NO: 17378 - DNA, 201 bp, Homo sapiens; identical to SEQ ID NO: 17366

SEQ ID NO: 17379 - DNA, 201 bp, Homo sapiens; identical to SEQ ID NO: 17377

SEQ ID NO: 17380 - DNA, 201 bp, Homo sapiens; identical to SEQ ID NO: 17368

SEQ ID NO: 17381 - DNA, 201 bp, Homo sapiens; identical to SEQ ID NO: 17365

SEQ ID NO: 17382 - DNA, 201 bp, Homo sapiens; identical to SEQ ID NO: 17364

SEQ ID NO: 17383 - DNA, 201 bp, Homo sapiens
gtaaatgcatctcccagagtaatattcacttaacacattgaaactattattttttagatttgaatataaatgtattttttaaacacttgttatgagttaasttggattacattttgaaatcagttcattccatgatgcatattactggattagattaagaaagacagaaaagattaagggacgggcacatttttcaacgat

SEQ ID NO: 17384 - DNA, 201 bp, Homo sapiens; identical to SEQ ID NO: 17367

SEQ ID NO: 17385 - DNA, 201 bp, Homo sapiens; identical to SEQ ID NO: 17369

SEQ ID NO: 17386 - DNA, 175 bp, Homo sapiens
gaaaatattccttttgtaatactgaatataaacatagagctagagtcatattatcatacttatcataatgttcaatttgatacagtagaattgcaagtccytaagtccctattcactgtgcttagtagtgactccatttaataaaaagtgtttttagtttttaacaactaaaccg

SEQ ID NO: 17387 - DNA, 201 bp, Homo sapiens
ttgtaaggctataattgtatcttttaagaaaacatacacttggatttctatgttgaaatggagatttttaagagttttaaccagctgctgcagatatatawctcaaaacagatatagcgtataaagatatagtaaatgcatctcccagagtaatattcacttaacacattgaaactattattttttagatttgaatataaa

SEQ ID NO: 17388 - DNA, 201 bp, Homo sapiens
ggtgacaaagtcatccctctctttctgccacaatgtagagaatgcaatgcttgtcgcaacccagatggcaacctttgcattaggagcgatattactggtcrtggagtactggctgatggcaccaccagatttacatgcaagggcaaaccagtacaccacttcatgaacaccagtacatttaccgagtacacagtggtggat

SEQ ID NO: 17389 - DNA, 201 bp, Homo sapiens; identical to SEQ ID NO: 17374

SEQ ID NO: 17390 - DNA, 201 bp, Homo sapiens; identical to SEQ ID NO: 17375

SEQ ID NO: 17391 - DNA, 201 bp, Homo sapiens
actttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccag

SEQ ID NO: 17392 - DNA, 201 bp, Homo sapiens
aagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatg

SEQ ID NO: 17393 - DNA, 201 bp, Homo sapiens
cgtctgctgtgactgggatcaccaccagcatcgtggagcactcatacacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatcc

SEQ ID NO: 17394 - DNA, 201 bp, Homo sapiens
agaaacgctttactgaagaggccaccaaatacttccgggagagagtcagcccagtgcatctgcaaatcctgctgactaacaatgaagcctggaagagattygtgactgcggctgaattgcccagggatgaggcagatgctctctacgaagctctgaagaagcttagaacatatgcagctattgaggacgaatatgtgcagc

SEQ ID NO: 17395 - DNA, 201 bp, Homo sapiens
ttacagcagggacgagtctggcccttactgcagctggggtagggctgggagcagcgtctgctgtgactgggatcaccaccagcatcgtggagcactcatayacatcatcagcagaagctgaagccagcaggctgactgcaaccagcattgaccgattgaaggtatttaaggaagttatgcgtgacatcacacccaacttac

SEQ ID NO: 17396 - DNA, 201 bp, Homo sapiens
tggcatcatgtcccttgctggtcttgttttggcaccatttacagcagggacgagtctggcccttactgcagctggggtagggctgggagcagcgtctgctrtgactgggatcaccaccagcatcgtggagcactcatacacatcatcagcagaagctgaagccagcaggctgactgcaaccagcattgaccgattgaaggt

SEQ ID NO: 17397 - DNA, 201 bp, Homo sapiens
aaataccagctggctggggcccaggagattaaaaaacaccgggctagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 17398 - DNA, 201 bp, Homo sapiens
ggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacacagctcagaacagctggatcttgctcacactctttcaagagaagct

SEQ ID NO: 17399 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttggacaaaaggaccctgccttggtgtgagagtgagggcagagggagctgga

SEQ ID NO: 17400 - DNA, 201 bp, Homo sapiens
agtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcag

SEQ ID NO: 17401 - DNA, 201 bp, Homo sapiens; identical to SEQ ID NO: 17391

SEQ ID NO: 17402 - DNA, 201 bp, Homo sapiens; identical to SEQ ID NO: 17392

SEQ ID NO: 17403 - DNA, 201 bp, Homo sapiens; identical to SEQ ID NO: 17393

SEQ ID NO: 17404 - DNA, 201 bp, Homo sapiens; identical to SEQ ID NO: 17394

SEQ ID NO: 17405 - DNA, 201 bp, Homo sapiens; identical to SEQ ID NO: 17395

SEQ ID NO: 17406 - DNA, 201 bp, Homo sapiens; identical to SEQ ID NO: 17396

SEQ ID NO: 17407 - DNA, 201 bp, Homo sapiens
cagaacagctggatcttgctcacactctttcaagagaagcttccttgggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 17408 - DNA, 201 bp, Homo sapiens; identical to SEQ ID NO: 17398

SEQ ID NO: 17409 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttgggttaagaaaaaaaacgaacccttccagtcaggtcagtgactggagagc

SEQ ID NO: 17410 - DNA, 201 bp, Homo sapiens; identical to SEQ ID NO: 17400

SEQ ID NO: 17411 - DNA, 201 bp, Homo sapiens; identical to SEQ ID NO: 17391

SEQ ID NO: 17412 - DNA, 201 bp, Homo sapiens; identical to SEQ ID NO: 17392

SEQ ID NO: 17413 - DNA, 201 bp, Homo sapiens; identical to SEQ ID NO: 17393

SEQ ID NO: 17414 - DNA, 201 bp, Homo sapiens; identical to SEQ ID NO: 17394

SEQ ID NO: 17415 - DNA, 201 bp, Homo sapiens; identical to SEQ ID NO: 17395

SEQ ID NO: 17416 - DNA, 201 bp, Homo sapiens; identical to SEQ ID NO: 17398

SEQ ID NO: 17417 - DNA, 201 bp, Homo sapiens; identical to SEQ ID NO: 17396

SEQ ID NO: 17418 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttgaaaagaaacgctttactgaagaggccaccaaatacttccgggagagagt

SEQ ID NO: 17419 - DNA, 201 bp, Homo sapiens; identical to SEQ ID NO: 17400

SEQ ID NO: 17420 - DNA, 201 bp, Homo sapiens; identical to SEQ ID NO: 17391

SEQ ID NO: 17421 - DNA, 201 bp, Homo sapiens; identical to SEQ ID NO: 17392

SEQ ID NO: 17422 - DNA, 201 bp, Homo sapiens; identical to SEQ ID NO: 17393

SEQ ID NO: 17423 - DNA, 201 bp, Homo sapiens; identical to SEQ ID NO: 17394

SEQ ID NO: 17424 - DNA, 201 bp, Homo sapiens; identical to SEQ ID NO: 17395

SEQ ID NO: 17425 - DNA, 201 bp, Homo sapiens; identical to SEQ ID NO: 17396

SEQ ID NO: 17426 - DNA, 201 bp, Homo sapiens
acaggtggctcacattcagtcccacaatttgctttctcctcctcaagggttaagaaaaaaaacgaacccttccagtcaggtcagtgactggagagctccawggaaagtctctcagtgacctggctgctggcaccatggactcagaaaagaaacgctttactgaagaggccaccaaatacttccgggagagagtcagcccag

SEQ ID NO: 17427 - DNA, 201 bp, Homo sapiens; identical to SEQ ID NO: 17398

SEQ ID NO: 17428 - DNA, 201 bp, Homo sapiens; identical to SEQ ID NO: 17399

SEQ ID NO: 17429 - DNA, 201 bp, Homo sapiens; identical to SEQ ID NO: 17400

SEQ ID NO: 17430 - DNA, 201 bp, Homo sapiens
agtggttcaacttaaaccatgtttcaactttacaattggtctgttggggtattaaatgaatttgtgacttaggatattttcatttatgatgggtttatcargaagtaaccccatggtaagttgaggcatatctgtatatatttaaacctaattaattcttgagctgaaaataaataaaccaggatggcagggaccaacccc

SEQ ID NO: 17431 - DNA, 201 bp, Homo sapiens
gccagcagatgattgttaagctgggtggtggcactgccattgccgcctcctgaccaccaggctcagcccacccctccacctctctctcgatttctctctcyccccctcagcatcttcccgctgagagtggtggggaagagccttgtcttcttagctgtcacctgccgaggcttctgggccactcaggccagtgcacccctg

SEQ ID NO: 17432 - DNA, 201 bp, Homo sapiens
ccagtgatccggccacactcgcgctcctcggtcaccttctggaggcaccggaaacaggcagatctggatctcgccagaggagattttgcagctgctgccgscaacctacaaacctgcctggcagttttgggccgggcactgcccacctcccgcctggacctggcctgcagcctctcctggaacgtgatccgctacagcctg

SEQ ID NO: 17433 - DNA, 201 bp, Homo sapiens
aacggtcattcacccaggtcacattaccttccttctctccctcggcggcctccccacaggctccaactctgcaagtcaaggtttctcccacctcagttccmaccacacccagggcaactcctattcttcagccccgcccccagccccagcctcaacctcaaactcagctgcaacaacagacggtaatgatcacgccaacat

SEQ ID NO: 17434 - DNA, 201 bp, Homo sapiens
aggaagaagagagctgtgaattctccagtgctctggagtacttgaaattacttcattcttttgtggactctgtgggggttatgagccccccactctccagsagctccgtgctcaagtccgccctgggtccagacatcatctgtcggtggtggacgtctgcaatcactgtggccatcagctggctccagggagacgatgcag

SEQ ID NO: 17435 - DNA, 201 bp, Homo sapiens
atgcccatggtccagggcctggtgggcgtgagaggataggtggcagggcagaaactgggcagccctgacttgatagcagcagggggagctcccaagctgcyaagcccctgcctccagccttcctgagtttctctctcctgaaccctactctctcctttttgcttcctcagtttttatcaggctttctctgggggacagcag

SEQ ID NO: 17436 - DNA, 201 bp, Homo sapiens
tggtccagcctcagatcatcaagacagattcccttgttttgaccacactgaagacagatggcagccctgttatggctgcggtccagaacccggccctcacygccctcaccacccctatccagacggctgcccttcaagtaccaaccctggtgggcagcagtgggaccattctgaccacaatgcctgtaatgatggggcaag

SEQ ID NO: 17437 - DNA, 201 bp, Homo sapiens
ccgcccagcataccgcaaggtgttcctgcatgaagccaccgtgcgcctgatggcaggagccagccccacccgcacccaccagctgctggaacacagcctgmggcggcgcaccacgcagagcaccaagcacggagaggtggatgcctggcccggccagcgagagcgggccaccgccatcctgctggcctgccgccacctgcc

SEQ ID NO: 17438 - DNA, 201 bp, Homo sapiens
ttttgcagctgctgccggcaacctacaaacctgcctggcagttttgggccgggcactgcccacctcccgcctggacctggcctgcagcctctcctggaacrtgatccgctacagcctgcagaagctacgcctggtgcgctggctgctcaagaaagtcttccagtgccggcgggccacgccagccactgaggcaggctttga

SEQ ID NO: 17439 - DNA, 201 bp, Homo sapiens
cgcctggacctggcctgcagcctctcctggaacgtgatccgctacagcctgcagaagctacgcctggtgcgctggctgctcaagaaagtcttccagtgccrgcgggccacgccagccactgaggcaggctttgaagacgaagctaagaccagcgcccgggatgcggctctggcctatcaccggctgcaccagctgcacatc

SEQ ID NO: 17440 - DNA, 201 bp, Homo sapiens
cattcgagtcaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagaggagatt

SEQ ID NO: 17441 - DNA, 201 bp, Homo sapiens
agcagcaggtgcagacagtacaggcccagcgggtgctgacacaaacggccaatggcacgctgcagacccttgccccggctacggtgcagacagttgctgcrccacaggtgcagcaggtcccggtcctggtccagcctcagatcatcaagacagattcccttgttttgaccacactgaagacagatggcagccctgttatgg

SEQ ID NO: 17442 - DNA, 201 bp, Homo sapiens
gttttcagaacagctgtgtagctcctttcctggcagtggtggtagtggtagcagcagcggcagcagtggcagcagcagcagcagcagcaatggcaggggcmgcagcagcggagctgtggacccttcagtgcaacggtcattcacccaggtcacattaccttccttctctccctcggcggcctccccacaggctccaactct

SEQ ID NO: 17443 - DNA, 201 bp, Homo sapiens
ccattgccgcctcctgaccaccaggctcagcccacccctccacctctctctcgatttctctctctccccctcagcatcttcccgctgagagtggtggggargagccttgtcttcttagctgtcacctgccgaggcttctgggccactcaggccagtgcacccctgggcagagccccttaaagctgctgtcactagatgccc

SEQ ID NO: 17444 - DNA, 201 bp, Homo sapiens; identical to SEQ ID NO: 17430

SEQ ID NO: 17445 - DNA, 201 bp, Homo sapiens
ggttgcctatggtgggcactaggaatgaggtcccctgcctcgatgcgggtcctaggagaaaaagtcctacttttctgggtccccaggtgcagcacctcccrgagactgtttctcccatggcctcctgagtgatgggccctgcctccctgtgcctcatcctcaggctggttggagcagagggtgggcaggagccccagcaca

SEQ ID NO: 17446 - DNA, 201 bp, Homo sapiens; identical to SEQ ID NO: 17431

SEQ ID NO: 17447 - DNA, 201 bp, Homo sapiens; identical to SEQ ID NO: 17432

SEQ ID NO: 17448 - DNA, 201 bp, Homo sapiens; identical to SEQ ID NO: 17433

SEQ ID NO: 17449 - DNA, 201 bp, Homo sapiens; identical to SEQ ID NO: 17434

SEQ ID NO: 17450 - DNA, 201 bp, Homo sapiens; identical to SEQ ID NO: 17435

SEQ ID NO: 17451 - DNA, 201 bp, Homo sapiens; identical to SEQ ID NO: 17436

SEQ ID NO: 17452 - DNA, 201 bp, Homo sapiens; identical to SEQ ID NO: 17437

SEQ ID NO: 17453 - DNA, 201 bp, Homo sapiens; identical to SEQ ID NO: 17438

SEQ ID NO: 17454 - DNA, 201 bp, Homo sapiens; identical to SEQ ID NO: 17439

SEQ ID NO: 17455 - DNA, 201 bp, Homo sapiens; identical to SEQ ID NO: 17440

SEQ ID NO: 17456 - DNA, 201 bp, Homo sapiens; identical to SEQ ID NO: 17441

SEQ ID NO: 17457 - DNA, 201 bp, Homo sapiens; identical to SEQ ID NO: 17442

SEQ ID NO: 17458 - DNA, 201 bp, Homo sapiens; identical to SEQ ID NO: 17443

SEQ ID NO: 17459 - DNA, 201 bp, Homo sapiens
cacaaagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccgtc

SEQ ID NO: 17460 - DNA, 201 bp, Homo sapiens
aagcccaatctcatgcagacactggagggcactccagtgtttgtccatgctggcccgtttgccaacatcgcacatggcaattcctccatcattgcagaccrgatcgcactcaagcttgttggcccagaagggtttgtagtgacggaagcaggatttggagcagacattggaatggaaaagttttttaacatcaaatgccgg

SEQ ID NO: 17461 - DNA, 201 bp, Homo sapiens
agcatcaatgctgggagacttgctagaggtgacctcaatgactgtttcattccttgtacgcctaagggatgcttggaactcatcaaagagacaggggtgcygattgccggaaggcatgctgtggtggttgggcgcagtaaaatagttggggccccgatgcatgacttgcttctgtggaacaatgccacagtgaccacctgc

SEQ ID NO: 17462 - DNA, 201 bp, Homo sapiens
gacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaagctcccagttgaggataaaatcag

SEQ ID NO: 17463 - DNA, 201 bp, Homo sapiens
gccagcgttggggctggttttctgtaccccttagtaggaacgatgagcacaatgcctggactccccacccggccctgtttttatgatattgatttggaccytgaaacagaacaggtgaatggattattctaaacagacttccctgaggggagaggggatagtaatgagagttggcaataaccaatgaattgaaatatttat

SEQ ID NO: 17464 - DNA, 201 bp, Homo sapiens
gcttgtcacaggttgacagtgtaggggagaaaactgctgtccaataaactacagaggaaactacaggagagatcaccatccatcttcaagaagctactttraaagtctggccagtgtctattcaggcccactgggagttaggaagtataagtaagccaagagaagtcagcccctgcccagaagatctgaaactaatagtag

SEQ ID NO: 17465 - DNA, 201 bp, Homo sapiens
ccatccatcttcaagaagctactttgaaagtctggccagtgtctattcaggcccactgggagttaggaagtataagtaagccaagagaagtcagcccctgyccagaagatctgaaactaatagtaggagtttccccagaagtcattttcagccttaattctcatcatgtataaattaacataaatcatgcatgtctgttta

SEQ ID NO: 17466 - DNA, 201 bp, Homo sapiens
ctacctttagattcagagaattccattaacactgaagaagtgatcaatgctattgcacccgagaaggatgtggatggattgactagcatcaatgctgggaracttgctagaggtgacctcaatgactgtttcattccttgtacgcctaagggatgcttggaactcatcaaagagacaggggtgccgattgccggaaggcat

SEQ ID NO: 17467 - DNA, 201 bp, Homo sapiens
tgtctattcaggcccactgggagttaggaagtataagtaagccaagagaagtcagcccctgcccagaagatctgaaactaatagtaggagtttccccagamgtcattttcagccttaattctcatcatgtataaattaacataaatcatgcatgtctgtttactttagtgacgttccacagaataaaaggaaacaagtttg

SEQ ID NO: 17468 - DNA, 201 bp, Homo sapiens
gaggccaaagagagggcgagcttcatcactcctgttcctggcggcgtagggcccatgacagttgcaatgctcatgcagagcacagtagagagtgccaagcrtttcctggagaaatttaagccaggaaagtggatgattcagtataacaaccttaacctcaagacacctgttccaagtgacattgatatatcacgatcttgt

SEQ ID NO: 17469 - DNA, 113 bp, Homo sapiens
agtgtgatccccyggccagtccctaagcacgtgggttgggttgtcctgcttggctgcggagggagtggaacctcgatattggtggtgtccatcgtgggcagcggactaataaa

SEQ ID NO: 17470 - DNA, 201 bp, Homo sapiens; identical to SEQ ID NO: 17460

SEQ ID NO: 17471 - DNA, 201 bp, Homo sapiens; identical to SEQ ID NO: 17461

SEQ ID NO: 17472 - DNA, 201 bp, Homo sapiens; identical to SEQ ID NO: 17462

SEQ ID NO: 17473 - DNA, 201 bp, Homo sapiens
gccagcgttggggctggttttctgtaccccttagtaggaacgatgagcacaatgcctggactccccacccggccctgtttttatgatattgatttggaccytgaaacagaacaggtgaatggattattctaaacagatcaccatccatcttcaagaagctactttgaaagtctggccagtgtctattcaggcccactggga

SEQ ID NO: 17474 - DNA, 201 bp, Homo sapiens
cacccggccctgtttttatgatattgatttggaccctgaaacagaacaggtgaatggattattctaaacagatcaccatccatcttcaagaagctactttraaagtctggccagtgtctattcaggcccactgggagttaggaagtataagtaagccaagagaagtcagcccctgcccagaagatctgaaactaatagtag

SEQ ID NO: 17475 - DNA, 201 bp, Homo sapiens; identical to SEQ ID NO: 17465

SEQ ID NO: 17476 - DNA, 201 bp, Homo sapiens; identical to SEQ ID NO: 17466

SEQ ID NO: 17477 - DNA, 201 bp, Homo sapiens; identical to SEQ ID NO: 17467

SEQ ID NO: 17478 - DNA, 201 bp, Homo sapiens; identical to SEQ ID NO: 17468

SEQ ID NO: 17479 - DNA, 113 bp, Homo sapiens; identical to SEQ ID NO: 17469

SEQ ID NO: 17480 - DNA, 201 bp, Homo sapiens
ctcaactctgttctcccctaggggctccctggtgttggcctcacaccttcagctgcccagactgcccgtcagcaccccaagatgcatcttgcccacagcamcctcaaacctgctgctcacctcattggagaccccagcaagcagaactcactgctctggagagcaaacacggaccgtgccttcctccaggatggtttctcc

SEQ ID NO: 17481 - DNA, 176 bp, Homo sapiens
gctccgcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggttctccccatgacacca

SEQ ID NO: 17482 - DNA, 201 bp, Homo sapiens
tgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcaccccaagatgcatcttgcccacagcaccctcaaacc

SEQ ID NO: 17483 - DNA, 106 bp, Homo sapiens
gctccrcacagcaggtgaggctctcctgccccatctccttgggctgcccgtgcttcgtgctttggactaccgcccagcagtgtcctgccctctgcctgggcctcgg

SEQ ID NO: 17484 - DNA, 201 bp, Homo sapiens
agccaaaccttgagccctagagcccccctcaactctgttctcccctaggggctccctggtgttggcctcacaccttcagctgcccagactgcccgtcagcmccccaagatgcatcttgcccacagcaccctcaaacctgctgctcacctcattggagaccccagcaagcagaactcactgctctggagagcaaacacggac

SEQ ID NO: 17485 - DNA, 201 bp, Homo sapiens
  misc_feature (1)...(201): n = A,T,C or G, or insertion/deletion polymorphism (see Tables 1-2)
cggtccctcctgcacctgctgcctggatccccggcctgcctgggcctgggccttggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctc

SEQ ID NO: 17486 - DNA, 201 bp, Homo sapiens
aaaccttgagccctagagcccccctcaactctgttctcccctaggggctccctggtgttggcctcacaccttcagctgcccagactgcccgtcagcacccyaagatgcatcttgcccacagcaccctcaaacctgctgctcacctcattggagaccccagcaagcagaactcactgctctggagagcaaacacggaccgtg

SEQ ID NO: 17487 - DNA, 201 bp, Homo sapiens
gttctgctgcctggggcccaggggctccctggtgttggcctcacaccttcagctgcccagactgcccgtcagcaccccaagatgcatcttgcccacagcamcctcaaacctgctgctcacctcattggagaccccagcaagcagaactcactgctctggagagcaaacacggaccgtgccttcctccaggatggtttctcc

SEQ ID NO: 17488 - DNA, 176 bp, Homo sapiens; identical to SEQ ID NO: 17481

SEQ ID NO: 17489 - DNA, 201 bp, Homo sapiens
cacctcctccttctggggctgctgctggttctgctgcctggggcccaggggctccctggtgttggcctcacaccttcagctgcccagactgcccgtcagcmccccaagatgcatcttgcccacagcaccctcaaacctgctgctcacctcattggagaccccagcaagcagaactcactgctctggagagcaaacacggac

SEQ ID NO: 17490 - DNA, 106 bp, Homo sapiens; identical to SEQ ID NO: 17483

SEQ ID NO: 17491 - DNA, 201 bp, Homo sapiens
  misc_feature (1)...(201): n = A,T,C or G, or insertion/deletion polymorphism (see Tables 1-2)
cggtccctcctgcacctgctgcctggatccccggcctgcctgggcctgggccttggttctccccatgacaccacctgaacgtctcttcctcccaagggtgngtggcaccaccctacacctcctccttctggggctgctgctggttctgctgcctggggcccaggggctccctggtgttggcctcacaccttcagctgccca

SEQ ID NO: 17492 - DNA, 201 bp, Homo sapiens
tcctccttctggggctgctgctggttctgctgcctggggcccaggggctccctggtgttggcctcacaccttcagctgcccagactgcccgtcagcacccyaagatgcatcttgcccacagcaccctcaaacctgctgctcacctcattggagaccccagcaagcagaactcactgctctggagagcaaacacggaccgtg

SEQ ID NO: 17493 - DNA, 201 bp, Homo sapiens
gctctcctcacctcagctgagctcctttgaaagtgattcaagggactatgtcactcagcctcatttgctggaccaaatctggagggagaacccctaaaacycctaagtgaggttgcccagggggttgtccccaggtggggggaagcaggggagagaaaatggtagccatttttacattgttttgtatagtatttattgatt

SEQ ID NO: 17494 - DNA, 201 bp, Homo sapiens
ctgccatccagcagcgagccattctaccttgtatcaagggttatgatgtgattgctcaagcccaatctgggactgggaaaacggccacatttgccatatcrattctgcagcagattgaattagatctaaaagccacccaggccttggtcctagcacccactcgagaattggctcagcagatacagaaggtggtcatggcac

SEQ ID NO: 17495 - DNA, 201 bp, Homo sapiens
aagccacccaggccttggtcctagcacccactcgagaattggctcagcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgc

SEQ ID NO: 17496 - DNA, 201 bp, Homo sapiens
catcgagagtaactggaatgagattgttgacagctttgatgacatgaacctctcggagtcccttctccgtggcatctacgcctatggttttgagaagcccyctgccatccagcagcgagccattctaccttgtatcaagggttatgatgtgattgctcaagcccaatctgggactgggaaaacggccacatttgccatatc

SEQ ID NO: 17497 - DNA, 201 bp, Homo sapiens
ggatggagcccgaaggcgtcatcgagagtaactggaatgagattgttgacagctttgatgacatgaacctctcggagtcccttctccgtggcatctacgcstatggttttgagaagccctctgccatccagcagcgagccattctaccttgtatcaagggttatgatgtgattgctcaagcccaatctgggactgggaaaa

SEQ ID NO: 17498 - DNA, 201 bp, Homo sapiens
tcgggggcaccaacgtgcgtgctgaggtgcagaaactgcagatggaagctccccacatcatcgtgggtacccctggccgtgtgtttgatatgcttaaccgsagatacctgtcccccaaatacatcaagatgtttgtactggatgaagctgacgaaatgttaagccgtggattcaaggaccagatctatgacatattccaaa

SEQ ID NO: 17499 - DNA, 201 bp, Homo sapiens
acgagacgtgattatgagggagtttcgttctggctctagcagagttttgattaccactgacctgctggccagaggcattgatgtgcagcaggtttctttastcatcaactatgaccttcccaccaacagggaaaactatatccacagaatcggtcgaggtggacggtttggccgtaaaggtgtggctattaacatggtgac

SEQ ID NO: 17500 - DNA, 201 bp, Homo sapiens
aaaaaaaaaacactaatccatttccctaacctagtaacctccagatcccagaggctctcctcacctcagctgagctcctttgaaagtgattcaagggactrtgtcactcagcctcatttgctggaccaaatctggagggagaacccctaaaacccctaagtgaggttgcccagggggttgtccccaggtggggggaagcag

SEQ ID NO: 17501 - DNA, 201 bp, Homo sapiens; identical to SEQ ID NO: 17495

SEQ ID NO: 17502 - DNA, 201 bp, Homo sapiens; identical to SEQ ID NO: 17494

SEQ ID NO: 17503 - DNA, 201 bp, Homo sapiens; identical to SEQ ID NO: 17496

SEQ ID NO: 17504 - DNA, 201 bp, Homo sapiens; identical to SEQ ID NO: 17497

SEQ ID NO: 17505 - DNA, 201 bp, Homo sapiens; identical to SEQ ID NO: 17498

SEQ ID NO: 17506 - DNA, 201 bp, Homo sapiens; identical to SEQ ID NO: 17499

SEQ ID NO: 17507 - DNA, 201 bp, Homo sapiens; identical to SEQ ID NO: 17495

SEQ ID NO: 17508 - DNA, 201 bp, Homo sapiens; identical to SEQ ID NO: 17494

SEQ ID NO: 17509 - DNA, 201 bp, Homo sapiens; identical to SEQ ID NO: 17496

SEQ ID NO: 17510 - DNA, 201 bp, Homo sapiens; identical to SEQ ID NO: 17497

SEQ ID NO: 17511 - DNA, 201 bp, Homo sapiens; identical to SEQ ID NO: 17498

SEQ ID NO: 17512 - DNA, 201 bp, Homo sapiens; identical to SEQ ID NO: 17493

SEQ ID NO: 17513 - DNA, 201 bp, Homo sapiens; identical to SEQ ID NO: 17495

SEQ ID NO: 17514 - DNA, 201 bp, Homo sapiens; identical to SEQ ID NO: 17494

SEQ ID NO: 17515 - DNA, 201 bp, Homo sapiens; identical to SEQ ID NO: 17496

SEQ ID NO: 17516 - DNA, 201 bp, Homo sapiens; identical to SEQ ID NO: 17497

SEQ ID NO: 17517 - DNA, 201 bp, Homo sapiens; identical to SEQ ID NO: 17498

SEQ ID NO: 17518 - DNA, 201 bp, Homo sapiens; identical to SEQ ID NO: 17500

SEQ ID NO: 17519 - DNA, 201 bp, Homo sapiens; identical to SEQ ID NO: 17499

SEQ ID NO: 17520 - DNA, 151 bp, Homo sapiens
ttagcatattttatgtaccatggttatatgattaatcttgggacaaagaattttatagaaatttttaaacatctgattatgctttaatgctgttatctatyttattgttcttgaaaatacctgcattttttggtatcatgttcaaccaaca

SEQ ID NO: 17521 - DNA, 201 bp, Homo sapiens
tcccccgtctgaggactgacctttttccaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaacctta

SEQ ID NO: 17522 - DNA, 201 bp, Homo sapiens
aagttggtcatgatgcagaagctactcaaatgcagtcggcttgtcctggctcttgccctcatcctggttctggaatcctcagttcaaggttatcctacgcrgagagccaggtaccaatgggtgcgctgcaatccagacagtaattctgcaaactgccttgaagaaaaaggaccaatgttcgaactacttccaggtgaatcc

SEQ ID NO: 17523 - DNA, 201 bp, Homo sapiens
attcccatggccataaaatggctttaaagaatatatatatatttttaaagtagcttgagaagcaaattggcaggtaatatttcatacctaaattaagactytgacttggattgtgaattataatgatatgccccttttcttataaaaacaaaaaaaaaaataatgaaacacagtgaatttgtagagtgggggtatttgaca

SEQ ID NO: 17524 - DNA, 201 bp, Homo sapiens
atgaaacacagtgaatttgtagagtgggggtatttgacatattttacagggtggagtgtactatatactattacctttgaatgtgtttgcagagctagtgkatgtgtttgtctacaagtatgattgctgttacataacaccccaaattaactcccaaattaaaacacagttgtgctgtcaatacctcatactgctttacct

SEQ ID NO: 17525 - DNA, 201 bp, Homo sapiens
ttatagaaatttttaaacatctgaaaaagaagcttaagttttatcatccttttttttctcatgaattcttaaaggattatgctttaatgctgttatctatyttattgttcttgaaaatacctgcattttttggtatcatgttcaaccaacatcattatgaaattaattagattcccatggccataaaatggctttaaagaa

SEQ ID NO: 17526 - DNA, 201 bp, Homo sapiens
tttgacatattttacagggtggagtgtactatatactattacctttgaatgtgtttgcagagctagtggatgtgtttgtctacaagtatgattgctgttamataacaccccaaattaactcccaaattaaaacacagttgtgctgtcaatacctcatactgctttacctttttttcctggatatctgtgtattttcaaatg

SEQ ID NO: 17527 - DNA, 201 bp, Homo sapiens; identical to SEQ ID NO: 17522

SEQ ID NO: 17528 - DNA, 201 bp, Homo sapiens; identical to SEQ ID NO: 17521

SEQ ID NO: 17529 - DNA, 201 bp, Homo sapiens
agagtgggggtatttgacatattttacagggtggagtgtactatatactattacctttgaatgtgtttgcagagctagtggatgtgtttgtctacaagtawgattgctgttacataacaccccaaattaactcccaaattaaaacacagttgtgctgtcaatacctcatactgctttacctttttttcctggatatctgtg

SEQ ID NO: 17530 - DNA, 201 bp, Homo sapiens
ttgtgagacgatccttttaaactctccaggccccttccctttcatccaagacaacatctcattctatgcaacaattggtgtttgtctcctcttcattgtcrttttaaccctgctaatttgtcacaagtacaaaaagcaatttaggtatgaaagccagctacagatggtacaggtgaccggctcctcagataatgagtactt

SEQ ID NO: 17531 - DNA, 201 bp, Homo sapiens
gtatcagaatgtggatggccgtgtttcggaatgtcctcacacctaccaaaacaggcgacctttcagcagagagatggatttggggctactctctccgcagsctcaggtcgaagattcgtagaggaacaatttagttttaaggacttcatccctccacctatccctaacaggctgtagattaccaaaacaagattaatttca

SEQ ID NO: 17532 - DNA, 201 bp, Homo sapiens
cgatgtatcagaatgtggatggccgtgtttcggaatgtcctcacacctaccaaaacaggcgacctttcagcagagagatggatttggggctactctctccrcaggctcaggtcgaagattcgtagaggaacaatttagttttaaggacttcatccctccacctatccctaacaggctgtagattaccaaaacaagattaat

SEQ ID NO: 17533 - DNA, 201 bp, Homo sapiens
atgaaagccagctacagatggtacaggtgaccggctcctcagataatgagtacttctacgttgatttcagagaatatgaatatgatctcaaatgggagttyccaagagaaaatttagagtttgggaaggtactaggatcaggtgcttttggaaaagtgatgaacgcaacagcttatggaattagcaaaacaggagtctcaa

SEQ ID NO: 17534 - DNA, 201 bp, Homo sapiens
ttttaaactctccaggccccttccctttcatccaagacaacatctcattctatgcaacaattggtgtttgtctcctcttcattgtcgttttaaccctgctratttgtcacaagtacaaaaagcaatttaggtatgaaagccagctacagatggtacaggtgaccggctcctcagataatgagtacttctacgttgatttca

SEQ ID NO: 17535 - DNA, 201 bp, Homo sapiens
tcgggtgtgcgttgagaccccagagctcagggacagtgtacgaagctgccgctgtggaagtggatgtatctgcttccatcacactgcaagtgctggtcgaygccccagggaacatttcctgtctctgggtctttaagcacagctccctgaattgccagccacattttgatttacaaaacagaggagttgtttccatggtca

SEQ ID NO: 17536 - DNA, 201 bp, Homo sapiens
tatattttatgggtgggaataaaatttctactacagaattgcccattattgaattatttacatggtataattagggcaagtcttaactggagttcacgaamcccctgaaattgtgcacccatagccacctacacattccttccagagcacgtgtgcttttaccccaagatacaaggaatgtgtaggcagctatggttgtca

SEQ ID NO: 17537 - DNA, 201 bp, Homo sapiens
ggcggcatcgcagggctgggccggcgcggcctggggaccccgggctccggaggccatgccggcgttggcgcgcgacggcggccagctgccgctgctcgttsttttttctgcaatgatatttgggactattacaaatcaagatctgcctgtgatcaagtgtgttttaatcaatcataagaacaatgattcatcagtggggaa

SEQ ID NO: 17538 - DNA, 201 bp, Homo sapiens
acttcgtttttaggatgtcagctggcagatgcagaagaagcgatgtatcagaatgtggatggccgtgtttcggaatgtcctcacacctaccaaaacaggcracctttcagcagagagatggatttggggctactctctccgcaggctcaggtcgaagattcgtagaggaacaatttagttttaaggacttcatccctccac

SEQ ID NO: 17539 - DNA, 201 bp, Homo sapiens
gtggaatgggtgctttgcgattcacagggggaaagctgtaaagaagaaagtccagctgttgttaaaaaggaggaaaaagtgcttcatgaattatttgggayggacataaggtgctgtgccagaaatgaactgggcagggaatgcaccaggctgttcacaatagatctaaatcaaactcctcagaccacattgccacaatta

SEQ ID NO: 17540 - DNA, 201 bp, Homo sapiens
agcactcgaggagggcaactactttgagatgagtacctattcaacaaacagaactatgatacggattctgtttgcttttgtatcatcagtggcaagaaacracaccggatactacacttgttcctcttcaaagcatcccagtcaatcagctttggttaccatcgtagaaaagggatttataaatgctaccaattcaagtga

SEQ ID NO: 17541 - DNA, 201 bp, Homo sapiens
agtccagctgttgttaaaaaggaggaaaaagtgcttcatgaattatttgggatggacataaggtgctgtgccagaaatgaactgggcagggaatgcaccargctgttcacaatagatctaaatcaaactcctcagaccacattgccacaattatttcttaaagtaggggaacccttatggataaggtgcaaagctgttcat

SEQ ID NO: 17542 - DNA, 201 bp, Homo sapiens
cctgcagcgcgaggcgcgccgctccaggcggcatcgcagggctgggccggcgcggcctggggaccccgggctccggaggccatgccggcgttggcgcgcgrcggcggccagctgccgctgctcgttgttttttctgcaatgatatttgggactattacaaatcaagatctgcctgtgatcaagtgtgttttaatcaatcat

SEQ ID NO: 17543 - DNA, 201 bp, Homo sapiens; identical to SEQ ID NO: 17535

SEQ ID NO: 17544 - DNA, 201 bp, Homo sapiens; identical to SEQ ID NO: 17539

SEQ ID NO: 17545 - DNA, 201 bp, Homo sapiens; identical to SEQ ID NO: 17533

SEQ ID NO: 17546 - DNA, 201 bp, Homo sapiens; identical to SEQ ID NO: 17534

SEQ ID NO: 17547 - DNA, 201 bp, Homo sapiens; identical to SEQ ID NO: 17530

SEQ ID NO: 17548 - DNA, 201 bp, Homo sapiens; identical to SEQ ID NO: 17531

SEQ ID NO: 17549 - DNA, 201 bp, Homo sapiens; identical to SEQ ID NO: 17532

SEQ ID NO: 17550 - DNA, 201 bp, Homo sapiens; identical to SEQ ID NO: 17538

SEQ ID NO: 17551 - DNA, 201 bp, Homo sapiens
agcactcgaggagggcaactactttgagatgagtacctattcaacaaacagaactatgatacggattctgtttgcttttgtatcatcagtggcaagaaacracaccggatactacacttgttcctcttcaaagcatcccagtcaatcagctttggttaccatcgtaggaaagggatttataaatgctaccaattcaagtga

SEQ ID NO: 17552 - DNA, 201 bp, Homo sapiens
agtccagctgttgttaaaaaggaggaaaaagtgcttcatgaattatttgggacggacataaggtgctgtgccagaaatgaactgggcagggaatgcaccargctgttcacaatagatctaaatcaaactcctcagaccacattgccacaattatttcttaaagtaggggaacccttatggataaggtgcaaagctgttcat

SEQ ID NO: 17553 - DNA, 44752 bp, Homo sapiens
  misc_feature (1)...(44752): n = A,T,C or G, or insertion/deletion polymorphism (see Tables 1-2)
agaacaaggcttcagatgatcaaactactccaagctaaaggaggaagttcgaacccatggcaaagaagttaaaaacattgaaaaaaaattagatgaatggctacctagaataaccaatgcagagaagtccttaaaagacctgatggagctgaaaaccatggcacgagaactatgtgatgaatgcataagcctcaataaccgattcgatcaactggaagaaagggtatcagtgatggaagatcaaatgaatgaaatgaagtgagaagagaagtttagagaaaaaagaataaaaagaaaggaataaagcctccaagaaatatgggactacgtgaaaagaccaaatctacgtctgattggtgtacctgaaagtgacggggagaatggaaccaagatagaaaacactctgcaggatattatccaggagaacttccccaatctagcaaggcaggccaacattcaaattcaggaaatacagagaacaccacaaagatactcctcgaaaagagcaactccaagacacataattgtcagattcaccaaagttgaaatgaagggaaaaaatgttaagggcagacagagagaaaggttgggttacccacaaagggaagcacatcagaataacagctgatctctcggcagaaactctacaagccagaagagagtggaggccaatattcaacattcttaaagaaaagaattttcaacccagaatttcatatccagccaaactaagcttcataagtgaaggagaaataaaatactttatagacaagcaaatgctgagagattttgtcaaaaccaggcctgtcctaaaagagctcctgaaggaagcactaaacatggaaaggaacaactggtaccagccactgcaaaaacatgccaaattgtaaagaccatcgaggctgggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaactcatctcacatgcagagacacacataggctcaaaataaagggatggaggaagatctaccaagcaaatggaaaacaaaaaggcagggtttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccatactgtcaacattagacagatcaacgagacagaaagttaacaaggatatccaggaattgaactcagttctgcaccaagcggacctaatagacatctacagaactctccaccccaaatcaacagaatatacattcttctcagcactacaccacacctattccaaaattgatcacatagttgaaagtaaagcactcctcagcaaatgtaaaagaacagaaattataacaaactatctctcagaccacagtgcaatcaaactagaactcaggattaagaaactcactcaaaaccactcgactacatggaaactgaacaacctgctcctgaatgactactgggtacataacgaaatgaaggcagaaataaagatgttctttgaaaccaacaagaacaaagacgcaacataccagaatctctgggacacattcaaagcagtgtgtagagggaaatttatagcactaaatgcccacaagagaaagcaggacggatctaaaatggataccctaacatcacaattaaaagaactagagaagcaagagcaaacacattcaaaagctagcagaaggcaagaaataactaagatcagagcagaactgaaggaaatagagacacaaaaaacctttcaaaaaatcaatgaacccaggagctggttttttgaaaagatcaacaaaactgatagaccactagcaagactaataaagaagaaaagagagaagaatcaaatagatgcaataaaaaatgataaaggggatatcaccaccgatcccgcagaaatacaaactaccatcagagaatactataaacacctctatacaaataaactagaaaacctagaagaaatggataaattcctcgacacatacaccctcccaagactaaaccaggaagaagttgaatctctgaatagaccaataacaggagctgaaattgaggcaataattaatagcttactgaccaaaaaaagtccaggaccagatggattcacagccaaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacatcaatgcaaaaatcctcaataaaatactggcaaaccaaatccagcagcacatcaaaaagcttgtccaccataatcaagtgggcttcatccctgggatgcaaggctggttcaacatatgcaaatcaataaatgtaatccagcatatatacagaaccaaagacaaaaaccacatgattacctcaatagatgcagaaaaggcctttgacaaaattcaacaaccttcatgctaaaaactctcaataaattaggtattgatgggatgtatctcaaaatcataagagctatctatgacaaacccacagccaatatcatactgaatgggcaagaactggaagcattccctttgaaaactggcacaagacagggatgccctctctcaccactcctattcaacatagtgttggaagttctggtcagggcaatcgggaaggaaaaggaaataaagggtattcaattaggaaaagaggaagtcaaattgtccctgtttgcagatgacatgattgtatatctagaaaaccccattgtctcattccaaaatctccttaagctgataggcaacttcagcaaagtctcaggatacaaaatcaatgtgcaaaaatcacaggcattcttatacaccaatagcagacaaacagacagccaaatcatgagtgaactcccattcacaattgcttcaaagagaataaaatacctaggaatcctacttacaagggatgtgaaggacctcttcaaggagaactacaaaccactgctcaatgaaataaaagaggatacaaacaaatggaagaacattacatgctcatgggtaggaagaatcaatatcatgaaaatggccatactgcccaaggtaatttatagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatacagaccaatggaacagaacagagccctcagaaataatgccacatatctacaactatctgatctttgaaaaacctgacaaaaacaagaaatggggaaaggattccctatttaataaatggtgctgggaaaactggctagccatatgtagaaagctgaaactggatcccttccttataccttatacaaaaattaattcaagatggattaaagacttcaatgttagacctaaaaccataaaaaccctagaagaaaacctaggcaataccattcaggacataggcatgggcaaggacttcatgtctaaaacaccaaaagcaatggcaacaaaagccaaaattgacaaatgggatcaaatgaaactaaagagcttctgcacagcaaaagaaactaccatcagagtgaacaggcaacctaaagaatgggagaaaaattttgcaatctactcatctgtccaagggctaatacctagaatctaaaatgaactcaaacaaatttacagaaaaaaacaaacaaccccatcaacaagtgggtgaaggatatgaacagacacttctcaaaagaagacatttatgcagccaacagacacatgaaaaaatgctcagcatcaccggccatcagagaaatgcaaatcaaaaccacaatgagataccatctcacacaagttagaatggcgatcatcaaaaactcaggaagcaacaggtgctggagaggatgtggagaaataggaacactttgacactgttggtgggactgtaaactagttcaaccattgtggaagtcagtgtggcgattcctcagggatctagacctagaaataccatctgacccagccatcccattattgggtatatacccaaagtattataaatcatgctgctataaagacacatgcacacgtatgtttattgcggcacttttcacaatagcaatgacttggaaccaacccaaatgtccaacaatgatagactggattaagaaaatgtggcacatatacaccatggaatactaggcagccataaaaagaaaatgagttcatgtcctttgtagggacatggatgaagctagaaaccatcattctcagcaaactatcgcaaggacaaaaaaccaaacaccgcatgttctcactcataggtgggaactgaacaatgagaacacttggacacaggaaggggaacatcacacaccggggcctgttgtggggtggggggcgaggggagggatagcattaggggatatacctaatgctaaatgacgagttaatgggtacagcacaccaacatggcacatgtatacatatgtaacaaacctgctcgttgtgcacatgtaccctaaaacttaaagtataataataaaaaaaagatcattctaaaatttatacaagcccttagaacagttaaaaatatcttaccaaaagaagaataaagttggaggaatcactctacctaatataaagtcttactacatagctacagtaattatgacagtgttatattggcagagggataaatacatcaatggcacaaagaatagatagagaaactggaagtagacccaaaacaatatggttaactgacttacgaaaaaatttcagaagccattcaatcgaggaaggatagggtggtattgttgttttttgttttaacaaattgtgctggataaattggacatacctatggaaaaaaaaatgaagtttgacttaaacatcatactttacacaaatattaactcaaaatggagcatgggcataaatctaaaacttcaaactgtaaaacatttagaaaaaaataggaaaaaaatcatcaggatctagtgttagtggaagagttctaaatgtgatccataaaacaaaaacaaataaactggactacatcaaaactaaaaaattctactctgtgaaagacctaattaagaggacaaaagacaagctacaggctggagacaatatatttaatccacgtatctatgaaaggactcatatctagaatatataaacaaccttaagaatctgacagtaaaaaaaaaaaatcagactaactggaccactcatacattgctgatggaaatgtaaagtggtacagccattttggtaaacatcattgctctctgacaaagatacggtgggtcccactgatgaactgtgctgccacagtaaatgtagccactatgcctatctccattctgaagatgtgtcacttcctgtttcagactcaaatcagccacagtggcagaagcccacgaaatcagaggtgaaatttaataatgaccactgcccattctcttcacttgtcccaagaggccattggaaatagtccaaagacccattgagggagatggacattatttcccagaagtaaatacagctcagcttgtactttggtacaactaatcgaccttaccactttcacaatctgctagcaaaggttatgcagcrcgtgaacatgwtcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcrctaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccwggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactayggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagmtttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagratgttaccttgggcayagcccttagcctctatgarycyatcvtyctwakyykrbaaaatkkgatwkcagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccamagattcaaytaactgcagatcaaaaatattcaagaaaaaaatggatggttscatctctactgaacatgtacagactyttttatctttcattattccctaaacaatacagcataacaactatttacatagcatttacattgtattagctattaagagaawcctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgargagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagarttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttartcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagwwctttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatydgccawakasstatdwtysarrtraatygrhagvswktgttyaarvgaaccttgagagavmayrtatggwaraaaagyrtagttytgaagaagcacgagaagtttttgaaaacactgaaagaacagtgagtatttccacataatacccttcagatgcagagcatagaatagaaaatctttaaaaagacacttctctttaaaattttaaagsatccatatatatttatgtatkttaaatgttataaaagataggaaatcaataccaaaacactttagatattaccgttaatttgtcttcttttattctttatagactgaaktttrgragyagdrtgttggtaagcaattcattttatcctctagctaatatatgaaacatatgagaattatgtgggttttttctctgcataaatagataatatattaaactttgtcaaaaggactcaraaagatcagtccaaccctctaacccatattgratggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccasaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttaytttytcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggayactcttttactctcataactcataactcctccacttttgtttttaaatcatgagagaaaaagagttgactctgttatattgttttatctacctttccttgatcttagaaaygaatactaccataccagcttctactgaggtgccccctaaagttagtccaaataggtctttgcaatctccattcccrcagaatttagaactttgaatcacatgwtttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgtwactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagrtcttgtctcttgttgtatttgaccccaactgtctatggctttgcctgaacccaaagtacacacagccwagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctccyatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccrtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccrattcaatttcttaacctatctcaaagatggagatcagtgtgagtccaatccatgtttaaatggcggcagttvmaagdrkgacabtaawtcctrtgaawvttggtgtccctttggatttgaaggaaagaactgtgaattaggtaagtractattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcraaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgwgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattgrtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccrgtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtmttgataatgtgctatgtattggtcagtttagtgtttaaacaggctcatttactttgtgaaaacttacactaaaattgtgtgtattttttgaatatatgttatacattaataaatagggtttttaaamctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcmgtttyrtaaaaatagtgctgataacaaggtggyttncyccyvtactgagrvatatcgacttgcagaaaaccakaagyscydtgaaccagyargtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatrccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagstagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcatmagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttyyabnkrraagagtttctgtttcacaaacttctaagctcacchntsctgagrctgtttttcctgatgtggactakgtaaattctactgaagctkaaaccattttggataacatcactcaaagcaccyaatcatttaatgacytcactbngkwtbbtggtggagaagatgccaaaccaggtcaattcccttggcaggtactttatactgatggtgtgtcaaaactggagctcagctggcaagacacrggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggwggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgcwcagagtagkggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggarctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgstcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcaktttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccacttycctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacmgccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtsttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcayaatattccagtttgaaaagggtttgaaaagacctcctagaaaaatcagtagtttttctcttttgagtaacatgtagcaaaaaaaatttcatcatgtaggtacagggaacaccctartaactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgyagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaatagbtgaacrtratawtgaggagacagaacatacagagcaaaagbraaatrtgawtykaattattcctcrcyacaacwrcartgcagctattwataagtrmaaccrkrdmwytghcydtcygkaacnggacgaacccwyagtgctaaasagctrmgttacamhtatktbcattvytgacragkaatrvvhgaacatcttcytcaaatttgkatctgrctadgbaavkrdchdnddaagagdctyccacraabrgagatcaghtttagttcytbmgtmvcttagadttccacytkhtkacbdarmcacayrwhytysayctabarasttcaccwbctawracawcrwrywchnwsctrvcttccatgaargakgtasarrttbanntcaadnavdtrddkrgrvamhcmrwgttactgaagwkkaagggamcagtbyctkmmntrsaattattwbcngdrntrvakrgkrtdhaatgaaaggcaamyrkrbamyatmtahcaaggtatycyrgyrtktcaachrsaytaaggaawaaamaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccrtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcataccttggctttttgtggattccattgatgtgaatcagtcaccctgtatttgatgatgcatgggactactgacaaaatcactctgacccygccaagctgctgccttctcctgccccaacctcacccccagccaggcctcactcttgctagttcctttagttcttttagtcaatatatttttgtcttcgcatataagtataaataaacatatttttaaatttcttggctgggcccagtggctcacgcctataatcccagcacttctggaggccaaggtgggcggatcacctgaggttaggagtttcaggccagcctggccaacatggtgaaaccctgtctctactaaaaatagaacaattagctgggcttggtaatgtgcacctataatcccagctactggggaggctgaggcaggagaatcacttgagcctggggagcagggggtgcgggaggttgcagtgagacaagatcgcaccagtgcactccccatcctgggtgacagagtgagactctgtctcaaagaaaataaataaataaatacatttcttgaggcgtttcttgttaaatcattcatggagaggcatcccaaacactacattcaacaaaacactctgaaaaatgttttcaaatgcaatataacacagcagagatttgatgctctgttatccagttttcatataaggcagtgtgagctgtgtcccagagaggacagtggtctgaatccacctgagacagaattgggtctaactaactgtgagtatggccttcaataagtcactctccatttgggaatttgatttctccacttctataatgagagtatttgacaggatgctctcccaaatcccttgcaattttgttagtctgtgatttcatgtttttatttttattccttcatccaacaaatagtcaaggagtaattgctgtctgccaaataccaacagtattcattaaattgtaattcagattttatatatatataaataatgtataatgtgtataaattgctttgtgagtgcctactacactgctagacagtagttgctcaataattgttagctgaatcagaatccatgtttatcccagagtagcaattagtcttgcatcgagtatcgtgaaagaaggccacgcttaaataagaataatgcctggggtttaggttttatgaaaaaatgaaaggaaattagttctgcttttgttgactaaaggaagggaagagagaagagactataattgtctgcctcagatttaaggaggaggctaattcatgcattaaacacgttacttcaaatttgaatgaccaaaggtctgtagcctcagcacttcaaaattggtaaaagtaagacactctggccttgtttccatagagaccaccccttacaaaggcaccaatgggaaactggcctcaggactcctgttattggtcttctctgtggcagagaaaggagctcttggacccataaatctctgagccacagttctttttgccatgggctcaaaaatgattgaattcatcatgagccacctgtggcatattgccaccactaaacatgtggggcctttaagctcactaagagccaatgtcttcagagccagccctggcttgattctacctagggcatttgcagttgccatataagaatcattagtgctttcaaaattactgtagatactttgcctaaatagactaaaacatgctgccgtcatattggaagtgacagattaaaatagaactcttgccaagtgaaggaaagtgtgctaatataatgcagtcattttaacttgctgtttaagtgtgattgtttttagttcttttgaatattrtttgttttatactgacaggaacgaagtactgtccaattttctctgccaaggaaaaaagaaaaggtgttcttccttacttacctgaaccaaaacagaccagtttacaaaattgcctaattataattgctaaacaagttccgaatgcttacagtctaatccaagaatgtcagagctgcaagggcccttaaacaccatccaatccactccactcatttagcagatgaagagattgagggcaacataaggccaggcccaagataacacaatgacagccaggactagagctcaagtctcccaccctgcactttgaaagaataatgctttcaactggagtacattaactctactgtctatatttttagggcagctggggcattctgcattggtggcaatcctctcaacaaccctgggactgaaaactgcctggaattcttactaacaattctctaattgaccaaaaggtgacgaaatcaaggagaccaataaggtagcttggaaagcagagtggcagtcagataacaaactggagcttcaacccctggctcatagcaggttctcagtaaatacatgtaggataaacgtgtggtgctggtgtctggcgtttagcccagctgtgggcactgggccttccagatgtgacatttgactactatagcacattcaacagtgtcatctggcacacagtcattccagcaacaattcaactttattcactgcaactgtgctggggaagacgtgcggcacacggagacagcaggttactccagaagctgtttgagggttgaaggcaggcttcaaaggcccaccgaagctgagattctaacaatgcattgcacctgcggatgattgggaaacagactacagatgctgaaaggcctctctgagtaaagcaatcaggaatcagagctctttttgaatctgaggcttatgccatctaaaaaatctcagggttaaagccataaaaatcagcatgttgtgtaaactgtggaaactattgaaagaatcacagcaggcaaaggactgtgggacccctgctcttttcaatcaatccaggcccacaaatcactctagtcattttttcctacggtagtttcgaggcaaatctttttcatccagtctttggggctatggactgccttgagatttctgagtcaatctcaacttctaatataggtatcaaaagtgaagaagagcaggcagatcttttcttgcatatgtagacaaagaggcaaagacttctgtctggaagaaggcagagacattttctccatgccttcacagaactatttcaaactcctggccaggtcattccactctaataggagagctatccttctattctcttggttaagagaaagctggaaatagaaacagggatattccaggccagacacaatggctcacgcctgtaatcccaacactttgggaggccgaggcaggcagatcacttgaggtcaggagttcaagattagtctggccaacatggtgaaacccatctttactaaaaatacaaaaattagccgggtgtggtggcgcacgcttataatcccagctactcgggaggctgaggcacgagaattgcttgaacccaggaggcagaggttgcagtgagccaagatcatgccattgcactcacatctgggtgacagagcaagaaaggaagaaagaaaggaagagagagagagagaggaggaaggaaggaaggaaggaaggaaggaaggaaggaaggaaggaagaaaggaaggaaggaaggaaagatactaatgattccaaaggctttcattcaaacagttgctgcattgtaatgttaagtatgagatactaattcataaaaatttaccaccatagtaaatctccctgataccatcactcttaaacctttagaaatgctacagcatctagcttctctagatcaataatcacagaggcttaagtgctgacctcataaagataaagagttcccatgatttacacattacgtgctttcataaatatctatatataaaagcctattttcctcttggactatattacaaaagtaagtatgcattttcataagattcaaacccagctctaaatgtaagaagccaaattaagaatgtagcaatgtatgaatgaaaaggaaggaaaaaagccattactaaccacaactctgtgcaaaactccctgtcatctaaggtaggaataagatatttatcttgaacacataagggaatatgtcatagaaagggagacagggaggttgaggcaggtgactggcttgagctcagaagttcaagagcagcctgggcaacgtggcaaaaccctgtctctacaaaaaatacaaaaattagccaggcatggtggctcatgcctgtagtcccagctactcaggaggctgaggtgggaggatcgcttgaatctgggaggttgaggcagcagagagccatggttgcaccactgcactctagcctgggtggcaaagtgagaccttgtctcagaaaaagaaaaagaggaagggagggagggaggaagggagggagggaggtaagggagggaggaagggaggaagggaaaggaagggagacaaaaatacaaaaaaaaaaaaaaaaggcctcctgcattcactttcttcctaggctataaggaggtgttttcattaatttctaggaaatgtaaaaaagattagcctaggaaactatggttataaccctggcctttttatctcctgttttgtgtttgtcttctccataagctgtatctacccctcttgtctgtgctttctgtcctcatttaggtagctattttgtttttgtaccttatttttatagattcagctcttagctttcatttcaatctctttctccctatagctattacccaatcaaataaccttgtgataaagtttaatatctgaacaaaactgttgttcttggccacagggatttcgtttctctcaatatgcctcccatattttagttgtctatgttctcttccatacactctgtttctagtcctagatgaacatgcttaagattagaatctccacttccttagtttagaaaatctagatttaagtaacagatatgctaaaaggacaggtgcacattacctaatagtgggattgttataattcagaagtcttagtacactctaataaagaattttactgtacactttctatgtacctagcgttgtatctatttcctaaggtgcaatgaatggtatgctggaactggcatatacaaactaactctcaaaaaccaatgttaaaagaaaaactttagacaaaataaattcaactggaggtcattatattaagtgaaataaatgaggcacagaaagataaacatcacatgttctaacttatgtgtgagatctaaagatcaaaataacttaactcatggacatagagcctagaaggatagttaccagaggctggaaagcgtagtggggggttggagggtaagtgaggatggctgatgaatacaaaaaaatagaaagaataagacctagtgtttgatagcacaacagggtgactatagtcaataataatttaattgtacatttgtaataactaaaagagtatcattggattgtttgtaatgcaatgcataaatgcttaaggtgatggagaccccatcttccatgatgtgattattacacattgcatgcttgtaccaaaatatctcatatattccataaatatatacacctactatttacccacaaaaattaaaaataaaaaaggaaaacaaagaaaaagattcaacagagtttatctgagcaaagaatgattcatgaatggtgtagcagtcagaatcaggggaggttcagagagctctgctgcagcagcctgagcagtgagtttttatgggctgacagagaaggaagacaaaatatatttaactggttagagtggaaataccctagttagaggtgagttgctgatttctgattgataaagtctccagtctccttttactgtttacactgggcttcagtttgcttatgtaggaacttaaagggcttgagcggtccaagtcgggtatccagtggcttcccctacccttttttttttttttgaaatggagtctcactctgttgcccggacttgagtccagtggcccgatctcggctcactgcaacctccaccgcccaggttcaagcgattctcctgcctcagcctcctgagta
